US009315822B2

(12) United States Patent
Goldman et al.

(10) Patent No.: US 9,315,822 B2
(45) Date of Patent: Apr. 19, 2016

(54) GENES AND USES FOR PLANT IMPROVEMENT

(71) Applicant: Monsanto Technology LLC, Saint Louis, MO (US)

(72) Inventors: Barry S. Goldman, Saint Louis, MO (US); Mark Scott Abad, Webster Grove, MO (US); Jaishree M. Chittoor-Vijayanath, Wildwood, MO (US); Ronald C. Rich, Raleigh, NC (US); Faten Shaikh, Cary, NC (US); Joseph C. Mitchell, Durham, NC (US); Diana Wray, Raleigh, NC (US)

(73) Assignee: Monsanto Technology LLC, St. Louis, MO (US)

( * ) Notice: Subject to any disclaimer, the term of this patent is extended or adjusted under 35 U.S.C. 154(b) by 191 days.

(21) Appl. No.: 13/914,701

(22) Filed: Jun. 11, 2013

(65) Prior Publication Data

US 2013/0269056 A1 Oct. 10, 2013

Related U.S. Application Data

(63) Continuation of application No. 13/372,542, filed on Feb. 14, 2012, now abandoned, which is a continuation of application No. 12/001,025, filed on Dec. 6, 2007, now abandoned.

(60) Provisional application No. 60/873,247, filed on Dec. 6, 2006.

(51) Int. Cl.
*C12N 15/82* (2006.01)
*C07K 14/415* (2006.01)

(52) U.S. Cl.
CPC .......... *C12N 15/8271* (2013.01); *C07K 14/415* (2013.01); *C12N 15/8241* (2013.01)

(58) Field of Classification Search
None
See application file for complete search history.

(56) References Cited

U.S. PATENT DOCUMENTS

| | | | |
|---|---|---|---|
| 5,387,754 | A | 2/1995 | Weber |
| 5,994,629 | A | 11/1999 | Bojsen et al. |
| 6,342,656 | B1 | 1/2002 | Bradford et al. |
| 6,624,345 | B2 | 9/2003 | Rice |
| 6,803,501 | B2 | 10/2004 | Baerson et al. |
| 2001/0051335 | A1 | 12/2001 | Lalgudi et al. |
| 2003/0182692 | A1 | 9/2003 | Thielen et al. |
| 2006/0150283 | A1 | 7/2006 | Alexandrov et al. |
| 2007/0124833 | A1 | 5/2007 | Abad et al. |
| 2008/0295196 | A1 | 11/2008 | Abad et al. |
| 2012/0167245 | A1 | 6/2012 | Abad et al. |

FOREIGN PATENT DOCUMENTS

| | | |
|---|---|---|
| EP | 1033405 A2 | 9/2000 |
| WO | WO-2008070179 A2 | 6/2008 |

OTHER PUBLICATIONS

"). BLASTp alignment of AGD12 (NCBI Accession No. NP_974582) and AGD13 (NCBI Accession No. NP_567292)", alignment done Dec. 17, 2012 [http://www.ncbi.nlm.nih.gov/BLAST/Blast.cgi], (Dec. 17, 2012), 4 pgs.
"U.S. Appl. No. 12/001,025, Advisory Action mailed Dec. 2, 2011", 4 pgs.
"U.S. Appl. No. 12/001,025, Final Office Action mailed Jul. 21, 2011", 8 pgs.
"U.S. Appl. No. 12/001,025, Non Final Office Action mailed Jan. 31, 2011", 11 pgs.
"U.S. Appl. No. 12/001,025, Non Final Office Action mailed Mar. 5, 2009", 13 pgs.
"U.S. Appl. No. 12/001,025, Non Final Office Action mailed Oct. 6, 2009", 9 pgs.
"U.S. Appl. No. 12/001,025, Non-Final Office Action mailed May 26, 2010", 9 pgs.
"U.S. Appl. No. 12/001,025, Response filed Feb. 8, 2010 to Non Final Office Action mailed Oct. 6, 2009", 11 pgs.
"U.S. Appl. No. 12/001,025, Response filed May 2, 2011 to Non Final Office Action mailed Jan. 31, 2011", 12 pgs.
"U.S. Appl. No. 12/001,025, Response filed Jun. 4, 2009 to Non Final Office Action mailed Mar. 5, 2009", 11 pgs.
"U.S. Appl. No. 12/001,025, Response filed Sep. 27, 2010 to Non Final Office Action mailed May 26, 2010", 11 pgs.
"U.S. Appl. No. 12/001,025, Response filed Nov. 18, 2011 to Final Office Action mailed Jul. 21, 2011", 10 pgs.
"U.S. Appl. No. 12/001,025, Response filed Nov. 20, 2008 to Restriction Requirement mailed Oct. 2, 2008", 8 pgs.
"U.S. Appl. No. 12/001,025, Response filed Nov. 21, 2011 to Final Office Action mailed Jul. 21, 2011", 10 pgs.
"U.S. Appl. No. 12/001,025, Restriction Requirement mailed Oct. 2, 2008", 9 pgs.
"U.S. Appl. No. 13/372,542, Final Office Action mailed Mar. 13, 2013", 17 pgs.
"U.S. Appl. No. 13/372,542, Non Final Office Action mailed Jul. 26, 2012", 14 pgs.
"U.S. Appl. No. 13/372,542, Preliminary Amendment filed Feb. 14, 2012", 7 pgs.

(Continued)

*Primary Examiner* — Brent T Page
(74) *Attorney, Agent, or Firm* — Schwegman Lundberg & Woessner, P.A.

(57) ABSTRACT

Transgenic seed for crops with improved traits are provided by trait-improving recombinant DNA in the nucleus of cells of the seed where plants grown from such transgenic seed exhibit one or more improved traits as compared to a control plant. Of particular interest are transgenic plants that have increased yield. The present invention also provides recombinant DNA molecules for expression of a protein, and recombinant DNA molecules for suppression of a protein.

16 Claims, 17 Drawing Sheets

(56) References Cited

OTHER PUBLICATIONS

"U.S. Appl. No. 13/372,542, Response filed Jun. 25, 2012 to Restriction Requirement mailed Apr. 24, 2012", 7 pgs.
"U.S. Appl. No. 13/372,542, Response filed Dec. 21, 2012 to Non Final Office Action mailed Jul. 26, 2012", 9 pgs.
"U.S. Appl. No. 13/372,542, Restriction Requirement mailed Apr. 24, 2012", 6 pgs.
"International Application Serial No. PCT/US07/25081, International Preliminary Report on Patentability dated Jun. 10, 2009", 6 pgs.
"International Application Serial No. PCT/US07/25081, International Search Report mailed Sep. 23, 2008", 3 pgs.
"International Application Serial No. PCT/US07/25081, Written Opinion mailed Sep. 23, 2008", 5 pgs.
"International Search Report for PCT2007025081".
"NCBI Accession No. AAM61306 (GenBank), putative zinc finger and C2 domain protein [Arabidopsis thaliana]", [online]. [retrieved Jun. 25, 2012]. Retrieved from the Internet: <URL: http://www.ncbi.nlm.nih.gov/protein/AAM61306>, (Jan. 27, 2006), 2 pgs.
"NCBI Accession No. AEE82506 (GenBank): putative ADP-ribosylation factor GTPase-activating protein AGD13 [Arabidopsis thaliana]", [online] [retrieved Jun. 25, 2012]. Retrieved from the Internet: <URL: http://www.ncbi.nlm.nih.gov/protein/AEE82506>, (Jun. 14, 2011), 3 pgs.
Ahn, J. H., et al., "Abstract: Isolation of 151 mutants that have developmental defects from T-DNA tagging", Plant Cell Physiol. Jan. 2007;48(1):169-78. Epub2006 Dec. 12, 2007, 1 pg.
Du, J., et al., "Abstract: Functional gene-mining for salt-tolerance genes with the power of Arabidopsis", Plant J. Nov. 2008; 56(4):653-64. Epub Jul. 4, 2008 1 pg.
Eddy, Sean R, "Profile Hidden Markov models.", Bioinformatics, 14(9), (1998), 755-763.
Fujita, M., et al., "Abstract: Identification of stress-tolerance-related transcription-factor genes via mini-scale Full-length cDNA OvereXpressor (FOX) gene hunting system", Biochem Biophys Res Commun. Dec. 14, 2007:364(2):250-7. Epub Oct. 8, 2007, 1 pg.
Gebbie, Leigh K., et al., "Genes encoding ADP-ribosylation factors in Arabidopsis thaliana L. Heyn.; genome analysis and antisense suppression", Journal of Experimental Botany, vol. 56, No. 414, pp. 1079-1091, Apr. 2005, (Feb. 21, 2005), 1079-1091.

Lee, Mi Hee, et al., "ADP-Ribosylation Factor 1 of Arabidopsis Plays a Critical Role in Intracellular Trafficking and Maintenance of Endoplasmic Reticulum Morphology in Arabidopsis", [Abstract]—Plant Physiology, Aug. 2002, vol. 129, No. 4, 1507-1520, (Aug. 2002), 1 pg.
Lu, C., et al., "Abstract: A high-throughput screen for genes from castor that boost hydroxy fatty acid accumulation in seed oils of transgenic Arabidopsis", Plant J. Mar. 2006;45(5):847-56.
Rama Devi, S., et al., "Abstract: A novel high-throughput genetic screen for stress-responsive mutants of Arabidopsis thaliana reveals new loci involving stress responses", Plant J. Aug. 2006; 47(4):652-63. Epub Jul. 11, 2006, (2006), 1 pg.
Song, Xiu-Fen, "RPA, a Class II ARFGAP Protein, Activates ARF-1 and U5 and Plays a Role in Root Hair Development in Arabidopsis", Plant Physiol. Jul. 2006; 141(3):966-976, (Jul. 2006), 7 pgs.
Takahashi, Y., et al., "Abstract: A high-throughput screen of cell-death-inducing factors in Nicotiana benthamiana identifies a novel MAPKK that mediates INF1-induced cell death signaling and non-host resistance to Pseudomonas cichorii", Plant J. Mar. 2007;49(6):1030-40. Epub Feb. 2, 2007, (Mar. 2007), 1 pg.
Tetlow, I. J., et al., "Recent developments in understanding the regulation of starch metabolism in higher plants", Journal of Experimental Botany, 55(406), (2004), 2131-2145.
Vernoud, Vanessa, et al., "Analysis of the Small GTPase Gene Superfamily of Arabidopsis", Plant Physiology, Mar. 2003, vol. 131, pp. 1191-1208, www.plantphysiol.org, (Mar. 2003), 1191-1208.
Zhang, X., et al., "Abstract: Agrobacterium-mediated transformation of Arabidopsis thaliana using the floral dip method", Nat Protoc. 2006; 1(2):641-6, Epub Jun. 29, 2006, 1 pg.
Broun, P., "Transcriptional Control of Flavanoid Biosynthesis: A Complex Network of Conserved Regulators Involved in Multiple Aspects of Differentiation in Arabidopsis", Current Opinion, Plant Biology, Jun. 2005. Abstract Only, 1 pg.
Holm, M., et al., "Identification of a structural motif that confers specific interaction with the WD40 repeat domain of Arabidopsis COP1", EMBO—Dept. of Molecular, Cellular and Developmental Biology, Yale University, OML 354, Yale University. Jan. 15, 2001. Abstract Only, 2 pgs.
Shi, DQ, et al., "Slow Walker1, essential for gametogensis in Arabidopsis, encodes a WD40 protein involved in 18S ribosomal RNA biogenesis", Plant Cell. Aug. 2005. Abstract Only, 2 pgs.
Yizhou, Joseph HE, et al., "DDB1 Functions as a Linker to Recruit Receptor WD40 proteins to CUL4-ROC1 ubitquitin ligases", Genes & Development www.genesdev.org, 2006, pp. 2949-2954.

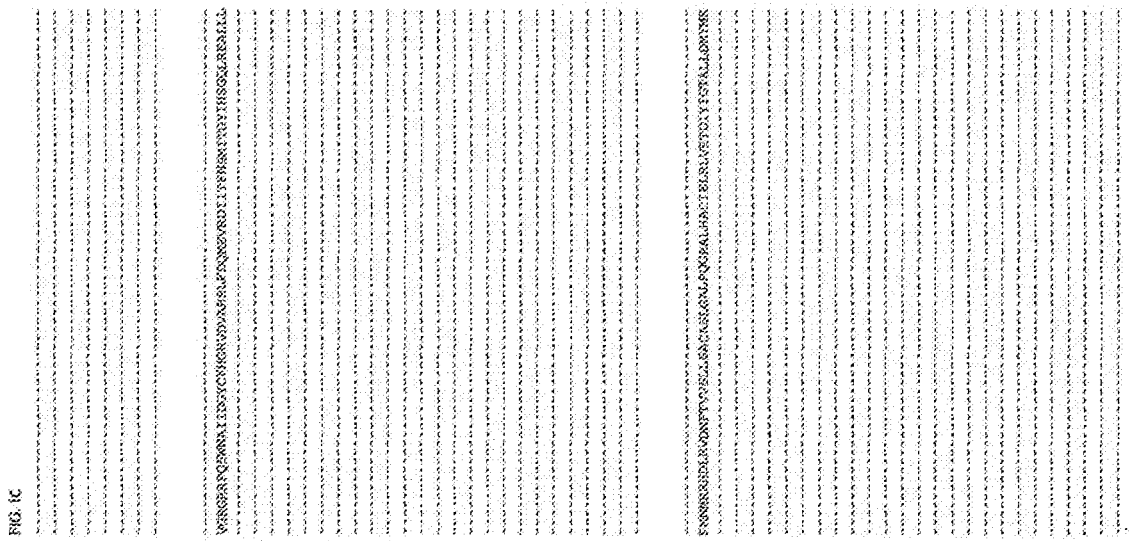

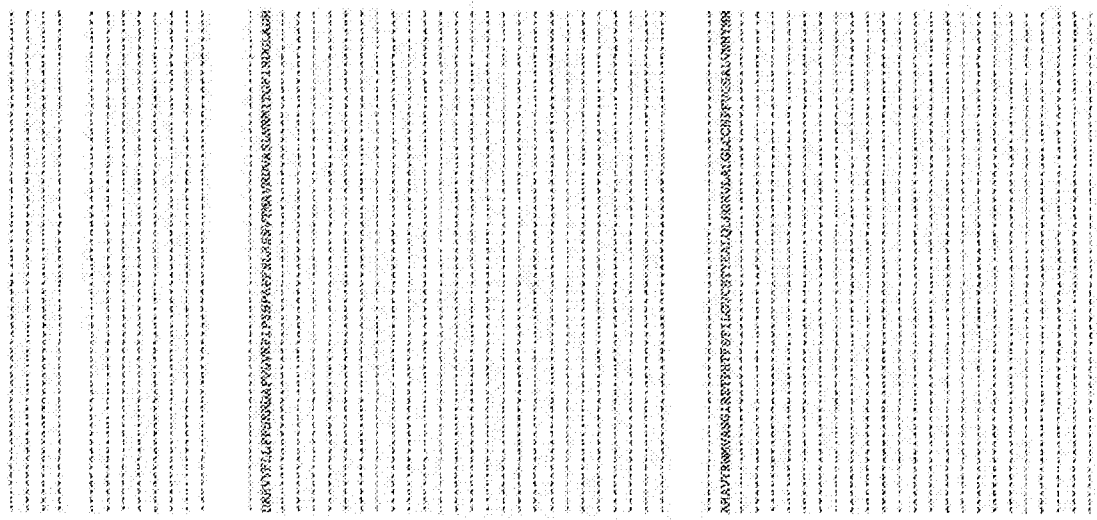

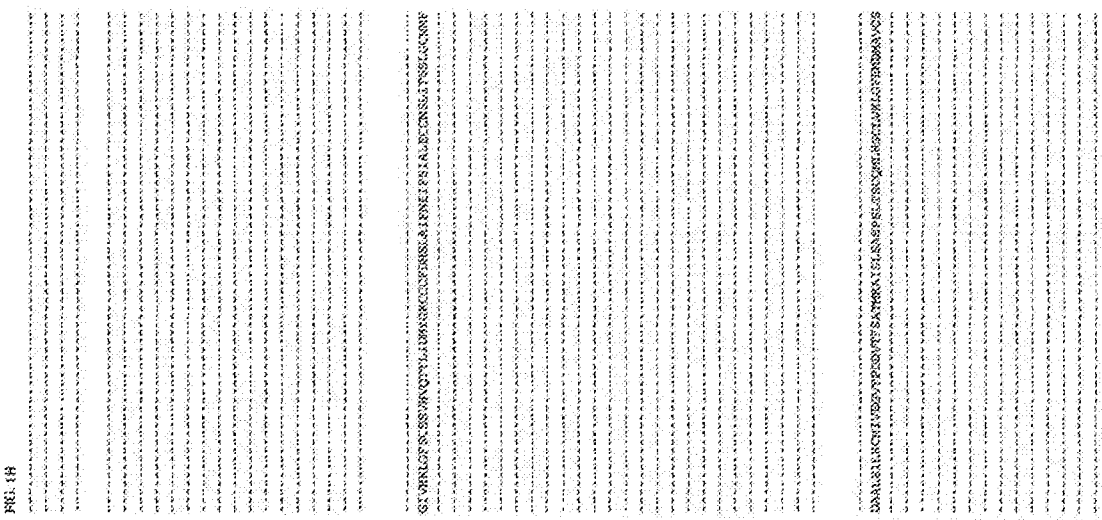

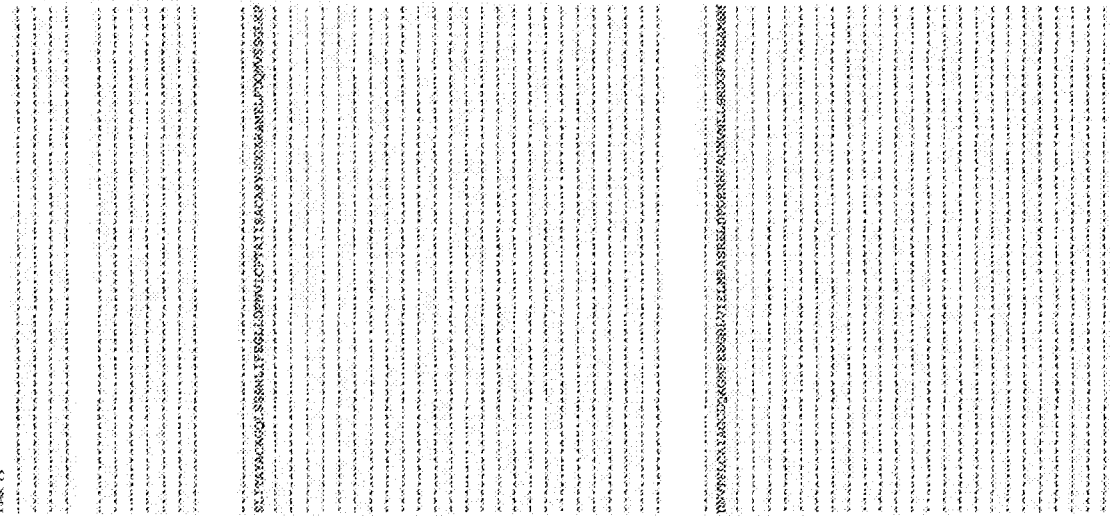

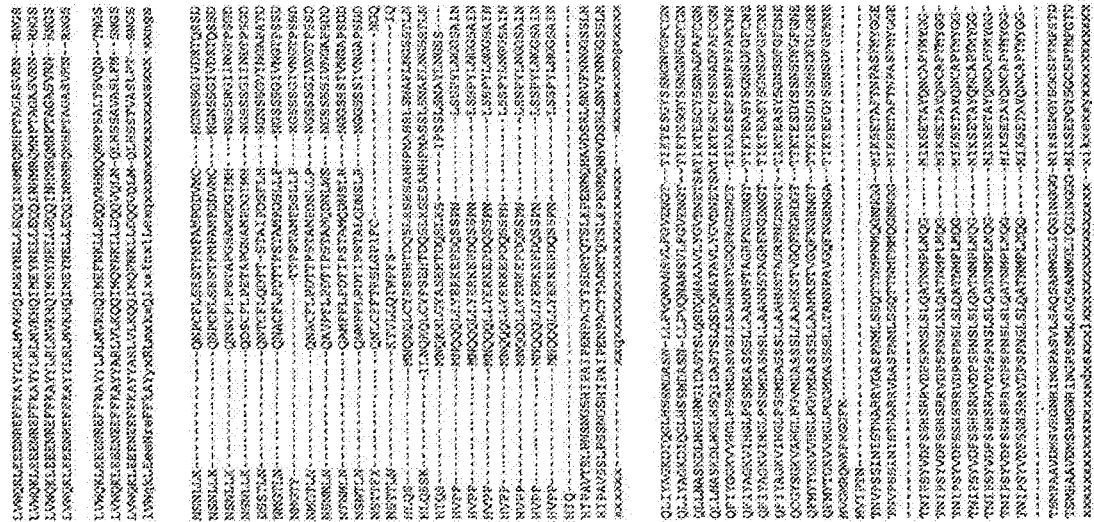

FIG. 18

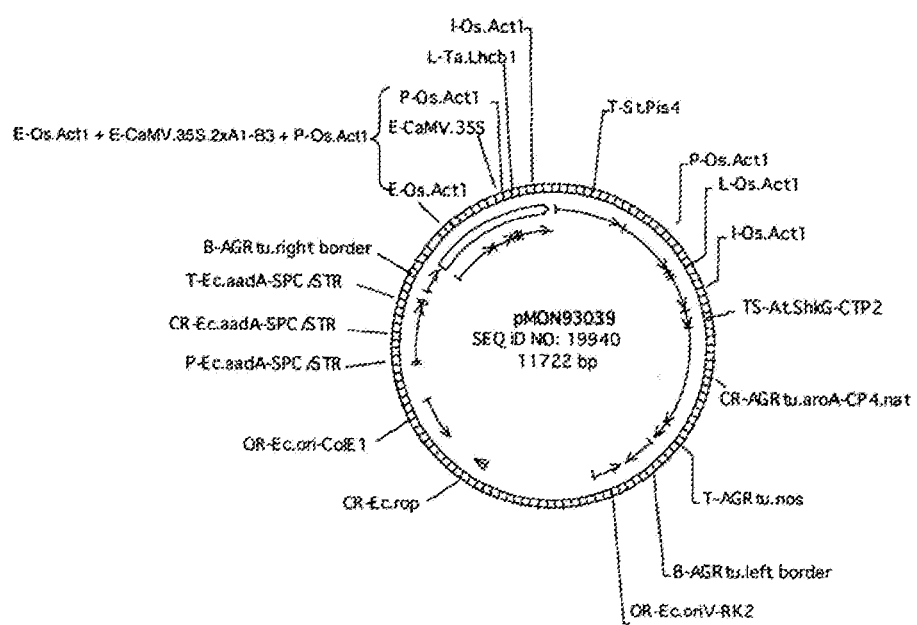

GENES AND USES FOR PLANT IMPROVEMENT

CROSS REFERENCE TO RELATED APPLICATIONS

This application is a continuation under 35 U.S.C. §120 of U.S. application Ser. No. 13/372,542 filed Feb. 14, 2012 (pending), which is incorporated by reference in its entirety including sequence listing and Pfam tables. Application Ser. No. 13/372,542 is a continuation under 35 U.S.C. §120 of U.S. application Ser. No. 12/001,025 filed on Dec. 6, 2007 (abandoned); application Ser. No. 12/001,025 claims benefit under 35 USC §119(e) of U.S. provisional application Ser. No. 60/873,247, filed Dec. 6, 2006, all of which are incorporated herein by reference in its entirety including sequence listing and Pfam tables.

INCORPORATION OF SEQUENCE LISTING

A computer readable form (CRF) of the sequence listing file named "53949D_SeqListing.txt", which is 67,079,223 bytes (measured in MS-WINDOWS), created on Jun. 7, 2013, filed concurrently herewith, is incorporated herein by reference in its entirety.

INCORPORATION OF LARGE TABLE

A large table containing a folder "pfamdir" on CD-Rs were previously submitted in the parent U.S. application Ser. No. 12/001,025 on Dec. 6, 2007. The content of which are incorporated herein by reference in their entirety. For example, folder "pfamdir" contains 161 Pfam Hidden Markov Models, and Folder hmmer-2.3.2 contains the source code and other associated file for implementing the HMMer software for Pfam analysis. The CD-Rs were created on Dec. 4, 2007, having a total size of Ser. No. 15/534,080 bytes (measured in MS-WINDOWS).

FIELD OF THE INVENTION

Disclosed herein are transgenic plant cells, plants and seeds comprising recombinant DNA and methods of making and using such plant cells, plants and seeds

BACKGROUND OF THE INVENTION

Transgenic plants with enhanced traits such as improved yield, environmental stress tolerance, pest resistance, herbicide tolerance, modified seed compositions, and the like are desired by both farmers and consumers. Although considerable efforts in plant breeding have provided significant gains in desired traits, the ability to introduce specific DNA into plant genomes provides further opportunities for generation of plants with improved and/or unique traits. The ability to develop transgenic plants with improved traits depends in part on the identification of useful recombinant DNA for production of transformed plants with improved properties, e.g. by actually selecting a transgenic plant from a screen for such improved property. An object of this invention is to provide transgenic plant cell nuclei, plant cells, plants and seeds by screening transgenic crop plants for one of more enhanced agronomic traits where the nucleus in cells of the plant or seed has recombinant DNA that was identified as imparting an improved trait in a model plant, e.g. *Arabidopsis thaliana*. In some cases the model plant may exhibit an improved trait that corresponds to an enhanced agronomic trait, e.g. cold stress tolerance, water deficit stress tolerance, low nitrogen stress tolerance and the like. In other cases the model plant may exhibit an improved trait that is a surrogate to an enhanced agronomic trait, e.g. salinity stress tolerance being a surrogate to drought tolerance or improvement in plant growth and development being a surrogate to enhanced yield. A further object of the invention is to provide screening methods requiring routine experimentation by which such transgenic plant cell nuclei, cells, plants and seeds can be identified by making a reasonable number of transgenic events and engaging in screening identified in this specification and illustrated in the examples.

SUMMARY OF THE INVENTION

This invention provides plant cell nuclei with recombinant DNA that imparts enhanced agronomic traits in transgenic plants having the nuclei in their cells. Recombinant DNA in this invention is provided in a construct comprising a promoter that is functional in plant cells and that is operably linked to DNA that encodes a protein having at least one amino acid domain in a sequence that exceeds the Pfam gathering cutoff for amino acid sequence alignment with a protein domain family identified by a Pfam name in the group of Pfam domain names identified in Table 17. In more specific embodiments of the invention plant cells are provided which express a protein having amino acid sequence with at least 90% identity to a consensus amino acid sequence in the group of consensus amino acid sequences consisting of the consensus amino acid sequence constructed for SEQ ID NO: 198 and homologs thereof listed in Table 2 through the consensus amino acid sequence constructed for SEQ ID NO: 394 and homologs thereof listed in Table 2. Amino acid sequences of homologs are SEQ ID NO: 395 through 19,938. In even more specific embodiments of the invention the protein expressed in plant cells is a protein selected from the group of proteins identified in Table 1 by annotation to a related protein in Genbank and alternatively identified in Table 16 by identification of protein domain family.

Other aspects of the invention are specifically directed to transgenic plant cells, and transgenic plants comprising a plurality of plant cells with such nuclei, progeny transgenic seed, embryo and transgenic pollen from such plants. Such plant cell nuclei are selected from a population of transgenic plants regenerated from plant cells with a nucleus transformed with recombinant DNA by screening the transgenic plants in the population for an enhanced trait as compared to control plants that do not have the recombinant DNA in their nucleus, where the enhanced trait is enhanced water use efficiency, enhanced cold tolerance, enhanced heat tolerance, enhanced shade tolerance, enhanced tolerance to salt exposure, increased yield, enhanced nitrogen use efficiency, enhanced seed protein or enhanced seed oil. In some aspects of the invention the recombinant DNA expresses a protein that imparts the enhanced trait; in other aspects of the invention the recombinant DNA expresses RNA for suppressing the level of an endogenous protein. In yet another aspect of the invention the nucleus of plant cells in plants, seeds, embryo and pollen further comprise DNA expressing a protein that provides tolerance from exposure to an herbicide applied at levels that are lethal to a wild type plant cell. Such tolerance is especially useful not only as an advantageous trait in such plants but is also useful in a selection step in the methods of the invention. In aspects of the invention the agent of such herbicide is a glyphosate, dicamba, or glufosinate compound.

Yet other aspects of the invention provide nuclei in cells of transgenic plants which are homozygous for the recombinant DNA and transgenic seed of the invention from corn, soybean, cotton, canola, alfalfa, wheat or rice plants.

In other embodiments for practice of various aspects of the invention in Argentina the recombinant DNA in the nucleus is provided in plant cells derived from corn lines that are and maintain resistance to a virus such as the Mal de Rio Cuarto virus or a fungus such as the *Puccina sorghi* fungus or to both.

This invention also provides methods for manufacturing non-natural, transgenic seed that can be used to produce a crop of transgenic plants with an enhanced trait resulting from expression of stably-integrated, recombinant DNA in the nucleus of the plant cells. In some aspects of the invention the recombinant DNA can express a protein having at least one domain of amino acids in a sequence that exceeds the Pfam gathering cutoff for amino acid sequence alignment with a protein domain family identified by a Pfam name in the group of Pfam names identified in Table 17; in other aspects the recombinant DNA suppresses the level of such a protein. More specifically the method comprises (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants; (c) verifying that the recombinant DNA is stably integrated in said selected plants; (d) analyzing tissue of a selected plant to determine the production of a protein having the function of a protein encoded by nucleotides in a sequence of one of SEQ ID NO: 1-197; and (e) collecting seed from a selected plant. In one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, alfalfa, wheat or rice seed selected as having at least one of the enhanced traits described above.

Another aspect of the invention provides a method of producing hybrid corn seed comprising acquiring hybrid corn seed from a herbicide tolerant corn plant which also has a nucleus of this invention with stably-integrated, recombinant DNA The method further comprises producing corn plants from said hybrid corn seed, where a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising a nucleus of this invention in its plant cells by using an immunoreactive antibody to detect the presence of protein expressed by recombinant DNA in seed or plant tissue. Another aspect of the invention provides anti-counterfeit milled seed having, as an indication of origin, a nucleus of this invention with unique recombinant DNA.

Aspects of the invention relating to nucleus in plant cells having recombinant DNA for suppressing the expression of a protein are identified in Table 1 and Table 16. More specific aspects of the invention provide plant cells having recombinant DNA for suppressing the expression of a protein having the function in a plant of the protein with amino acid sequence of SEQ ID NO: 200, 201, 205, 207, 211 and 394 or the corresponding Pfam identified in Table 16, i.e. SNF5, LMBR1, TFIIS_M, TFIIS_C, Glyco_transf_8, respectively. Such suppression can be effected by any of a number of ways known in the art, e.g. anti-sense suppression, RNAi or mutation knockout and the like.

Another aspect of this invention relates to growing transgenic plants with enhanced water use efficiency or enhanced nitrogen use efficiency. For instance, this invention provides methods of growing a corn, cotton or soybean crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton or soybean crop without added nitrogen fertilizer comprising planting seed having plant cells of the invention which are selected for enhanced nitrogen use efficiency. Alternatively methods comprise applying reduced amount of nitrogen input as compared to the conventional input during the production of a corn crop.

The various aspects of this invention are especially useful for transgenic plant cells in seeds and transgenic plants having any of the above-described enhanced traits in crop plants such as corn (maize), soybean, cotton, canola (rape), wheat, sunflower, sorghum, alfalfa, barley, millet, rice, tobacco, fruit and vegetable crops, and turfgrass.

The invention also provides recombinant DNA constructs comprising the DNA useful in the nuclei in plant cells for imparting enhanced traits in plants having those cells.

BRIEF DESCRIPTION OF THE DRAWINGS

FIGS. 2, 3 and 4 illustrate plasmid maps.

DETAILED DESCRIPTION OF THE INVENTION

Figure 1G:
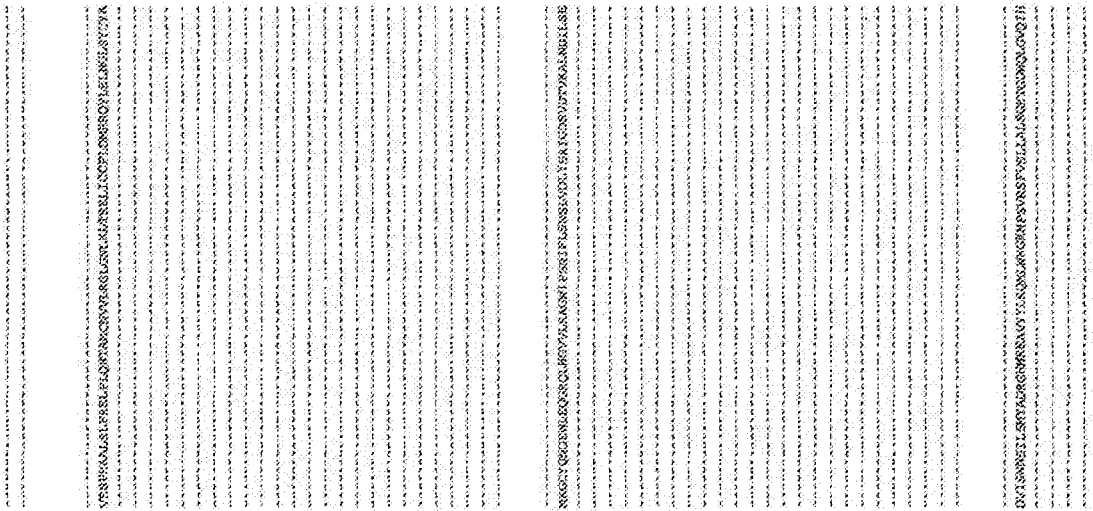
FIGS. 1A-1N illustrate a consensus amino acid sequence of SEQ ID NO: 227 and its homologs.
Figure 13A:
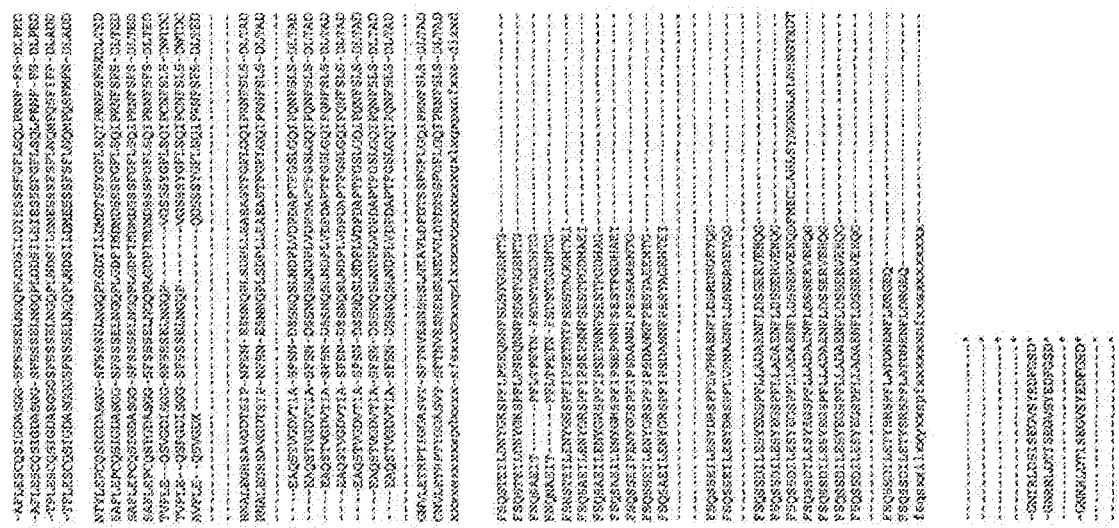

In the attached sequence listing:

SEQ ID NO: 1-197 are nucleotide sequences of the coding strand of DNA for "genes" used in the recombinant DNA imparting an enhanced trait in plant cells, i.e. each represents a coding sequence for a protein;

SEQ ID NO: 198-394 are amino acid sequences of the cognate protein of the "genes" with nucleotide coding sequence 1-197;

SEQ ID NO: 395-19938 are amino acid sequences of homologous proteins;

SEQ ID NO: 19939 is a consensus amino acid sequence.

SEQ ID NO: 19940 is a nucleotide sequence of a plasmid base vector useful for corn transformation; and SEQ ID NO: 19941 is a DNA sequence of a plasmid base vector useful for soybean or canola transformation.

SEQ ID NO:19942 is a DNA sequence of a plasmid base vector useful for cotton transformation.

The nuclei of this invention are identified by screening transgenic plants for one or more traits including improved drought stress tolerance, improved heat stress tolerance, improved cold stress tolerance, improved high salinity stress tolerance, improved low nitrogen availability stress tolerance, improved shade stress tolerance, improved plant growth and development at the stages of seed imbibition through early vegetative phase, and improved plant growth and development at the stages of leaf development, flower production and seed maturity.

"Gene" refers to chromosomal DNA, plasmid DNA, cDNA, synthetic DNA, or other DNA that encodes a peptide, polypeptide, protein, or RNA molecule, and regions flanking the coding sequences involved in the regulation of expression. In aspects of the invention where an improved trait is provided by expression of a protein, "gene" refers at least to coding nucleotide sequence for a protein or a functional polypeptide fragment of a protein that imparts the trait. In aspects of the invention where an improved trait is provided by suppression of expression of an endogenous protein, "gene" refers to any part of the gene that can be a target for suppression.

"Transgenic seed" means a plant seed whose nucleus has been altered by the incorporation of recombinant DNA, e.g., by transformation as described herein. The term "transgenic plant" is used to refer to the plant produced from an original transformation event, or progeny from later generations or crosses of a plant to a transformed plant, so long as the progeny contains a nucleus with the recombinant DNA in its genome.

"Recombinant DNA" means a polynucleotide having a genetically engineered modification introduced through combination of endogenous and/or exogenous elements in a transcription unit, manipulation via mutagenesis, restriction enzymes, and the like or simply by inserting multiple copies of a native transcription unit. Recombinant DNA may comprise DNA segments obtained from different sources, or DNA segments obtained from the same source, but which have been manipulated to join DNA segments which do not naturally exist in the joined form. A recombinant polynucleotide may exist outside of the cell, for example as a PCR fragment, or integrated into a genome, such as a plant genome.

"Trait" means a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g., by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

A "control plant" is a plant without trait-improving recombinant DNA in its nucleus. A control plant is used to measure and compare trait improvement in a transgenic plant with such trait-improving recombinant DNA. A suitable control plant may be a nontransgenic plant of the parental line used to generate a transgenic plant herein. Alternatively, a control plant may be a transgenic plant that comprises an empty vector or marker gene, but does not contain the recombinant DNA that produces the trait improvement. A control plant may also be a negative segregant progeny of hemizygous transgenic plant. In certain demonstrations of trait improvement, the use of a limited number of control plants can cause a wide variation in the control dataset. To minimize the effect of the variation within the control dataset, a "reference" is used. As use herein a "reference" is a trimmed mean of all data from both transgenic and control plants grown under the same conditions and at the same developmental stage. The trimmed mean is calculated by eliminating a specific percentage, e.g., 20%, of the smallest and largest observation from the data set and then calculating the average of the remaining observation.

"Trait enhancement" means a detectable and desirable difference in a characteristic in a transgenic plant relative to a control plant or a reference. In some cases, the trait enhancement can be measured quantitatively. For example, the trait improvement can entail at least a 2% desirable difference in an observed trait, at least a 5% desirable difference, at least about a 10% desirable difference, at least about a 20% desirable difference, at least about a 30% desirable difference, at least about a 50% desirable difference, at least about a 70% desirable difference, or at least about a 100% difference, or an even greater desirable difference. In other cases, the trait enhancement is only measured qualitatively. It is known that there can be a natural variation in a trait. Therefore, the trait enhancement observed entails a change of the normal distribution of the trait in the transgenic plant compared with the trait distribution observed in a control plant or a reference, which is evaluated by statistical methods provided herein. Trait enhancement includes, but is not limited to, yield increase, including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

"Yield-limiting environment" means the condition under which a plant would have the limitation on yield including environmental stress conditions.

"Stress condition" means a condition unfavorable for a plant, which adversely affect plant metabolism, growth and/or development. A plant under the stress condition typically shows reduced germination rate, retarded growth and development, reduced photosynthesis rate, and eventually leading to reduction in yield. Specifically, "water deficit stress" used herein preferably refers to the sub-optimal conditions for water and humidity needed for normal growth of natural plants. Relative water content (RWC) can be used as a physiological measure of plant water deficit. It measures the effect of osmotic adjustment in plant water status, when a plant is under stress conditions. Conditions that may result in water deficit stress include heat, drought, high salinity and PEG induced osmotic stress.

"Cold stress" means the exposure of a plant to a temperatures below (two or more degrees Celsius below) those normal for a particular species or particular strain of plant.

"Nitrogen nutrient" means any one or any mix of the nitrate salts commonly used as plant nitrogen fertilizer, including, but not limited to, potassium nitrate, calcium nitrate, sodium nitrate, ammonium nitrate. The term ammonium as used herein means any one or any mix of the ammonium salts commonly used as plant nitrogen fertilizer, e.g., ammonium nitrate, ammonium chloride, ammonium sulfate, etc.

"Low nitrogen availability stress" means a plant growth condition that does not contain sufficient nitrogen nutrient to maintain a healthy plant growth and/or for a plant to reach its typical yield under a sufficient nitrogen growth condition. For example, a low nitrogen condition can refers to a growth condition with 50% or less of the conventional nitrogen inputs. "Sufficient nitrogen growth condition" means a growth condition where the soil or growth medium contains or receives optimal amounts of nitrogen nutrient to sustain a healthy plant growth and/or for a plant to reach its typical yield for a particular plant species or a particular strain. One skilled in the art would recognize what constitute such soil, media and fertilizer inputs for most plant species.

"Shade stress" means a growth condition that has limited light availability that triggers the shade avoidance response in plant. Plants are subject to shade stress when localized at lower part of the canopy, or in close proximity of neighboring vegetation. Shade stress may become exacerbated when the planting density exceeds the average prevailing density for a particular plant species. The average prevailing densities per acre of a few examples of crop plants in the USA in the year 2000 were: wheat 1,000,000-1,500,000; rice 650,000-900,000; soybean 150,000-200,000, canola 260,000-350,000, sunflower 17,000-23,000 and cotton 28,000-55,000 plants per acre (Cheikh, e.g., (2003) U.S. Patent Application No. 20030101479).

"Increased yield" of a transgenic plant of the present invention is evidenced and measured in a number of ways, including test weight, seed number per plant, seed weight, seed number per unit area (i.e., seeds, or weight of seeds, per acre), bushels per acre, tons per acre, tons per acre, kilo per hectare. For example, maize yield can be measured as production of shelled corn kernels per unit of production area, e.g., in bushels per acre or metric tons per hectare, often reported on a moisture adjusted basis, e.g., at 15.5% moisture. Increased yield can result from improved utilization of key biochemical compounds, such as nitrogen, phosphorous and carbohydrate, or from improved tolerance to environmental stresses, such as cold, heat, drought, salt, and attack by pests or pathogens. Trait-improving recombinant DNA can also be used to provide transgenic plants having improved growth and development, and ultimately increased yield, as the result of modified expression of plant growth regulators or modification of cell cycle or photosynthesis pathways.

"Expression" means transcription of DNA to produce RNA. The resulting RNA may be without limitation mRNA encoding a protein, antisense RNA, or a double-stranded RNA for use in RNAi technology. Expression also refers to production of encoded protein from mRNA.

A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such Agrobacterium or Rhizobium. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions. As used herein, "antisense orientation" includes reference to a polynucleotide sequence that is operably linked to a promoter in an orientation where the antisense strand is transcribed. The antisense strand is sufficiently complementary to an endogenous transcription product such that translation of the endogenous transcription product is often inhibited.

As used herein, "operably linked" refers to the association of two or more nucleic acid fragments on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

A "consensus sequence" refers to an artificial, amino acid sequence of conserved parts of the proteins encoded by homologous genes, e.g., as determined by a CLUSTALW alignment of amino acid sequence of homolog proteins.

Homologous genes are genes which encode proteins with the same or similar biological function to the protein encoded by the second gene. Homologous genes may be generated by the event of speciation (see ortholog) or by the event of genetic duplication (see paralog). "Orthologs" refer to a set of homologous genes in different species that evolved from a common ancestral gene by specification. Normally, orthologs retain the same function in the course of evolution; and "paralogs" refer to a set of homologous genes in the same species that have diverged from each other as a consequence of genetic duplication. Thus, homologous genes can be from the same or a different organism. As used herein, "homolog" means a protein that performs the same biological function as a second protein including those identified by sequence identity search.

Percent identity refers to the extent to which two optimally aligned DNA or protein segments are invariant throughout a window of alignment of components, e.g., nucleotide sequence or amino acid sequence. An "identity fraction" for aligned segments of a test sequence and a reference sequence is the number of identical components which are shared by sequences of the two aligned segments divided by the total number of sequence components in the reference segment over a window of alignment which is the smaller of the full test sequence or the full reference sequence. "Percent identity" ("% identity") is the identity fraction times 100. "% identity to a consensus amino acid sequence" is 100 times the identity fraction in a window of alignment of an amino acid sequence of a test protein optimally aligned to consensus amino acid sequence of this invention.

"*Arabidopsis*" means plants of *Arabidopsis thaliana*.

"Pfam" refers to a large collection of multiple sequence alignments and hidden Markov models covering many common protein families, e.g. Pfam version 18.0 (August 2005)

contains alignments and models for 7973 protein families and is based on the Swissprot 47.0 and SP-TREMBL 30.0 protein sequence databases. See S. R. Eddy, "Profile Hidden Markov Models", *Bioinformatics* 14:755-763, 1998. Pfam is currently maintained and updated by a Pfam Consortium. The alignments represent some evolutionary conserved structure that has implications for the protein's function. Profile hidden Markov models (profile HMMs) built from the Pfam alignments are useful for automatically recognizing that a new protein belongs to an existing protein family even if the homology by alignment appears to be low. Once one DNA is identified as encoding a protein which imparts an enhanced trait when expressed in transgenic plants, other DNA encoding proteins in the same protein family are identified by querying the amino acid sequence of protein encoded by candidate DNA against the Hidden Markov Model which characterizes the Pfam domain using HMMER software, a current version of which is provided in the appended computer listing. Candidate proteins meeting the gathering cutoff for the alignment of a particular Pfam are in the protein family and have cognate DNA that is useful in constructing recombinant DNA for the use in the plant cells of this invention. Hidden Markov Model databases for use with HMMER software in identifying DNA expressing protein in a common Pfam for recombinant DNA in the plant cells of this invention are also included in the appended computer listing. The HMMER software and Pfam databases are version 18.0 and were used to identify known domains in the proteins corresponding to amino acid sequence of SEQ ID NO: 198 through SEQ ID NO: 394. All DNA encoding proteins that have scores higher than the gathering cutoff disclosed in Table 17 by Pfam analysis disclosed herein can be used in recombinant DNA of the plant cells of this invention, e.g. for selecting transgenic plants having enhanced agronomic traits. The relevant Pfams for use in this invention, as more specifically disclosed below, are L51_S25_CI-B8, iPGM_N, WD40, BPL_LipA_LipB, DUF676, AAA, S_locus_glycop, ArfGap, Rotamase, Metallophos, CMAS, Sugar_tr, LMBR1, RrnaAD, NAF, BolA, Pkinase, C2, FA_hydroxylase, p450, Complex1_30 kDa, Histone, DUF822, PEP-utilizers, PCI, ETC_C1_NDUFA5, 2-Hacid_dh, Tryp_alpha_amyl, PK_C, MAP65_ASE1, FBPase, SWIB, Ank, Ribosomal_S8e, 2-Hacid_dh_C, SMC_N, GTP_cyclohydro2, PfkB, ORMDL, ADH_zinc_N, SWIM, TrkA_N, HLH, GH3, SNF5, Ceramidase_alk, Ribonuclease_T2, Complex1_49 kDa, Gp_dh_C, Aldo_ket_red, zf-AN1, TFIIS_C, MFS_1, Thioredoxin, DUF1005, LEA_3, Sterol_MT_C, Gp_dh_N, TFIIS_M, PAN_2, BPL_C, DUF26, Aa_trans, ACT, ADH_N, NAD_binding_1, Auxin_inducible, B_lectin, Anti-silence, Response_reg, 14-3-3, LRRNT_2, GDC-P, zf-CCHC, NPH3, TPR_1, TFIIA, DHBP_synthase, UQ_con, TPR_2, TPT, F-box, adh_short, Cyclin_C, Na_H_Exchanger, AA_permease, MtN3_slv, TIM, NDK, Pantoate_transf, Allene_ox_cyc, Cyclin_N, Methyltransf_11, CBM_20, Methyltransf_12, Rhodanese, Glycolytic, Actin, Usp, eIF-4B, Glyco_transf_8, BURP, Alpha-amylase, F420_oxidored, EGF_CA, Kelch_1, PGAM, Aminotran_1_2, Kelch_2, UPF0261, CoA_binding, DUF868, Peptidase_S10, Lung_7-TM_R, Oleosin, Sad1_UNC, Gln-synt_C, LSM, NTP_transferase, Metalloenzyme, Prenylcys_lyase, Subtilisin_N, SAM_1, DUF298, ESCRT-III, DNA_pol_E_B, Aminotran_3, NAD_Gly3P_dh_N, Gln-synt_N, MMR_HSR1, DUF588, zf-CCCH, DnaJ, Pkinase_Tyr, Cupin_2, LRR_1, Cupin_3, zf-CSL, FAR1, HD, FH2, APC8, PTR2, MannoseP_isomer, Rib_5-P_isom_A, DUF1336, Phosphorylase, DUF1191, Asp, Mit_rib_S27, PAP_fibrillin, DUF1195, Aldedh, zf-C3HC4, PPR, PK, PurA, RMMBL, HTH_11, Tim17, and PBD.

Recombinant DNA Constructs

The present invention provides recombinant DNA constructs comprising one or more polynucleotides disclosed herein for imparting one or more improved traits to transgenic plant when incorporated into the nucleus of the plant cells. Such constructs also typically comprise a promoter operatively linked to said polynucleotide to provide for expression in the plant cells. Other construct components may include additional regulatory elements, such as 5' or 3' untranslated regions (such as polyadenylation sites), intron regions, and transit or signal peptides. Such recombinant DNA constructs can be assembled using methods known to those of ordinary skill in the art.

In a preferred embodiment, a polynucleotide of the present invention is operatively linked in a recombinant DNA construct to a promoter functional in a plant to provide for expression of the polynucleotide in the sense orientation such that a desired protein or polypeptide fragment of a protein is produced. Also provided are embodiments wherein a polynucleotide is operatively linked to a promoter functional in a plant to provide for expression of gene suppression RNA to suppress the level of an endogenous protein.

Recombinant constructs prepared in accordance with the present invention also generally include a 3' untranslated DNA region (UTR) that typically contains a polyadenylation sequence following the polynucleotide coding region. Examples of useful 3' UTRs include those from the nopaline synthase gene of *Agrobacterium tumefaciens* (nos), a gene encoding the small subunit of a ribulose-1,5-bisphosphate carboxylase-oxygenase (rbcS), and the T7 transcript of *Agrobacterium tumefaciens*.

Constructs and vectors may also include a transit peptide for targeting of a gene target to a plant organelle, particularly to a chloroplast, leucoplast or other plastid organelle. For descriptions of the use of chloroplast transit peptides, see U.S. Pat. No. 5,188,642 and U.S. Pat. No. 5,728,925, incorporated herein by reference.

Table 1 provides a list of genes that provided recombinant DNA that was expressed in a model plant and identified from screening as imparting an improved trait. When the stated orientation is "sense", the expression of the gene or a homolog in a crop plant provides the means to identify transgenic events that provide an enhanced trait in the crop plant. When the stated orientation is "antisense", the suppression of the native homolog in a crop plant provides the means to identify transgenic events that provide an enhanced trait in the crop plant. In some cases the expression/suppression in the model plant exhibited an improved trait that corresponds to an enhanced agronomic trait, e.g. cold stress tolerance, water deficit stress tolerance, low nitrogen stress tolerance and the like. In other cases the expression/suppression in the model plant exhibited an improved trait that is a surrogate to an enhance agronomic trait, e.g. salinity stress tolerance being a surrogate to drought tolerance or improvement in plant growth and development being a surrogate to enhanced yield. Even when expression of a transgene or suppression of a native gene imparts an improved trait in a model plant, not every crop plant expressing the same transgene or suppressing the same native gene will necessarily demonstrate an indicated enhanced agronomic trait. For instance, it is well known that multiple transgenic events are required to identify a transgenic plant that can exhibit an enhanced agronomic trait. However, by with routine experimentation a transgenic plant cell nuclei, cell, plant or seed of this invention can be identified by making a reasonable number of transgenic events and engaging in screening process identified in this specification and illustrated in the examples. An understanding of Table 1 is facilitated by the following description of the headings:

"NUC SEQ ID NO" refers to a SEQ ID NO. for particular DNA sequence in the Sequence Listing.

"PEP SEQ ID NO" refers to a SEQ ID NO. in the Sequence Listing for the amino acid sequence of a protein cognate to a particular DNA "construct_id" refers to an arbitrary number used to identify a particular recombinant DNA construct comprising the particular DNA.

"Gene ID" refers to an arbitrary name used to identify the particular DNA.

"orientation" refers to the orientation of the particular DNA in a recombinant DNA construct relative to the promoter.

TABLE 1

| NUC Seq ID No. | PEP SEQ ID No | Gene ID | Construct ID | Orientation |
|---|---|---|---|---|
| 1 | 198 | CGPG106 | 11029 | SENSE |
| 2 | 199 | CGPG1133 | 12223 | SENSE |
| 3 | 200 | CGPG117 | 10422 | ANTI-SENSE |
| 4 | 201 | CGPG1226 | 13485 | ANTI-SENSE |
| 5 | 202 | CGPG1288 | 13235 | SENSE |
| 6 | 203 | CGPG1301 | 13411 | SENSE |
| 7 | 204 | CGPG1458 | 73944 | SENSE |
| 8 | 205 | CGPG1542 | 13846 | ANTI-SENSE |
| 9 | 206 | CGPG170 | 12602 | SENSE |
| 10 | 207 | CGPG1828 | 74065 | ANTI-SENSE |
| 11 | 208 | CGPG2206 | 72783 | SENSE |
| 12 | 209 | CGPG2217 | 17210 | SENSE |
| 13 | 210 | CGPG2292 | 72724 | SENSE |
| 14 | 211 | CGPG2457 | 17805 | ANTI-SENSE |
| 15 | 212 | CGPG2499 | 16610 | SENSE |
| 16 | 213 | CGPG2653 | 76602 | SENSE |
| 17 | 214 | CGPG2813 | 18456 | SENSE |
| 18 | 215 | CGPG3002 | 18414 | SENSE |
| 19 | 216 | CGPG3154 | 71538 | SENSE |
| 20 | 217 | CGPG3235 | 76532 | SENSE |
| 21 | 218 | CGPG3274 | 18231 | SENSE |
| 22 | 219 | CGPG3275 | 18232 | SENSE |
| 23 | 220 | CGPG3363 | 18256 | SENSE |
| 24 | 221 | CGPG3367 | 18258 | SENSE |
| 25 | 222 | CGPG3375 | 19193 | SENSE |
| 26 | 223 | CGPG3528 | 71301 | SENSE |
| 27 | 224 | CGPG3534 | 18354 | SENSE |
| 28 | 225 | CGPG3638 | 77334 | SENSE |
| 29 | 226 | CGPG3918 | 19767 | SENSE |
| 30 | 227 | CGPG3920 | 19774 | SENSE |
| 31 | 228 | CGPG3962 | 70992 | SENSE |
| 32 | 229 | CGPG3972 | 19956 | SENSE |
| 33 | 230 | CGPG3990 | 70948 | SENSE |
| 34 | 231 | CGPG3994 | 70201 | SENSE |
| 35 | 232 | CGPG4026 | 19973 | SENSE |
| 36 | 233 | CGPG4048 | 70987 | SENSE |
| 37 | 234 | CGPG4052 | 70950 | SENSE |
| 38 | 235 | CGPG4057 | 70962 | SENSE |
| 39 | 236 | CGPG4058 | 70915 | SENSE |
| 40 | 237 | CGPG4069 | 19947 | SENSE |
| 41 | 238 | CGPG4087 | 70969 | SENSE |
| 42 | 239 | CGPG4088 | 70985 | SENSE |
| 43 | 240 | CGPG4102 | 70971 | SENSE |
| 44 | 241 | CGPG4121 | 70963 | SENSE |
| 45 | 242 | CGPG4122 | 70994 | SENSE |
| 46 | 243 | CGPG4140 | 70956 | SENSE |
| 47 | 244 | CGPG4154 | 70995 | SENSE |
| 48 | 245 | CGPG4311 | 73306 | SENSE |
| 49 | 246 | CGPG4363 | 70657 | SENSE |
| 50 | 247 | CGPG4369 | 70660 | SENSE |
| 51 | 248 | CGPG442 | 74536 | SENSE |
| 52 | 249 | CGPG4454 | 71328 | SENSE |
| 53 | 250 | CGPG4456 | 71329 | SENSE |
| 54 | 251 | CGPG4473 | 70755 | SENSE |
| 55 | 252 | CGPG4588 | 70684 | SENSE |
| 56 | 253 | CGPG4765 | 73330 | SENSE |
| 57 | 254 | CGPG4788 | 76202 | SENSE |
| 58 | 255 | CGPG4912 | 72807 | SENSE |
| 59 | 256 | CGPG4926 | 72811 | SENSE |
| 60 | 257 | CGPG4967 | 73235 | SENSE |
| 61 | 258 | CGPG4977 | 72813 | SENSE |
| 62 | 259 | CGPG5001 | 72825 | SENSE |
| 63 | 260 | CGPG5025 | 73628 | SENSE |
| 64 | 261 | CGPG5041 | 76105 | SENSE |
| 65 | 262 | CGPG5116 | 73242 | SENSE |
| 66 | 263 | CGPG5144 | 74217 | SENSE |
| 67 | 264 | CGPG5171 | 73735 | SENSE |
| 68 | 265 | CGPG5194 | 73256 | SENSE |
| 69 | 266 | CGPG5200 | 73260 | SENSE |
| 70 | 267 | CGPG5210 | 75822 | SENSE |
| 71 | 268 | CGPG5221 | 72001 | SENSE |
| 72 | 269 | CGPG5269 | 72056 | SENSE |
| 73 | 270 | CGPG5404 | 77308 | SENSE |
| 74 | 271 | CGPG5432 | 73766 | SENSE |
| 75 | 272 | CGPG5518 | 72774 | SENSE |
| 76 | 273 | CGPG5535 | 72788 | SENSE |
| 77 | 274 | CGPG5540 | 72753 | SENSE |
| 78 | 275 | CGPG5568 | 72709 | SENSE |
| 79 | 276 | CGPG5577 | 73954 | SENSE |
| 80 | 277 | CGPG5587 | 73137 | SENSE |
| 81 | 278 | CGPG5594 | 73161 | SENSE |
| 82 | 279 | CGPG5633 | 73057 | SENSE |
| 83 | 280 | CGPG5640 | 73127 | SENSE |
| 84 | 281 | CGPG5646 | 73033 | SENSE |
| 85 | 282 | CGPG5656 | 73105 | SENSE |
| 86 | 283 | CGPG5659 | 73141 | SENSE |
| 87 | 284 | CGPG5661 | 73165 | SENSE |
| 88 | 285 | CGPG5684 | 73155 | SENSE |
| 89 | 286 | CGPG5694 | 73026 | SENSE |
| 90 | 287 | CGPG5704 | 73120 | SENSE |
| 91 | 288 | CGPG5714 | 73133 | SENSE |
| 92 | 289 | CGPG5721 | 73134 | SENSE |
| 93 | 290 | CGPG5728 | 73123 | SENSE |
| 94 | 291 | CGPG5757 | 73981 | SENSE |
| 95 | 292 | CGPG5764 | 73136 | SENSE |
| 96 | 293 | CGPG5783 | 73172 | SENSE |
| 97 | 294 | CGPG5791 | 73020 | SENSE |
| 98 | 295 | CGPG5799 | 72946 | SENSE |
| 99 | 296 | CGPG5856 | 74746 | SENSE |
| 100 | 297 | CGPG5927 | 77312 | SENSE |
| 101 | 298 | CGPG5941 | 75237 | SENSE |
| 102 | 299 | CGPG5957 | 75240 | SENSE |
| 103 | 300 | CGPG5967 | 74349 | SENSE |
| 104 | 301 | CGPG6040 | 76422 | SENSE |
| 105 | 302 | CGPG607 | 70812 | SENSE |
| 106 | 303 | CGPG6178 | 77322 | SENSE |
| 107 | 304 | CGPG6185 | 74662 | SENSE |
| 108 | 305 | CGPG6306 | 76527 | SENSE |
| 109 | 306 | CGPG6318 | 77020 | SENSE |
| 110 | 307 | CGPG6326 | 77609 | SENSE |
| 111 | 308 | CGPG6370 | 73485 | SENSE |
| 112 | 309 | CGPG6429 | 73433 | SENSE |
| 113 | 310 | CGPG6440 | 73411 | SENSE |
| 114 | 311 | CGPG6516 | 73568 | SENSE |
| 115 | 312 | CGPG6653 | 74688 | SENSE |
| 116 | 313 | CGPG6712 | 74420 | SENSE |
| 117 | 314 | CGPG6737 | 74435 | SENSE |
| 118 | 315 | CGPG6747 | 74460 | SENSE |
| 119 | 316 | CGPG6796 | 74566 | SENSE |
| 120 | 317 | CGPG6805 | 77610 | SENSE |
| 121 | 318 | CGPG6810 | 77618 | SENSE |
| 122 | 319 | CGPG6952 | 77517 | SENSE |
| 123 | 320 | CGPG6953 | 77518 | SENSE |
| 124 | 321 | CGPG7121 | 76460 | SENSE |
| 125 | 322 | CGPG7163 | 77069 | SENSE |
| 126 | 323 | CGPG7168 | 76161 | SENSE |

TABLE 1-continued

| NUC Seq ID No. | PEP SEQ ID No | Gene ID | Construct ID | Orientation |
|---|---|---|---|---|
| 127 | 324 | CGPG7206 | 76171 | SENSE |
| 128 | 325 | CGPG7225 | 76178 | SENSE |
| 129 | 326 | CGPG7267 | 76467 | SENSE |
| 130 | 327 | CGPG7272 | 77536 | SENSE |
| 131 | 328 | CGPG7281 | 76576 | SENSE |
| 132 | 329 | CGPG7308 | 74862 | SENSE |
| 133 | 330 | CGPG7316 | 74863 | SENSE |
| 134 | 331 | CGPG7371 | 74858 | SENSE |
| 135 | 332 | CGPG7457 | 74933 | SENSE |
| 136 | 333 | CGPG7520 | 75379 | SENSE |
| 137 | 334 | CGPG7529 | 77816 | SENSE |
| 138 | 335 | CGPG7636 | 75434 | SENSE |
| 139 | 336 | CGPG7737 | 77821 | SENSE |
| 140 | 337 | CGPG7767 | 75685 | SENSE |
| 141 | 338 | CGPG7804 | 75654 | SENSE |
| 142 | 339 | CGPG7823 | 75692 | SENSE |
| 143 | 340 | CGPG7828 | 75657 | SENSE |
| 144 | 341 | CGPG7833 | 75622 | SENSE |
| 145 | 342 | CGPG7933 | 77549 | SENSE |
| 146 | 343 | CGPG7986 | 77917 | SENSE |
| 147 | 344 | CGPG8012 | 77568 | SENSE |
| 148 | 345 | CGPG8015 | 77570 | SENSE |
| 149 | 346 | CGPG8055 | 77338 | SENSE |
| 150 | 347 | CGPG8062 | 77580 | SENSE |
| 151 | 348 | CGPG8082 | 77928 | SENSE |
| 152 | 349 | CGPG8083 | 77349 | SENSE |
| 153 | 350 | CGPG8106 | 77357 | SENSE |
| 154 | 351 | CGPG8107 | 77587 | SENSE |
| 155 | 352 | CGPG8136 | 77933 | SENSE |
| 156 | 353 | CGPG8152 | 77619 | SENSE |
| 157 | 354 | CGPG8166 | 77621 | SENSE |
| 158 | 355 | CGPG8377 | 77629 | SENSE |
| 159 | 356 | CGPG8976 | 77832 | SENSE |
| 160 | 357 | CGPG8987 | 76802 | SENSE |
| 161 | 358 | CGPG9013 | 76829 | SENSE |
| 162 | 359 | CGPG9080 | 76961 | SENSE |
| 163 | 360 | CGPG9081 | 76973 | SENSE |
| 164 | 361 | CGPG9130 | 77150 | SENSE |
| 165 | 362 | CGPG9133 | 77186 | SENSE |
| 166 | 363 | CGPG9134 | 77103 | SENSE |
| 167 | 364 | CGPG9137 | 77139 | SENSE |
| 168 | 365 | CGPG9141 | 77187 | SENSE |
| 169 | 366 | CGPG9145 | 77140 | SENSE |
| 170 | 367 | CGPG9147 | 77164 | SENSE |
| 171 | 368 | CGPG9148 | 77176 | SENSE |
| 172 | 369 | CGPG9155 | 77165 | SENSE |
| 173 | 370 | CGPG9163 | 77166 | SENSE |
| 174 | 371 | CGPG9170 | 77155 | SENSE |
| 175 | 372 | CGPG9180 | 77180 | SENSE |
| 176 | 373 | CGPG9183 | 77121 | SENSE |
| 177 | 374 | CGPG9186 | 77157 | SENSE |
| 178 | 375 | CGPG9205 | 77195 | SENSE |
| 179 | 376 | CGPG9207 | 77124 | SENSE |
| 180 | 377 | CGPG9219 | 77261 | SENSE |
| 181 | 378 | CGPG9220 | 77273 | SENSE |
| 182 | 379 | CGPG9230 | 77203 | SENSE |
| 183 | 380 | CGPG9236 | 77275 | SENSE |
| 184 | 381 | CGPG9238 | 77204 | SENSE |
| 185 | 382 | CGPG9259 | 77266 | SENSE |
| 186 | 383 | CGPG9271 | 77220 | SENSE |
| 187 | 384 | CGPG9275 | 77268 | SENSE |
| 188 | 385 | CGPG9278 | 77209 | SENSE |
| 189 | 386 | CGPG9283 | 77269 | SENSE |
| 190 | 387 | CGPG9309 | 77451 | SENSE |
| 191 | 388 | CGPG9311 | 77452 | SENSE |
| 192 | 389 | CGPG9322 | 77430 | SENSE |
| 193 | 390 | CGPG9335 | 77432 | SENSE |
| 194 | 391 | CGPG9341 | 77433 | SENSE |
| 195 | 392 | CGPG9344 | 77444 | SENSE |
| 196 | 393 | CGPG9345 | 77409 | SENSE |
| 197 | 394 | CGPG976 | 12313 | ANTI-SENSE |
| 10 | 207 | CGPG1828 | 16322 | SENSE |

Recombinant DNA

DNA for use in the present invention to improve traits in plants have a nucleotide sequence of SEQ ID NO:1 through SEQ ID NO:197, as well as the homologs of such DNA molecules. A subset of the DNA for gene suppression aspects of the invention includes fragments of the disclosed full polynucleotides consisting of oligonucleotides of 21 or more consecutive nucleotides. Oligonucleotides the larger molecules having a sequence selected from the group consisting of SEQ ID NO:1 through SEQ ID NO:197 are useful as probes and primers for detection of the polynucleotides used in the invention. Also useful in this invention are variants of the DNA. Such variants may be naturally occurring, including DNA from homologous genes from the same or a different species, or may be non-natural variants, for example DNA synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, a DNA useful in the present invention may have any base sequence that has been changed from the sequences provided herein by substitution in accordance with degeneracy of the genetic code.

Homologs of the genes providing DNA demonstrated as useful in improving traits in model plants disclosed herein will generally have significant identity with the DNA disclosed herein. DNA is substantially identical to a reference DNA if, when the sequences of the polynucleotides are optimally aligned there is about 60% nucleotide equivalence; more preferably 70%; more preferably 80% equivalence; more preferably 85% equivalence; more preferably 90%; more preferably 95%; and/or more preferably 98% or 99% equivalence over a comparison window. A comparison window is preferably at least 50-100 nucleotides, and more preferably is the entire length of the polynucleotide provided herein. Optimal alignment of sequences for aligning a comparison window may be conducted by algorithms; preferably by computerized implementations of these algorithms (for example, the Wisconsin Genetics Software Package Release 7.0-10.0, Genetics Computer Group, 575 Science Dr., Madison, Wis.). The reference polynucleotide may be a full-length molecule or a portion of a longer molecule. Preferentially, the window of comparison for determining polynucleotide identity of protein encoding sequences is the entire coding region.

Proteins useful for imparting improved traits are entire proteins or at least a sufficient portion of the entire protein to impart the relevant biological activity of the protein. Proteins useful for generation of transgenic plants having improved traits include the proteins with an amino acid sequence provided herein as SEQ ID NO: 198 through SEQ ID NO: 394, as well as homologs of such proteins.

Homologs of the proteins useful in the invention are identified by comparison of the amino acid sequence of the protein to amino acid sequences of proteins from the same or different plant sources, e.g., manually or by using known homology-based search algorithms such as those commonly known and referred to as BLAST, FASTA, and Smith-Waterman. As used herein, a homolog is a protein from the same or a different organism that performs the same biological function as the polypeptide to which it is compared. An orthologous relation between two organisms is not necessarily manifest as a one-to-one correspondence between two genes, because a gene can be duplicated or deleted after organism phylogenetic separation, such as speciation. For a given protein, there may be no ortholog or more than one ortholog. Other complicating factors include alternatively spliced transcripts from the same gene, limited gene identification, redundant copies of the same gene with different sequence lengths or corrected sequence. A local sequence alignment program, e.g., BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal BLAST search is used in the present invention to filter hit sequences with significant E-values for ortholog identification. The reciprocal BLAST entails search of the significant hits against a database of amino acid sequences from the base organism that are similar to the sequence of the query protein. A hit is a likely ortholog, when the reciprocal BLAST's best hit is the query protein itself or a protein encoded by a duplicated gene after speciation. Thus, homolog is used herein to describe proteins that are assumed to have functional similarity by inference from sequence base similarity. The relationship of homologs with amino acid sequences of SEQ ID NO: 395 to SEQ ID NO: 19,938 to the proteins with amino acid sequences of SEQ ID NO: to 198 to SEQ ID NO: 394 are found in the listing of Table 2.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention comprises proteins that differ in one or more amino acids from those of a described protein sequence as the result of deletion or insertion of one or more amino acids in a native sequence.

Homologs of the trait-improving proteins provided herein will generally demonstrate significant sequence identity. Of particular interest are proteins having at least 50% sequence identity, more preferably at least about 70% sequence identity or higher, e.g., at least about 80% sequence identity with an amino acid sequence of SEQ ID NO:198 through SEQ ID NO: 394. Of course useful proteins also include those with higher identity, e.g., 90% to 99% identity. Identity of protein homologs is determined by optimally aligning the amino acid sequence of a putative protein homolog with a defined amino acid sequence and by calculating the percentage of identical and conservatively substituted amino acids over the window of comparison. The window of comparison for determining identity can be the entire amino acid sequence disclosed herein, e.g., the full sequence of any of SEQ ID NO: 198 through SEQ ID NO: 394.

Genes that are homologous to each other can be grouped into families and included in multiple sequence alignments. Then a consensus sequence for each group can be derived. This analysis enables the derivation of conserved and class-(family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

Promoters

Numerous promoters that are active in plant cells have been described in the literature. These include promoters present in plant genoMes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus or Figwort mosaic virus promoters. For instance, see U.S. Pat. Nos. 5,858,742 and 5,322,938 which disclose versions of the constitutive promoter derived from cauliflower mosaic virus (CaMV35S), U.S. Pat. No. 5,378,619 which discloses a Figwort Mosaic Virus (FMV) 35S promoter, U.S. Pat. No. 6,437,217 which discloses a maize RS81 promoter, U.S. Pat. No. 5,641,876 which discloses a rice actin promoter, U.S. Pat. No. 6,426,446 which discloses a maize RS324 promoter, U.S. Pat. No. 6,429,362 which discloses a maize PR-1 promoter, U.S. Pat. No. 6,232,526 which discloses a maize A3 promoter, U.S. Pat. No. 6,177,611 which discloses constitutive maize promoters, U.S. Pat. No. 6,433,252 which discloses a maize L3 oleosin promoter, U.S. Pat. No. 6,429,357 which discloses a rice actin 2 promoter and intron, U.S. Pat. No. 5,837,848 which discloses a root specific promoter, U.S. Pat. No. 6,084,089 which discloses cold inducible promoters, U.S. Pat. No. 6,294,714 which discloses light inducible promoters, U.S. Pat. No. 6,140,078 which discloses salt inducible promoters, U.S. Pat. No. 6,252,138 which discloses pathogen inducible promoters, U.S. Pat. No. 6,175,060 which discloses phosphorus deficiency inducible promoters, U.S. Patent Application Publication 2002/0192813A1 which discloses 5', 3' and intron elements useful in the design of effective plant expression vectors, U.S. patent application Ser. No. 09/078,972 which discloses a coixin promoter, U.S. patent application Ser. No. 09/757,089 which discloses a maize chloroplast aldolase promoter, and U.S. patent application Ser. No. 10/739,565 which discloses water-deficit inducible promoters, all of which are incorporated herein by reference. These and numerous other promoters that function in plant cells are known to those skilled in the art and available for use in recombinant polynucleotides of the present invention to provide for expression of desired genes in transgenic plant cells.

Furthermore, the promoters can include multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers that can be used in accordance with the invention include elements from the CaMV 35S promoter, octopine synthase genes, the maize alcohol dehydrogenase gene, the maize shrunken 1 gene and promoters from non-plant eukaryotes.

In some aspects of the invention it is preferred that the promoter element in the DNA construct be capable of causing sufficient expression to result in the production of an effective amount of a polypeptide in water deficit conditions. Such promoters can be identified and isolated from the regulatory region of plant genes that are over expressed in water deficit conditions. Specific water-deficit-inducible promoters for use in this invention are derived from the 5' regulatory region of genes identified as a heat shock protein 17.5 gene (HSP17.5), an HVA22 gene (HVA22), a Rab17 gene and a cinnamic acid 4-hydroxylase (CA4H) gene (CA4H) of *Zea maize*. Such water-deficit-inducible promoters are disclosed in U.S. application Ser. No. 10/739,565, incorporated herein by reference.

In some aspects of the invention, sufficient expression in plant seed tissues is desired to effect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al., (1997) *Transgenic Res.* 6(2):157-166), globulin 1 (Belanger et al., (1991) *Genetics* 129:863-872), glutelin 1 (Russell (1997) supra), and peroxiredoxin antioxidant (Per1 (Stacy et al., (1996) *Plant Mol Biol.* 31(6):1205-1216).

In some aspects of the invention, preferential expression in plant green tissues is desired. Promoters of interest for such uses include those from genes such as SSU (Fischhoff, et al., (1992) *Plant Mol. Biol.* 20:81-93), aldolase and pyruvate orthophosphate dikinase (PPDK) (Taniguchi, et al., (2000) *Plant Cell Physiol.* 41(1):42-48).

Gene suppression includes any of the well-known methods for suppressing transcription of a gene or the accumulation of the mRNA corresponding to that gene thereby preventing translation of the transcript into protein. Posttranscriptional gene suppression is mediated by transcription of RNA that forms double-stranded RNA (dsRNA) having homology to a gene targeted for suppression. Suppression can also be achieved by insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

Gene Stacking

The present invention also contemplates that the trait-improving recombinant DNA provided herein can be used in combination with other recombinant DNA to create plants with multiple desired traits or a further enhanced trait. The combinations generated can include multiple copies of any one or more of the recombinant DNA constructs. These stacked combinations can be created by any method, including but not limited to cross breeding of transgenic plants, or multiple genetic transformation.

In particular embodiments, the inventors contemplate the use of antibodies, either monoclonal or polyclonal which bind to the proteins disclosed herein. Means for preparing and characterizing antibodies are well known in the art (See, e.g., Antibodies: A Laboratory Manual, Cold Spring Harbor Laboratory, 1988; incorporated herein by reference). The methods for generating monoclonal antibodies (mAbs) generally begin along the same lines as those for preparing polyclonal antibodies. Briefly, a polyclonal antibody is prepared by immunizing an animal with an immunogenic composition in accordance with the present invention and collecting antisera from that immunized animal. A wide range of animal species can be used for the production of antisera. Typically the animal used for production of anti-antisera is a rabbit, a mouse, a rat, a hamster, a guinea pig or a goat. Because of the relatively large blood volume of rabbits, a rabbit is a preferred choice for production of polyclonal antibodies.

As is well known in the art, a given composition may vary in its immunogenicity. It is often necessary therefore to boost the host immune system, as may be achieved by coupling a peptide or polypeptide immunogen to a carrier. Exemplary and preferred carriers are keyhole limpet hemocyanin (KLH) and bovine serum albumin (BSA). Other albumins such as ovalbumin, mouse serum albumin or rabbit serum albumin can also be used as carriers. Means for conjugating a polypeptide to a carrier protein are well known in the art and include using glutaraldehyde, m-maleimidobencoyl-N-hydroxysuccinimide ester, carbodiimide and bis-biazotized benzidine.

As is also well known in the art, the immunogenicity of a particular immunogen composition can be enhanced by the use of non-specific stimulators of the immune response, known as adjuvants. Exemplary and preferred adjuvants include complete Freund's adjuvant (a non-specific stimulator of the immune response containing killed *Mycobacterium tuberculosis*), incomplete Freund's adjuvants and aluminum hydroxide adjuvant.

The amount of immunogen composition used in the production of polyclonal antibodies varies upon the nature of the immunogen as well as the animal used for immunization. A variety of routes can be used to administer the immunogen (subcutaneous, intramuscular, intradermal, intravenous and intraperitoneal). The production of polyclonal antibodies may be monitored by sampling blood of the immunized animal at various points following immunization. A second, booster, injection may also be given. The process of boosting and titering is repeated until a suitable titer is achieved. When a desired level of immunogenicity is obtained, the immunized animal can be bled and the serum isolated and stored, and/or the animal can be used to generate mAbs.

mAbs may be readily prepared through use of well-known techniques, such as those exemplified in U.S. Pat. No. 4,196,265, incorporated herein by reference. Typically, this technique involves immunizing a suitable animal with a selected immunogen composition, e.g., a purified or partially purified antifungal protein, polypeptide or peptide. The immunizing composition is administered in a manner effective to stimulate antibody producing cells. Rodents such as mice and rats are preferred animals, however, the use of rabbit, sheep, or frog cells is also possible. The use of rats may provide certain advantages (Goding, 1986, pp. 60-61), but mice are preferred, with the BALB/c mouse being most preferred as this is most routinely used and generally gives a higher percentage of stable fusions.

Following immunization, somatic cells with the potential for producing antibodies, specifically B lymphocytes (B cells), are selected for use in the mAb generating protocol. These cells may be obtained from biopsied spleens, tonsils or lymph nodes, or from a peripheral blood sample. Spleen cells and peripheral blood cells are preferred, the former because they are a rich source of antibody-producing cells that are in the dividing plasmablast stage, and the latter because peripheral blood is easily accessible. Often, a panel of animals will have been immunized and the spleen of animal with the highest antibody titer will be removed and the spleen lymphocytes obtained by homogenizing the spleen with a syringe. Typically, a spleen from an immunized mouse contains approximately $5 \times 10^7$ to $2 \times 10^8$ lymphocytes.

The antibody-producing B lymphocytes from the immunized animal are then fused with cells of an immortal myeloma cell, generally one of the same species as the animal that was immunized. Myeloma cell lines suited for use in hybridoma-producing fusion procedures preferably are non-antibody-producing, have high fusion efficiency, and enzyme deficiencies that render them incapable of growing in certain selective media which support the growth of only the desired fused cells (hybridomas).

Any one of a number of myeloma cells may be used, as are known to those of skill in the art (Goding, 1986, pp. 65-66; Campbell, 1984, pp. 75-83). For example, where the immunized animal is a mouse, one may use P3-X63/Ag8, X63-Ag8.653, NS1/1.Ag 4 1, Sp210-Ag14, FO, NSO/U, MPC-11, MPC11-X45-GTG 1.7 and S194/5XX0 Bul; for rats, one may use R210.RCY3, Y3-Ag 1.2.3, IR983F and 4B210; and U-266, GM1500-GRG2, LICR-LON-HMy2 and UC729-6 are all useful in connection with human cell fusions.

One preferred murine myeloma cell is the NS-1 myeloma cell line (also termed P3-NS-1-Ag4-1), which is readily available from the NIGMS Human Genetic Mutant Cell Repository by requesting cell line repository number GM3573. Another mouse myeloma cell line that may be used is the 8-azaguanine-resistant mouse murine myeloma SP2/0 non-producer cell line.

Methods for generating hybrids of antibody-producing spleen or lymph node cells and myeloma cells usually comprise mixing somatic cells with myeloma cells in a 2:1 ratio, though the ratio may vary from about 20:1 to about 1:1, respectively, in the presence of an agent or agents (chemical or electrical) that promote the fusion of cell membranes. Fusion methods using Spend virus have been described (Kohler and Milstein, 1975; 1976), and those using polyethylene glycol (PEG), such as 37% (v/v) PEG, (Gefter et al., 1977). The use of electrically induced fusion methods is also appropriate (Goding, 1986, pp. 71-74).

Fusion procedures usually produce viable hybrids at low frequencies, about $1 \times 10^{-6}$ to $1 \times 10^{-8}$. However, this does not pose a problem, as the viable, fused hybrids are differentiated from the parental, unfused cells (particularly the unfused myeloma cells that would normally continue to divide indefinitely) by culturing in a selective medium. The selective medium is generally one that contains an agent that blocks the de novo synthesis of nucleotides in the tissue culture media. Exemplary and preferred agents are aminopterin, methotrexate, and azaserine. Aminopterin and methotrexate block de novo synthesis of both purines and pyrimidines, whereas azasenne blocks only purine synthesis. Where aminopterin or methotrexate is used, the media is supplemented with hypoxanthine and thymidine as a source of nucleotides (HAT medium). Where azaserine is used, the media is supplemented with hypoxanthine.

The preferred selection medium is HAT. Only cells capable of operating nucleotide salvage pathways are able to survive in HAT medium. The myeloma cells are defective in key enzymes of the salvage pathway, e.g., hypoxanthine phosphoribosyl transferase (HPRT), and they cannot survive. The B-cells can operate this pathway, but they have a limited life span in culture and generally die within about two weeks. Therefore, the only cells that can survive in the selective media are those hybrids formed from myeloma and B-cells.

This culturing provides a population of hybridomas from which specific hybridomas are selected. Typically, selection of hybridomas is performed by culturing the cells by single-clone dilution in microtiter plates, followed by testing the individual clonal supernatants (after about two to three weeks) for the desired reactivity. The assay should be sensitive, simple and rapid, such as radioimmunoassays, enzyme immunoassays, cytotoxicity assays, plaque assays, dot immunobinding assays, and the like.

The selected hybridomas would then be serially diluted and cloned into individual antibody-producing cell lines, which clones can then be propagated indefinitely to provide mAbs. The cell lines may be exploited for mAb production in two basic ways. A sample of the hybridoma can be injected (often into the peritoneal cavity) into a histocompatible animal of the type that was used to provide the somatic and myeloma cells for the original fusion. The injected animal develops tumors secreting the specific monoclonal antibody produced by the fused cell hybrid. The body fluids of the animal, such as serum or ascites fluid, can then be tapped to provide mAbs in high concentration. The individual cell lines could also be cultured in vitro, where the mAbs are naturally secreted into the culture medium from which they can be readily obtained in high concentrations. mAbs produced by either means may be further purified, if desired, using filtration, centrifugation and various chromatographic methods such as HPLC or affinity chromatography.

Transformation Methods

Numerous methods for producing plant cell nuclei with recombinant DNA are known in the art and may be used in the present invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean), all of which are incorporated herein by reference. For *Agrobacterium tumefaciens* based plant transformation system, additional elements present on transformation constructs will include T-DNA left and right border sequences to facilitate incorporation of the recombinant polynucleotide into the plant genome.

In general it is preferred to introduce heterologous DNA randomly, i.e., at a non-specific location, in the genome of a target plant line. In special cases it may be useful to target heterologous DNA insertion in order to achieve site-specific integration, e.g., to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, e.g., various media and recipient target cells, transformation of immature embryos and subsequent regeneration of fertile transgenic plants are disclosed in U.S. Pat. Nos. 6,194,636 and 6,232,526 and U.S. patent application Ser. No. 09/757,089, which are incorporated herein by reference.

In practice DNA is introduced into only a small percentage of target cell nuclei in any one experiment. Marker genes are used to provide an efficient system for identification of those cells with nuclei that are stably transformed by receiving and integrating a transgenic DNA construct into their genomes. Preferred marker genes provide selective markers that confer resistance to a selective agent, such as an antibiotic or herbicide. Potentially transformed cells with a nucleus of the invention are exposed to the selective agent. In the population of surviving cells will be those cells where, generally, the resistance-conferring gene has been integrated and expressed at sufficient levels to permit cell survival. Cells may be tested further to confirm stable integration of the exogenous DNA in the nucleus. Useful selective marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable are illustrated in U.S. Pat. Nos. 5,550,318; 5,633,435; 5,780,708 and 6,118,047, all of which are incorporated herein by reference. Screenable markers which provide an ability to visually identify transformants can also be employed, e.g., a gene expressing a colored or fluorescent protein such as a luciferase or green fluorescent protein (GFP) or a gene expressing a beta-glucuronidase or uidA gene (GUS) for which various chromogenic substrates are known. It is also contemplated that combinations of screenable and selectable markers will be useful for identification of transformed cells. See PCT publication WO 99/61129 which discloses use of a gene fusion between a selectable marker gene and a screenable marker gene, e.g., an NPTII gene and a GFP gene.

Cells that survive exposure to the selective agent, or cells that have been scored positive in a screening assay, may be cultured in regeneration media and allowed to mature into plants. Developing plantlets can be transferred to soil less plant growth mix, and hardened off, e.g., in an environmentally controlled chamber at about 85% relative humidity, 600 ppm $CO_2$, and 25-250 microeinsteins $m^{-2} s^{-1}$ of light, prior to transfer to a greenhouse or growth chamber for maturation. Plants are preferably matured either in a growth chamber or greenhouse. Plants are regenerated from about 6 wk to 10 months after a transformant is identified, depending on the initial tissue. During regeneration, cells are grown to plants on solid media at about 19 to 28° C. After regenerating plants have reached the stage of shoot and root development, they may be transferred to a greenhouse for further growth and testing. Plants may be pollinated using conventional plant breeding methods known to those of skill in the art and seed produced.

Progeny may be recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Discovery of Trait-Improving Recombinant DNA

To identify nuclei with recombinant DNA that confer improved traits to plants, *Arabidopsis thaliana* was transformed with a candidate recombinant DNA construct and screened for an improved trait.

*Arabidopsis thaliana* is used a model for genetics and metabolism in plants. *Arabidopsis* has a small genome, and well-documented studies are available. It is easy to grow in large numbers and mutants defining important genetically controlled mechanisms are either available, or can readily be obtained. Various methods to introduce and express isolated homologous genes are available (see Koncz, e.g., Methods in *Arabidopsis* Research e.g., (1992), World Scientific, New Jersey, N.J., in "Preface").

A two-step screening process was employed which comprised two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more improved traits, were further evaluated in the second pass screen to confirm the transgene's ability to impart an improved trait. The following Table 3 summarizes the improved traits that have been confirmed as provided by a recombinant DNA construct.

In particular, Table 3 reports:

"PEP SEQ ID" which is the amino acid sequence of the protein cognate to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"% id" refers to the percentage of identically matched amino acid residues along the length of the portion of the sequences which is aligned by BLAST between the sequence of interest provided herein and the hit sequence in GenBank.

"traits" identify by two letter codes the confirmed improvement in a transgenic plant provided by the recombinant DNA. The codes for improved traits are:

"CK" which indicates cold tolerance improvement identified under a cold shock tolerance screen;

"CS" which indicates cold tolerance improvement identified by a cold germination tolerance screen;

"DS" which indicates drought tolerance improvement identified by a soil drought stress tolerance screen;

"PEG" which indicates osmotic stress tolerance improvement identified by a PEG induced osmotic stress tolerance screen;

"HS" which indicates heat stress tolerance improvement identified by a heat stress tolerance screen;

"SS" which indicates high salinity stress tolerance improvement identified by a salt stress tolerance screen;

"LN" which indicates nitrogen use efficiency improvement identified by a limited nitrogen tolerance screen;

"LL" which indicates attenuated shade avoidance response identified by a shade tolerance screen under a low light condition;

"PP" which indicates improved growth and development at early stages identified by an early plant growth and development screen;

"SP" which indicates improved growth and development at late stages identified by a late plant growth and development screen provided herein.

TABLE 3

| PEP SEQ ID | Construct ID | e value | % id | description | trait | | |
|---|---|---|---|---|---|---|---|
| 198 | 11029 | 1.00E−170 | 85 | gb|AAD02882.1|gamma-tocopherol methyltransferase [*Arabidopsis thaliana*] | DS | LN | |
| 199 | 12223 | / | / | / | CK | PEG | |
| 200 | 10422 | 1.00E−133 | 100 | gb|AAB47766.1|SNF5 homolog BSH [*Arabidopsis thaliana*] | LN | | |
| 201 | 13485 | 4.00E−39 | 55 | emb|CAB79347.1|hypothetical protein [*Arabidopsis thaliana*] | LN | | |
| 202 | 13235 | 7.00E−76 | 100 | emb|CAB78153.1|putative protein [*Arabidopsis thaliana*] | LN | | |
| 203 | 13411 | 3.00E−29 | 100 | ref|NP_179638.1|unknown protein [*Arabidopsis thaliana*] | LN | CK | |
| 204 | 73944 | 0 | 95 | ref|NP_189578.1|phosphorylase/transferase, transferring glycosyl groups [*Arabidopsis thaliana*] | CS | | |
| 205 | 13846 | 0 | 91 | gb|AAN60291.1|unknown [*Arabidopsis thaliana*] | LN | | |
| 206 | 12602 | 0 | 100 | ref|NP_565974.1|PP2A-4; hydrolase/protein phosphatase type 2A/protein serine/threonine phosphatase [*Arabidopsis thaliana*] | LN | | |
| 207 | 74065 | 0 | 94 | ref|NP_181390.1|DNA binding/transcription factor [*Arabidopsis thaliana*] gb|AAN13033.1|putative elongation | CS | DS | |
| 208 | 72783 | 0 | 83 | ref|NP_564690.1|unknown protein [*Arabidopsis thaliana*] | CK | PEG | HS |
| 209 | 17210 | 1.00E−92 | 100 | ref|NP_563622.1|unknown protein [*Arabidopsis thaliana*] | CS | CK | PEG |
| 210 | 72724 | 1.00E−128 | 90 | ref|NP_190525.1|protein translocase/protein transporter [*Arabidopsis thaliana*] | LL | | |
| 211 | 17805 | 1.00E−172 | 80 | ref|NP_563761.1|unknown protein [*Arabidopsis thaliana*] | LN | | |
| 212 | 16610 | 0 | 100 | gb|AAL44550.1|fructose bisphosphate aldolase [*Agrobacterium tumefaciens* str. C58] | LN | HS | |
| 213 | 76602 | 0 | 78 | ref|NP_566515.1|signal transducer [*Arabidopsis thaliana*] | CS | HS | |
| 214 | 18456 | 1.00E−135 | 81 | ref|NP_176820.1|DNA binding/transcription factor [*Arabidopsis thaliana*] | CK | SS | PEG |
| 215 | 18414 | 1.00E−169 | 70 | ref|NP_195583.1|translation initiation factor [*Arabidopsis thaliana*] | CK | | |
| 216 | 71538 | 1.00E−137 | 90 | emb|CAE85115.1|synaptotagmin [*Arabidopsis thaliana*] | SP | | |
| 217 | 76532 | 0 | 99 | ref|NP_564775.1|ATP binding/carbohydrate binding/kinase/protein kinase/protein serine/threonine kinase/protein-tyrosine kinase/sugar binding [*Arabidopsis thaliana*] | CK | CS | |
| 218 | 18231 | 1.00E−142 | 100 | emb|CAC83762.1|allene oxide cyclase [*Arabidopsis thaliana*] | CK | LN | |
| 219 | 18232 | 6.00E−85 | 89 | ref|NP_191628.1|unknown protein [*Arabidopsis thaliana*] | CS | | |
| 220 | 18256 | 1.00E−102 | 100 | dbj|BAD44508.1|putative zinc finger protein (PMZ) [*Arabidopsis thaliana*] | SS | CK | HS |

TABLE 3-continued

| PEP SEQ ID | Construct ID | e value | % id | Annotation description | trait | | | | |
|---|---|---|---|---|---|---|---|---|---|
| 221 | 18258 | 1.00E−175 | 83 | emb\|CAA11525.1\|transcription factor IIA large subunit [*Arabidopsis thaliana*] | SP | | | | |
| 222 | 19193 | 1.00E−103 | 100 | ref\|NP_564682.1\|lipid binding [*Arabidopsis thaliana*] dbj\|BAE73268.1\|xylogen like protein 12 [*Arabidopsis thaliana*] | SP | HS | | | |
| 223 | 71301 | 0 | 84 | ref\|NP_568393.1\|nucleic acid binding [*Arabidopsis thaliana*] | LN | | | | |
| 224 | 18354 | 0 | 96 | ref\|NP_567568.1\|ATP binding/ kinase/protein kinase/protein serine/threonine kinase/protein-tyrosine kinase [*Arabidopsis thaliana*] | LN | | | | |
| 225 | 77334 | 1.00E−117 | 100 | ref\|NP_178399.1\|RNS1 (RIBONUCLEASE 1); endoribonuclease [*Arabidopsis thaliana*] | LL | | | | |
| 226 | 19767 | 1.00E−180 | 95 | gb\|AAO69665.1\|serine threonine protein phosphatase [*Phaseolus acutifolius*] | CS | DS | | | |
| 227 | 19774 | 1.00E−100 | 57 | ref\|NP_974271.1\|unknown protein [*Arabidopsis thaliana*] | CS | PP | | | |
| 228 | 70992 | 1.00E−108 | 65 | gb\|ABE87200.1\|hypothetical protein MtrDRAFT_AC151668g4v1 [*Medicago truncatula*] | CS | PEG | | | |
| 229 | 19956 | 1.00E−146 | 100 | gb\|AAF64040.1\|14-3-3-like protein [*Glycine max*] | PP | | | | |
| 230 | 70948 | 3.00E−59 | 45 | ref\|NP_201297.1\|CIP8 (COP1-INTERACTING PROTEIN 8); protein binding/zinc ion binding [*Arabidopsis thaliana*] | PP | HS | | | |
| 231 | 70201 | 0 | 68 | ref\|NP_567072.1\|ATP binding/ kinase/protein kinase/protein serine/threonine kinase/protein-tyrosine kinase [*Arabidopsis thaliana*] | CS | SS | | | |
| 232 | 19973 | 0 | 96 | gb\|AAB04057.1\|S-adenosyl-L-methionine:delta24-sterol-C-methyltransferase | PP | SS | | | |
| 233 | 70987 | 0 | 93 | gb\|AAM83095.1\|SOS2-like protein kinase [*Glycine max*] | CK | CS | HS | SS | PEG |
| 234 | 70950 | 1.00E−116 | 77 | dbj\|BAD38167.1\|putative leucine zipper protein [*Oryza sativa (japonica* cultivar-group)] | PP | PEG | | | |
| 235 | 70962 | 1.00E−179 | 78 | gb\|ABE93200.1\|conserved hypothetical protein [*Medicago truncatula*] | PP | HS | | | |
| 236 | 70915 | 0 | 76 | dbj\|BAE71210.1\|hypothetical protein [*Trifolium pratense*] dbj\|BAE71208.1\| hypothetical protein [*Trifolium pratense*] | CS | PP | | | |
| 237 | 19947 | 1.00E−116 | 65 | gb\|AAS38575.1\|short-chain dehydrogenase Tic32 [*Pisum sativum*] | CS | DS | SS | | |
| 238 | 70969 | 1.00E−144 | 76 | ref\|NP_174321.2\|unknown protein [*Arabidopsis thaliana*] | SS | | | | |
| 239 | 70985 | 0 | 69 | dbj\|BAB08296.1\|unnamed protein product [*Arabidopsis thaliana*] sp\|Q9FMT4\|Y5417_ARATH Protein At5g14170 | CS | HS | PEG | | |
| 240 | 70971 | 1.00E−92 | 63 | gb\|ABE80664.1\|GNS1/SUR4 membrane protein [*Medicago truncatula*] gb\|ABE78502.1\| GNS1/SUR4 membrane protein [*Medicago truncatula*] | SS | | | | |
| 241 | 70963 | 1.00E−96 | 56 | ref\|NP_177178.1\|CYCD1; 1; cyclin-dependent protein kinase regulator [*Arabidopsis thaliana*] | CS | PP | HS | | |
| 242 | 70994 | 2.00E−33 | 44 | ref\|NP_172962.1\|RHA2A; protein binding/ubiquitin-protein ligase/zinc ion binding [*Arabidopsis thaliana*] | PP | DS | HS | SS | |
| 243 | 70956 | 0 | 85 | gb\|AAO23063.1\|ent-kaurenoic acid oxidase [*Pisum sativum*] | CS | SS | HS | | |

TABLE 3-continued

| PEP SEQ ID | Construct ID | e value | % id | description | trait | | | | |
|---|---|---|---|---|---|---|---|---|---|
| 244 | 70995 | 1.00E−132 | 66 | dbj\|BAD73789.1\|putative uncharacterized hypothalamus protein HT010 [*Oryza sativa (japonica cultivar-group)*] | CK | CS | PP | LL | PEG |
| 245 | 73306 | 0 | 93 | ref\|NP_201243.1\|phosphoric ester hydrolase [*Arabidopsis thaliana*] | SS | PEG | | | |
| 246 | 70657 | 9.00E−31 | 73 | emb\|CAB78150.1\|probable wound-induced protein [*Arabidopsis thaliana*] | SP | LL | | | |
| 247 | 70660 | 2.00E−32 | 79 | ref\|NP_568217.1\|transcription regulator [*Arabidopsis thaliana*] | SP | | | | |
| 248 | 74536 | 0 | 91 | ref\|NP_001031061.1\|PGDH; phosphoglycerate dehydrogenase [*Arabidopsis thaliana*]] | CS | | | | |
| 249 | 71328 | 0 | 99 | gb\|AAD46022.1\|Strong simlarity to gb\|286426 F10M6.190 cytochrome p450 homolog from *Arabidopsis thaliana* BAC | PP | | | | |
| 250 | 71329 | 0 | 94 | ref\|NP_177477.1\|heme binding/iron ion binding/monooxygenase/oxygen binding [*Arabidopsis thaliana*] | LN | | | | |
| 251 | 70755 | 1.00E−142 | 100 | ref\|NP_188925.1\|unknown protein [*Arabidopsis thaliana*] | LL | | | | |
| 252 | 70684 | 3.00E−53 | 100 | emb\|CAB80194.1\|putative protein [*Arabidopsis thaliana*] | CS | LN | HS | PP | |
| 253 | 73330 | 1.00E−158 | 72 | emb\|CAB96855.1\|putative protein [*Arabidopsis thaliana*] | CK | CS | SS | | |
| 254 | 76202 | 3.00E−83 | 67 | emb\|CAA16586.1\|putative protein [*Arabidopsis thaliana*] | LL | | | | |
| 255 | 72807 | 0 | 100 | ref\|NP_173478.2\|nucleotide binding [*Arabidopsis thaliana*] | PEG | CK | HS | SS | |
| 256 | 72811 | 1.00E−176 | 100 | ref\|NP_565782.1\|nucleotide binding [*Arabidopsis thaliana*] | CK | SS | PEG | | |
| 257 | 73235 | 0 | 89 | ref\|NP_564867.1\|pepsin A [*Arabidopsis thaliana*] | SS | HS | | | |
| 258 | 72813 | 2.00E−79 | 93 | ref\|NP_850506.1\|unknown protein [*Arabidopsis thaliana*] | LL | LN | | | |
| 259 | 72825 | 1.00E−154 | 95 | ref\|NP_563635.1\|oxidoreductase [*Arabidopsis thaliana*] | CK | PEG | HS | | |
| 260 | 73628 | 1.00E−163 | 92 | ref\|NP_849428.1\|oxidoreductase [*Arabidopsis thaliana*] | CS | DS | LL | HS | PEG |
| 261 | 76105 | 0 | 93 | emb\|CAB79123.1\|receptor kinase-like protein [*Arabidopsis thaliana*] | DS | | | | |
| 262 | 73242 | 0 | 100 | ref\|NP_567292.1\|unknown protein [*Arabidopsis thaliana*] | SP | PEG | | | |
| 263 | 74217 | 0 | 100 | emb\|CAB93726.1\|cytochrome P450-like protein [*Arabidopsis thaliana*] | DS | CK | | | |
| 264 | 73735 | 0 | 97 | gb\|AAU94404.1\|At3g48520 [*Arabidopsis thaliana*] | CK | | | | |
| 265 | 73256 | 1.00E−114 | 77 | ref\|NP_566329.1\|unknown protein [*Arabidopsis thaliana*] gb\|AAL06975.1\| | CS | PP | PEG | | |
| 266 | 73260 | 4.00E−37 | 100 | ref\|NP_566488.1\|unknown protein [*Arabidopsis thaliana*] | CS | | | | |
| 267 | 75822 | 1.00E−90 | 88 | emb\|CAB63015.1\|putative protein [*Arabidopsis thaliana*] | LL | | | | |
| 268 | 72001 | 0 | 96 | ref\|NP_200045.1\|CYP96A4; heme binding/iron ion binding/ monooxygenase/oxygen binding [*Arabidopsis thaliana*] | CS | PP | HS | | |
| 269 | 72056 | 0 | 92 | ref\|NP_010186.1\|Essential, non-ATPase regulatory subunit of the 26S proteasome lid required for the assembly and activity of the 26S proteasome; | SP | | | | |
| 270 | 77308 | 0 | 100 | ref\|NP_178642.1\|SCPL38; serine carboxypeptidase [*Arabidopsis thaliana*] | PEG | | | | |
| 271 | 73766 | 1.00E−163 | 100 | emb\|CAB62363.1\|MTN3-like protein [*Arabidopsis thaliana*] | LL | | | | |
| 272 | 72774 | 1.00E−139 | 95 | ref\|NP_011052.1\|Constituent of 66S pre-ribosomal particles, involved in 60S ribosomal subunit biogenesis; | LL | CK | HS | | |
| 273 | 72788 | 0 | 81 | ref\|NP_010007.1\|General repressor of transcription, forms complex with | CK | CS | SS | | |

TABLE 3-continued

| PEP SEQ ID | Construct ID | e value | % id | Annotation description | trait | | | |
|---|---|---|---|---|---|---|---|---|
| | | | | Cyc8p, involved in the establishment of repressive chromatin structure through interactions with histones H3 and H4, appears to enhance expression of some genes | | | | |
| 274 | 72753 | 1.00E−105 | 85 | ref|NP_013125.1|One of four subunits of the endosomal sorting complex required for transport III (ESCRT-III); | CS | PP | HS | PEG |
| 275 | 72709 | 0 | 94 | ref|NP_011827.1|Low affinity methionine permease, similar to Mup1p; | LL | | | |
| 276 | 73954 | 0 | 98 | ref|NP_200954.1|MIM; ATP binding [Arabidopsis thaliana] | HS | | | |
| 277 | 73137 | 1.00E−110 | 94 | gb|AAD32800.1|putative thioredoxin H [Arabidopsis thaliana] | CS | | | |
| 278 | 73161 | 1.00E−36 | 65 | emb|CAB85993.1|putative protein [Arabidopsis thaliana] | CS | PEG | | |
| 279 | 73057 | 1.00E−133 | 95 | ref|NP_012770.1|Tetrameric phosphoglycerate mutase, mediates the conversion of 3-phosphoglycerate to 2-phosphoglycerate during glycolysis and the reverse reaction during gluconeogenesis; | SP | | | |
| 280 | 73127 | 0 | 99 | dbj|BAB05414.1|aspartate aminotransferase [Bacillus halodurans C-125] ref|NP_242561.1|aspartate aminotransferase [Bacillus halodurans C-125] | SS | HS | | |
| 281 | 73033 | 0 | 96 | dbj|BAB07276.1|2,3-bisphosphoglycerate-independent phosphoglycerate mutase [Bacillus halodurans C-125] | CK | | | |
| 282 | 73105 | 0 | 99 | emb|CAB13630.1|glutamine synthetase [Bacillus subtilis subsp. subtilis str. 168] | PP | PEG | | |
| 283 | 73141 | 0 | 95 | ref|NP_414696.1|glutamate-1-semialdehyde aminotransferase [Escherichia coli K12] | CS | | | |
| 284 | 73165 | 0 | 99 | ref|NP_288110.1|pyruvate kinase [Escherichia coli O157:H7 EDL933] | DS | PEG | | |
| 285 | 73155 | 1.00E−173 | 92 | emb|CAC47346.1|PROBABLE FRUCTOSE-BISPHOSPHATE ALDOLASE CLASS I PROTEIN [Sinorhizobium meliloti]] | CS | | | |
| 286 | 73026 | 1.00E−116 | 87 | emb|CAG77169.1|triosephosphate isomerase [Erwinia carotovora subsp. atroseptica SCRI1043] | PEG | | | |
| 287 | 73120 | 8.00E−82 | 100 | ref|NP_441918.1|nucleoside diphosphate kinase [Synechocystis sp. PCC 6803] | CS | SS | HS | |
| 288 | 73133 | 2.00E−63 | 90 | gb|ABA76342.1|Nucleoside diphosphate kinase [Pseudomonas fluorescens PfO-1] | LL | | | |
| 289 | 73134 | 9.00E−98 | 81 | emb|CAE15979.1|ribose 5-phosphate isomerase A (phosphoriboisomerase A) [Photorhabdus luminescens subsp. laumondii TTO1] | SS | CK | | |
| 290 | 73123 | 0 | 95 | ref|NP_180412.2|nucleic acid binding [Arabidopsis thaliana] | CS | PEG | | |
| 291 | 73981 | 0 | 93 | ref|NP_014797.1|hypothetical protein; Slp1p [Saccharomyces cerevisiae] | DS | PEG | | |
| 292 | 73136 | 0 | 91 | ref|NP_012454.1|Nuclear actin-related protein involved in chromatin remodeling | DS | PP | | |
| 293 | 73172 | 0 | 100 | ref|NP_014952.1|Protein involved in ER-to-Golgi transport; Sly41p [Saccharomyces cerevisiae] | CK | PEG | HS | |
| 294 | 73020 | 0 | 93 | ref|NP_014993.1|Proline permease, required for high-affinity transport of proline | LL | | | |
| 295 | 72946 | 0 | 95 | ref|NP_012534.1|Vacuolar transporter, imports large neutral amino acids into the vacuole | PEG | LL | | |

TABLE 3-continued

| PEP SEQ ID | Construct ID | Annotation e value | % id | description | trait | | | | |
|---|---|---|---|---|---|---|---|---|---|
| 296 | 74746 | 0 | 93 | ref|NP_566298.1|ATP binding/ kinase/protein kinase/protein serine/threonine kinase/protein-tyrosine kinase [*Arabidopsis thaliana*] | CK | | | | |
| 297 | 77312 | 0 | 90 | ref|NP_178463.1|CDC48B; ATP binding/ATP-dependent peptidase/ ATPase/nucleoside-triphosphatase/ nucleotide binding/serine-type endopeptidase [*Arabidopsis thaliana*] | PP | SS | HS | | |
| 298 | 75237 | 0 | 100 | ref|NP_173390.1|kinase [*Arabidopsis thaliana*] gb|AAF98405.1|Unknown protein [*Arabidopsis thaliana*] | LN | | | | |
| 299 | 75240 | 0 | 100 | emb|CAB69854.1|putative protein [*Arabidopsis thaliana*] | CK | | | | |
| 300 | 74349 | 1.00E-148 | 79 | ref|NP_565187.1|transcription regulator [*Arabidopsis thaliana*] | LN | | | | |
| 301 | 76422 | 5.00E-44 | 100 | ref|NP_171781.1|unknown protein [*Arabidopsis thaliana*] | LN | | | | |
| 302 | 70812 | 1.00E-152 | 92 | ref|NP_850182.1|PUR ALPHA-1; nucleic acid binding [*Arabidopsis thaliana*] | PP | PEG | | | |
| 303 | 77322 | 1.00E-172 | 100 | gb|AAW38983.1|At5g10750 [*Arabidopsis thaliana*] | LN | LL | | | |
| 304 | 74662 | 4.00E-89 | 100 | ref|NP_001031939.1|ubiquitin conjugating enzyme/ubiquitin-like activating enzyme [*Arabidopsis thaliana*] | PP | HS | | | |
| 305 | 76527 | 0 | 96 | emb|CAB51062.1|cell division cycle protein 23 homolog [*Arabidopsis thaliana*] | CS | | | | |
| 306 | 77020 | 0 | 98 | emb|CAB75781.1|putative transporter protein [*Arabidopsis thaliana*] ref|NP_190154.1|transporter [*Arabidopsis thaliana*] | CS | | | | |
| 307 | 77609 | 0 | 96 | gb|AAU95452.1|At5g04420 [*Arabidopsis thaliana*] | LL | SS | | | |
| 308 | 73485 | 0 | 100 | emb|CAD84238.1|Glyceraldehyde 3-phosphate dehydrogenase | PEG | | | | |
| 309 | 73433 | 1.00E-132 | 65 | ref|ZP_00819153.1|putative alcohol dehydrogenase [*Marinobacter aquaeolei* VT8] | SP | LN | PP | | |
| 310 | 73411 | 0 | 99 | emb|CAB14878.1|pyruvate kinase [*Bacillus subtilis* subsp. *subtilis* str. 168] | CS | HS | PP | PEG | |
| 311 | 73568 | 0 | 97 | emb|CAC41401.1|PROBABLE SUCCINATE-SEMIALDEHYDE DEHYDROGENASE [NADP+] PROTEIN [*Sinorhizobium meliloti*] | SP | | | | |
| 312 | 74688 | 0 | 98 | emb|CAA16688.1|receptor protein kinase - like protein [*Arabidopsis thaliana*] | CS | PP | SS | PEG | |
| 313 | 74420 | 1.00E-142 | 99 | emb|CAD85691.1|Phosphoglycerate mutase family [*Nitrosomonas europaea* ATCC 19718] | PP | LN | SS | | |
| 314 | 74435 | 1.00E-117 | 100 | emb|CAC41549.1|PROBABLE PHOSPHOGLYCERATE MUTASE 1 PROTEIN [*Sinorhizobium meliloti*] | LL | | | | |
| 315 | 74460 | 0 | 95 | ref|NP_441738.1|fructose-1,6-bisphosphatase [*Synechocystis* sp. PCC 6803] | CK | | | | |
| 316 | 74566 | 0 | 93 | emb|CAC48499.1|putative trehalose synthase protein [*Sinorhizobium meliloti* 1021] | SP | PP | SS | PEG | HS |
| 317 | 77610 | 0 | 94 | gb|AAC23406.1|hypothetical protein [*Arabidopsis thaliana*] | CS | HS | | | |
| 318 | 77618 | 0 | 100 | ref|NP_850453.1|JAR1 (JASMONATE RESISTANT 1) [*Arabidopsis thaliana*] | PP | HS | | | |
| 319 | 77517 | 7.00E-77 | 100 | emb|CAB75802.1|putative protein [*Arabidopsis thaliana*] | CS | LL | | | |
| 320 | 77518 | 1.00E-49 | 100 | ref|NP_199600.1|oxidoreductase, acting on NADH or NADPH, quinone or similar compound as acceptor [*Arabidopsis thaliana*] | SS | LL | HS | | |

TABLE 3-continued

| PEP SEQ ID | Construct ID | Annotation | | | trait | | | | |
|---|---|---|---|---|---|---|---|---|---|
| | | e value | % id | description | | | | | |
| 321 | 76460 | / | / | / | CS | PEG | | | |
| 322 | 77069 | 0 | 85 | ref|NP_201196.1|unknown protein [*Arabidopsis thaliana*] | PP | | | | |
| 323 | 76161 | 1.00E−161 | 100 | ref|NP_851282.1|unknown protein [*Arabidopsis thaliana*] | CK | | | | |
| 324 | 76171 | 1.00E−178 | 95 | ref|NP_176204.1|oxidoreductase [*Arabidopsis thaliana*] | LL | | | | |
| 325 | 76178 | 5.00E−60 | 86 | ref|NP_565029.1|unknown protein [*Arabidopsis thaliana*] | CS | PP | HS | LL | PEG |
| 326 | 76467 | 6.00E−86 | 89 | ref|NP_565671.1|unknown protein [*Arabidopsis thaliana*] | LL | | | | |
| 327 | 77536 | 1.00E−119 | 83 | gb|AAS99692.1|At1g10020 [*Arabidopsis thaliana*] | SP | CS | DS | PP | LN |
| 328 | 76576 | 1.00E−145 | 100 | ref|NP_181023.1|FAH1 (FATTY ACID HYDROXYLASE 1); catalytic [*Arabidopsis thaliana*] | DS | | | | |
| 329 | 74862 | 1.00E−145 | 100 | gb|ABA77057.1|Delta 1-pyrroline-5-carboxylate reductase [*Pseudomonas fluorescens* PfO-1] | PP | | | | |
| 330 | 74863 | 1.00E−93 | 100 | ref|NP_012420.1|Nucleosome assembly factor, involved in chromatin assembly after DNA replication] | LL | PEG | CK | SS | |
| 331 | 74858 | 5.00E−50 | 68 | gb|AAK14395.1|response regulator protein [*Dianthus caryophyllus*] | LL | | | | |
| 332 | 74933 | 1.00E−177 | 95 | gb|AAK85899.1|AGR_C_118p [*Agrobacterium tumefaciens* str. C58] | LL | | | | |
| 333 | 75379 | 1.00E−105 | 76 | dbj|BAD73205.1|unknown protein [*Oryza sativa (japonica* cultivar-group)] | LN | | | | |
| 334 | 77816 | 4.00E−41 | 89 | gb|ABA98984.1|expressed protein [*Oryza sativa (japonica* cultivar-group)] | SP | PP | HS | | |
| 335 | 75434 | 3.00E−52 | 79 | ref|XP_472650.1|OSJNBa0027P08.15 [*Oryza sativa (japonica* cultivar-group)] | LN | | | | |
| 336 | 77821 | 0 | 71 | gb|ABE84883.1|conserved hypothetical protein [*Medicago truncatula*] | PP | SS | HS | PEG | |
| 337 | 75685 | 0 | 82 | ref|XP_475937.1|unknown protein [*Oryza sativa (japonica* cultivar-group)] | LL | | | | |
| 338 | 75654 | 0 | 100 | ref|NP_563865.1|unknown protein [*Arabidopsis thaliana*] | SP | CK | HS | | |
| 339 | 75692 | 1.00E−119 | 87 | dbj|BAD30296.1|peptidyl-prolyl cis-trans isomerase-like protein [*Oryza sativa (japonica* cultivar-group)] | CK | LN | | | |
| 340 | 75657 | 6.00E−57 | 67 | dbj|BAD38392.1|DNAJ heat shock N-terminal domain-containing protein-like [*Oryza sativa (japonica* cultivar-group)] | CS | LL | HS | | |
| 341 | 75622 | 1.00E−30 | 78 | dbj|BAD45825.1|unknown protein [*Oryza sativa (japonica* cultivar-group)] | LN | | | | |
| 342 | 77549 | 1.00E−132 | 89 | emb|CAB80891.1|AT4g00820 [*Arabidopsis thaliana*]] | PP | HS | | | |
| 343 | 77917 | 0 | 91 | ref|NP_197917.1|EBF2 (EIN3-BINDING F BOX PROTEIN 2) [*Arabidopsis thaliana*] | PP | PEG | | | |
| 344 | 77568 | 9.00E−99 | 76 | ref|NP_849792.1|nucleic acid binding [*Arabidopsis thaliana*] | PP | | | | |
| 345 | 77570 | 7.00E−54 | 100 | gb|AAS75309.1|multidomain cyclophilin type peptidyl-prolyl cis-trans isomerase [*Arabidopsis thaliana*]] | CK | SS | | | |
| 346 | 77338 | 4.00E−24 | 65 | gb|AAM61454.1|unknown [*Arabidopsis thaliana*] | PEG | | | | |
| 347 | 77580 | 3.00E−45 | 100 | dbj|BAB01457.1|unnamed protein product [*Arabidopsis thaliana*] | PEG | CS | HS | SS | |
| 348 | 77928 | 4.00E−38 | 100 | ref|NP_196244.1|unknown protein [*Arabidopsis thaliana*] | HS | | | | |
| 349 | 77349 | 1.00E−81 | 93 | emb|CAC05463.1|putative lipid transfer protein [*Arabidopsis thaliana*] | LL | SS | | | |
| 350 | 77357 | 1.00E−155 | 95 | ref|NP_175357.1|unknown protein [*Arabidopsis thaliana*] | PEG | | | | |

TABLE 3-continued

| PEP SEQ ID | Construct ID | Annotation e value | Annotation % id | Annotation description | trait | | | | |
|---|---|---|---|---|---|---|---|---|---|
| 351 | 77587 | / | / | / | CS | PP | HS | SS | |
| 352 | 77933 | / | / | / | SS | | | | |
| 353 | 77619 | 3.00E−40 | 98 | dbj\|BAB09403.1\|unnamed protein product [*Arabidopsis thaliana*] | CK | SS | PEG | HS | |
| 354 | 77621 | 4.00E−58 | 74 | ref\|NP_197632.1\|Rac GTPase activator [*Arabidopsis thaliana*] [*Arabidopsis thaliana*] | CK | | | | |
| 355 | 77629 | 5.00E−36 | 100 | ref\|NP_196372.1\|GRP19 [*Arabidopsis thaliana*] | SS | HS | | | |
| 356 | 77832 | 0 | 83 | ref\|NP_917762.1\|P0501G01.24 [*Oryza sativa* (*japonica* cultivar-group)] | CS | SS | PEG | HS | LN |
| 357 | 76802 | 0 | 76 | ref\|NP_181908.1\|actin binding [*Arabidopsis thaliana*] gb\|AAB64026.1\|unknown protein [*Arabidopsis thaliana*] | CK | | | | |
| 358 | 76829 | 0 | 89 | ref\|NP_909912.1\|ferredoxin-NADP+ reductase [*Oryza sativa*] | CK | | | | |
| 359 | 76961 | 0 | 65 | ref\|XP_473189.1\|OSJNBa0073E02.11 [*Oryza sativa* (*japonica* cultivar-group)] | LL | LN | | | |
| 360 | 76973 | 1.00E−151 | 76 | ref\|XP_480055.1\|unknown protein [*Oryza sativa* (*japonica* cultivar-group)] | LL | | | | |
| 361 | 77150 | 0 | 76 | dbj\|BAD61385.1\|putative nucleostemin [*Oryza sativa* (*japonica* cultivar-group)] | SP | HS | PEG | | |
| 362 | 77186 | 0 | 85 | dbj\|BAD27898.1\|putative pentatricopeptide (PPR) repeat-containing protein [*Oryza sativa* (*japonica* cultivar-group)] | PP | | | | |
| 363 | 77103 | 1.00E−174 | 66 | ref\|NP_568580.1\|catalytic [*Arabidopsis thaliana*] | LL | DS | | | |
| 364 | 77139 | 2.00E−93 | 58 | ref\|NP_171690.1\|PFC1 (PALEFACE 1) [*Arabidopsis thaliana*] | CS | SS | | | |
| 365 | 77187 | 1.00E−160 | 83 | ref\|NP_913437.1\|3-methyl-2-oxobutanoate hydroxy-methyl-transferase-like protein [*Oryza sativa* (*japonica* cultivar-group)] | CS | PP | LL | PEG | |
| 366 | 77140 | 0 | 77 | dbj\|BAD36145.1\|membrane protein PTM1-like [*Oryza sativa* (*japonica* cultivar-group)] | CK | PEG | SS | | |
| 367 | 77164 | 0 | 91 | gb\|ABF93778.1\|DNA polymerase delta small subunit, putative, expressed [*Oryza sativa* (*japonica* cultivar-group)] | PP | HS | | | |
| 368 | 77176 | 0 | 76 | ref\|NP_914476.1\|putative phytochrome P450 [*Oryza sativa* (*japonica* cultivar-group)] | LL | | | | |
| 369 | 77165 | 1.00E−139 | 75 | ref\|NP_914949.1\|serine/threonine protein kinase-like protein [*Oryza sativa* (*japonica* cultivar-group)] | CK | LL | LN | | |
| 370 | 77166 | 0 | 85 | dbj\|BAB75233.1\|all3534 [*Nostoc* sp. PCC 7120] | CK | PP | | | |
| 371 | 77155 | 0 | 97 | emb\|CAA35550.1\|hycE [*Escherichia coli*] | PP | | | | |
| 372 | 77180 | 2.00E−62 | 61 | gb\|ABA99663.1\|expressed protein [*Oryza sativa* (*japonica* cultivar-group)] | CS | PP | HS | PEG | |
| 373 | 77121 | 1.00E−166 | 93 | dbj\|BAB05404.1\|transcriptional repressor of the biotin operon [*Bacillus halodurans* C-125] | CK | | | | |
| 374 | 77157 | 0 | 100 | ref\|NP_531453.1\|3,4-dihydroxy-2-butanone-4-phoshate synthase/GTP cyclohydrolase II [*Agrobacterium tumefaciens* str. C58] | CK | LL | | | |
| 375 | 77195 | 0 | 94 | gb\|AAM71555.1\|mannose-6-phosphate isomerase/mannose-1-phosphate guanylyl transferase [*Chlorobium tepidum* TLS] | PP | SS | PEG | LL | |
| 376 | 77124 | 1.00E−180 | 100 | ref\|NP_418404.1\|biotin--protein ligase [*Escherichia coli* K12] | PP | SS | PEG | | |
| 377 | 77261 | 0 | 100 | ref\|NP_416982.1\|hydrogenase 4, subunit [*Escherichia coli* K12] | PEG | | | | |

TABLE 3-continued

| PEP SEQ ID | Construct ID | e value | % id | description | trait | | |
|---|---|---|---|---|---|---|---|
| 378 | 77273 | 0 | 93 | dbj|BAB06534.1|glycine dehydrogenase subunit 1 [*Bacillus halodurans* C-125] | PP | PEG | |
| 379 | 77203 | 1.00E−176 | 60 | dbj|BAD33942.1|putative serine carboxypeptidase precursor [*Oryza sativa* (*japonica* cultivar-group)] | PEG | CK | |
| 380 | 77275 | 4.00E−37 | 55 | gb|ABA91490.1|expressed protein [*Oryza sativa* (*japonica* cultivar-group)] | SS | HS | PEG |
| 381 | 77204 | 2.00E−27 | 44 | ref|XP_469963.1|putative protease inhibitor [*Oryza sativa* (*japonica* cultivar-group)] | CK | CS | |
| 382 | 77266 | 7.00E−25 | 73 | gb|AAT93978.1|unknown protein [*Oryza sativa* (*japonica* cultivar-group)] | CS | PP | PEG |
| 383 | 77220 | 1.00E−169 | 78 | dbj|BAD52854.1|putative non-phototropic hypocotyl 3 [*Oryza sativa* (*japonica* cultivar-group)] | LL | | |
| 384 | 77268 | 4.00E−71 | 85 | gb|ABF95596.1|ETC complex I subunit conserved region family protein, expressed [*Oryza sativa* (*japonica* cultivar-group)] | PP | SS | |
| 385 | 77209 | 9.00E−86 | 85 | ref|XP_479456.1|putative 60S ribosome subunit biogenesis protein [*Oryza sativa* (*japonica* cultivar-group)] | PP | LL | |
| 386 | 77269 | 2.00E−56 | 70 | dbj|BAD32031.1|unknown protein [*Oryza sativa* (*japonica* cultivar-group)] | SS | | |
| 387 | 77451 | 0 | 71 | ref|XP_475231.1|putative microtubule-associated protein [*Oryza sativa* (*japonica* cultivar-group)] | PP | SS | |
| 388 | 77452 | 1.00E−106 | 69 | dbj|BAD69045.1|unknown protein [*Oryza sativa* (*japonica* cultivar-group)] | PP | | |
| 389 | 77430 | 1.00E−160 | 83 | dbj|BAD33328.1|putative protein serine/threonine kinase [*Oryza sativa* (*japonica* cultivar-group)] | CS | PP | SS |
| 390 | 77432 | 0 | 86 | ref|NP_849565.1|carbohydrate transporter/nucleoside transporter/sugar porter [*Arabidopsis thaliana*] gb|AAM19835.1| AT4g35300/F23E12_140 [*Arabidopsis thaliana*] | PP | HS | PEG |
| 391 | 77433 | 0 | 100 | gb|AAK59487.1|putative cleavage and polyadenylation specificity factor [*Arabidopsis thaliana*] | CK | PP | |
| 392 | 77444 | 0 | 96 | ref|NP_199947.1|unknown protein [*Arabidopsis thaliana*] | CS | PP | |
| 393 | 77409 | 0 | 91 | ref|NP_001032163.1|unknown protein [*Arabidopsis thaliana*] | PP | | |
| 394 | 12313 | 0 | 94 | ref|NP_189150.1|QUA1 (QUASIMODO1); transferase, transferring glycosyl groups/transferase, transferring hexosyl groups [*Arabidopsis thaliana*] | SP | | |

Trait Improvement Screens

DS—Improvement of Drought Tolerance Identified by a Soil Drought Stress Tolerance Screen:

Drought or water deficit conditions impose mainly osmotic stress on plants. Plants are particularly vulnerable to drought during the flowering stage. The drought condition in the screening process disclosed in Example 1B started from the flowering time and was sustained to the end of harvesting. The present invention provides recombinant DNA that can improve the plant survival rate under such sustained drought condition. Exemplary recombinant DNA for conferring such drought tolerance are identified as such in Table 3. Such recombinant DNA may find particular use in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition can also have increased total seed weight per plant in addition to the increased survival rate within a transgenic population, providing a higher yield potential as compared to control plants.

PEG-Improvement of Drought Tolerance Identified by PEG Induced Osmotic Stress Tolerance Screen:

Various drought levels can be artificially induced by using various concentrations of polyethylene glycol (PEG) to produce different osmotic potentials (Pilon-Smits e.g., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen is a useful surrogate for drought tolerance screen. As demonstrated from the model plant screen, embodiments of transgenic plants with trait-improving recombinant DNA identified in the PEG-induced osmotic stress tolerance screen can survive better drought conditions providing a higher yield potential as compared to control plants.

SS-Improvement of Drought Tolerance Identified by High Salinity Stress Tolerance Screen:

Three different factors are responsible for salt damages: (1) osmotic effects, (2) disturbances in the mineralization process, and (3) toxic effects caused by the salt ions, e.g., inactivation of enzymes. While the first factor of salt stress results in the wilting of the plants that is similar to drought effect, the ionic aspect of salt stress is clearly distinct from drought. The present invention provides genes that help plants maintain biomass, root growth, and/or plant development in high salinity conditions, which are identified as such in Table 3. Since osmotic effect is one of the major components of salt stress, which is common to the drought stress, trait-improving recombinant DNA identified in a high salinity stress tolerance screen can also provide transgenic crops with improved drought tolerance. As demonstrated from the model plant screen, embodiments of transgenic plants with trait-improving recombinant DNA identified in a high salinity stress tolerance screen can survive better drought conditions and/or high salinity conditions providing a higher yield potential as compared to control plants.

HS-Improvement of Drought Tolerance Identified by Heat Stress Tolerance Screen:

Heat and drought stress often occur simultaneously, limiting plant growth. Heat stress can cause the reduction in photosynthesis rate, inhibition of leaf growth and osmotic potential in plants. Thus, genes identified by the present invention as heat stress tolerance conferring genes may also impart improved drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Improvement of Tolerance to Cold Stress:

Low temperature may immediately result in mechanical constraints, changes in activities of macromolecules, and reduced osmotic potential. In the present invention, two screening conditions, i.e., cold shock tolerance screen (CK) and cold germination tolerance screen (CS), were set up to look for transgenic plants that display visual growth advantage at lower temperature. In cold germination tolerance screen, the transgenic *Arabidopsis* plants were exposed to a constant temperature of 8° C. from planting until day 28 post plating. The trait-improving recombinant DNA identified by such screen are particular useful for the production of transgenic plant that can germinate more robustly in a cold temperature as compared to the wild type plants. In cold shock tolerance screen, the transgenic plants were first grown under the normal growth temperature of 22° C. until day 8 post plating, and subsequently were placed under 8° C. until day 28 post plating. As demonstrated from the model plant screen, embodiments of transgenic plants with trait-improving recombinant DNA identified in a cold shock stress tolerance screen and/or a cold germination stress tolerance screen can survive better cold conditions providing a higher yield potential as compared to control plants.

Improvement of Tolerance to Multiple Stresses:

Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, i.e., multiple stress tolerance genes, the plant can be enabled to react to different kinds of stresses. For examples, PEP SEQ ID NO: 231 can be used to improve both salt stress tolerance and cold stress tolerance in plants. Of particular interest, plants transformed with PEP SEQ ID NO: 233 can resist heat stress, salt stress and cold stress. In addition to these multiple stress tolerance genes, the stress tolerance conferring genes provided by the present invention may be used in combinations to generate transgenic plants that can resist multiple stress conditions.

PP-Improvement of Early Plant Growth and Development:

It has been known in the art that to minimize the impact of disease on crop profitability, it is important to start the season with healthy and vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems, that continuously generate new organs throughout post-embryonic development. "Early growth and development" used herein encompasses the stages of seed imbibition through the early vegetative phase. The present invention provides genes that are useful to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, it can be recognized by those skilled in the art that genes conferring the growth advantage in early stages to plants may also be used to generate transgenic plants that are more resistant to various stress conditions due to improved early plant development. The present invention provides such exemplary recombinant DNA that confer both the stress tolerance and growth advantages to plants, identified as such in Table 3, e.g., PEP SEQ ID NO: 268 which can improve the plant early growth and development, and impart heat and cold tolerance to plants. As demonstrated from the model plant screen, embodiments of transgenic plants with trait-improving recombinant DNA identified in the early plant development screen can grow better under non-stress conditions and/or stress conditions providing a higher yield potential as compared to control plants.

SP-Improvement of Late Plant Growth and Development:

"Late growth and development" used herein encompasses the stages of leaf development, flower production, and seed maturity. In certain embodiments, transgenic plants produced using genes that confer growth advantages to plants provided by the present invention, identified as such in Table 3, exhibit at least one phenotypic characteristics including, but not limited to, increased rosette radius, increased rosette dry weight, seed dry weight, silique dry weight, and silique length. On one hand, the rosette radius and rosette dry weight are used as the indexes of photosynthesis capacity, and thereby plant source strength and yield potential of a plant. On the other hand, the seed dry weight, silique dry weight and silique length are used as the indexes for plant sink strength, which are considered as the direct determinants of yield. As demonstrated from the model plant screen, embodiments of transgenic plants with trait-improving recombinant DNA identified in the late development screen can grow better and/or have improved development during leaf development and seed maturation providing a higher yield potential as compared to control plants.

LL-Improvement of Tolerance to Shade Stress Identified in a Low Light Screen:

The effects of light on plant development are especially prominent at the seedling stage. Under normal light conditions with unobstructed direct light, a plant seeding develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. The present invention provides recombinant DNA that enable plants to have an attenuated shade avoidance response so that the source of plant can be contributed to reproductive growth efficiently, resulting higher yield as compared to the wild type plants. As demonstrated from the model plant screen, embodiments of transgenic plants with trait-improving recombinant DNA identified in a shade stress tolerance screen can have attenuated shade response under shade conditions providing a higher yield potential as compared to control plants. The transgenic plants generated by the present invention may be suitable for a higher density planting, thereby resulting increased yield per unit area.

LN-Improvement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

According to the present invention, transgenic plants generated using the recombinant nucleotides, which confer enhanced nitrogen use efficiency, identified as such in Table 3, exhibit one or more desirable traits including, but not limited to, increased seedling weight, greener leaves, increased number of rosette leaves, increased or decreased root length. One skilled in the art may recognize that the transgenic plants provided by the present invention with enhanced nitrogen use efficiency may also have altered amino acid or protein compositions, increased yield and/or better seed quality. The transgenic plants of the present invention may be productively cultivated under low nitrogen growth conditions, i.e., nitrogen-poor soils and low nitrogen fertilizer inputs, which would cause the growth of wild type plants to cease or to be so diminished as to make the wild type plants practically useless. The transgenic plants also may be advantageously used to achieve earlier maturing, faster growing, and/or higher yielding crops and/or produce more nutritious foods and animal feedstocks when cultivated using nitrogen non-limiting growth conditions.

Stacked Traits:

The present invention also encompasses transgenic plants with stacked engineered traits, e.g., a crop having an improved phenotype resulting from expression of a trait-improving recombinant DNA, in combination with herbicide and/or pest resistance traits. For example, genes of the current invention can be stacked with other traits of agronomic interest, such as a trait providing herbicide resistance, for example a RoundUp Ready® trait, or insect resistance, such as using a gene from *Bacillus thuringensis* to provide resistance against lepidopteran, coliopteran, homopteran, hemiopteran, and other insects. Herbicides for which resistance is useful in a plant include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the art, reference is made to U.S. patent application publications 2003/0106096A1 and 2002/0112260A1 and U.S. Pat. Nos. 5,034,322; 5,776,760, 6,107, 549 and 6,376,754, all of which are incorporated herein by reference. To illustrate that the production of transgenic plants with pest resistance is a capability of those of ordinary skill in the art reference is made to U.S. Pat. Nos. 5,250,515 and 5,880,275 which disclose plants expressing an endotoxin of *Bacillus thuringiensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an improved trait of interest in transgenic *Arabidopsis* plants, several methods are available for using the sequence of that recombinant DNA and knowledge about the protein it encodes to identify homologs of that sequence from the same plant or different plant species or other organisms, e.g., bacteria and yeast. Thus, in one aspect, the invention provides methods for identifying a homologous gene with a DNA sequence homologous to any of SEQ ID NO: 1 through SEQ ID NO: 197, or a homologous protein with an amino acid sequence homologous to any of SEQ ID NO: 198 through SEQ ID NO: 394. In another aspect, the present invention provides the protein sequences of identified homologs for a sequence listed as SEQ ID NO: 395 through SEQ ID NO: 19938. In yet another aspect, the present invention also includes linking or associating one or more desired traits, or gene function with a homolog sequence provided herein.

The trait-improving recombinant DNA and methods of using such trait-improving recombinant DNA for generating transgenic plants with improved traits provided by the present invention are not limited to any particular plant species. Indeed, the plants according to the present invention may be of any plant species, i.e., may be monocotyledonous or dicotyledonous. Preferably, they will be agricultural useful plants, i.e., plants cultivated by man for purposes of food production or technical, particularly industrial applications. Of particular interest in the present invention are corn and soybean plants. The recombinant DNA constructs optimized for soybean transformation and recombinant DNA constructs optimized for corn transformation are provided by the present invention. Other plants of interest in the present invention for production of transgenic plants having improved traits include, without limitation, cotton, canola, wheat, sunflower, sorghum, alfalfa, barley, millet, rice, tobacco, fruit and vegetable crops, and turfgrass.

In certain embodiments, the present invention contemplates to use an orthologous gene in generating the transgenic plants with similarly improved traits as the transgenic *Arabidopsis* counterpart. Improved physiological properties in transgenic plants of the present invention may be confirmed in responses to stress conditions, for example in assays using imposed stress conditions to detect improved responses to drought stress, nitrogen deficiency, cold growing conditions, or alternatively, under naturally present stress conditions, for example under field conditions. Biomass measures may be made on greenhouse or field grown plants and may include such measurements as plant height, stem diameter, root and shoot dry weights, and, for corn plants, ear length and diameter.

Trait data on morphological changes may be collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits may be identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, trait characteristics of harvested grain may be confirmed, including number of kernels per row on the ear, number of rows of kernels on the ear, kernel abortion, kernel weight, kernel size, kernel density and physical grain quality.

To confirm hybrid yield in transgenic corn plants expressing genes of the present invention, it may be desirable to test hybrids over multiple years at multiple locations in a geographical location where maize is conventionally grown, e.g., in Iowa, Ill. or other locations in the midwestern United States, under "normal" field conditions as well as under stress conditions, e.g., under drought or population density stress.

Transgenic plants can be used to provide plant parts according to the invention for regeneration or tissue culture of cells or tissues containing the constructs described herein. Plant parts for these purposes can include leaves, stems, roots, flowers, tissues, epicotyl, meristems, hypocotyls, cotyledons, pollen, ovaries, cells and protoplasts, or any other portion of the plant which can be used to regenerate additional transgenic plants, cells, protoplasts or tissue culture. Seeds of transgenic plants are provided by this invention can be used to propagate more plants containing the trait-improving recombinant DNA constructs of this invention. These descendants are intended to be included in the scope of this invention if they contain a trait-improving recombinant DNA construct of this invention, whether or not these plants are selfed or crossed with different varieties of plants.

The various aspects of the invention are illustrated by means of the following examples which are in no way intended to limit the full breath and scope of claims.

EXAMPLES

Example 1

Identification of Recombinant DNA that Confers Improved Trait(s) to Plants

A. Plant Expression Constructs for *Arabidopsis* Transformation

Each gene of interest was amplified from a genomic or cDNA library using primers specific to sequences upstream and downstream of the coding region. Transformation vectors were prepared to constitutively transcribe DNA in either sense orientation (for enhanced protein expression) or antisense orientation (for endogenous gene suppression) under the control of an enhanced Cauliflower Mosaic Virus 35S promoter (U.S. Pat. No. 5,359,142) directly or indirectly (Moore, e.g., PNAS 95:376-381, 1998; Guyer, e.g., Genetics 149: 633-639, 1998; International patent application NO. PCT/EP98/07577). The transformation vectors also contain a bar gene as a selectable marker for resistance to glufosinate herbicide. The transformation of *Arabidopsis* plants was carried out using the vacuum infiltration method known in the art (Bethtold, e.g., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify *Arabidopsis* plants transformed with recombinant DNA that wilt less rapidly and/or produce higher seed yield when grown in soil under drought conditions T2 seeds were sown in flats filled with Metro/Mix® 200 (The Scotts® Company, USA). Humidity domes were added to each flat and flats were assigned locations and placed in climate-controlled growth chambers. Plants were grown under a temperature regime of 22° C. at day and 20° C. at night, with a photoperiod of 16 hours and average light intensity of 170 µmol/m$^2$/s. After the first true leaves appeared, humidity domes were removed. The plants were sprayed with glufosinate herbicide and put back in the growth chamber for 3 additional days. Flats were watered for 1 hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and non-wilted transgenic and control plants were compared over each of the six days under scoring and an overall log rank test was performed to compare the two survival curves using S-PLUS statistical software (S-PLUS 6, Guide to statistics, Insightful, Seattle, Wash., USA). A list of recombinant DNA constructs which improve drought tolerance in transgenic plants is illustrated in Table 4.

TABLE 4

| PEP SEQ ID NO | Construct ID | Nomination ID | Orientation | Drought score Delta mean | P-value | Seed yield Delta mean | P-value | Time to wilting Risk score mean | P-value |
|---|---|---|---|---|---|---|---|---|---|
| 198 | 11029 | CGPG106 | SENSE | 0.109 | 0.381 | 0.072 | 0.717 | 0.119 | 1.000 |
| 292 | 73136 | CGPG5764 | SENSE | 0.030 | 0.090 | 0.136 | 0.067 | 0.104 | 1.000 |
| 284 | 73165 | CGPG5661 | SENSE | −0.031 | 0.504 | 0.526 | 0.018 | −0.075 | 1.000 |
| 260 | 73628 | CGPG5025 | SENSE | 0.342 | 0.038 | −0.474 | 0.022 | 0.208 | 1.000 |
| 291 | 73981 | CGPG5757 | SENSE | 0.517 | 0.026 | −0.096 | 0.000 | 0.573 | 1.000 |
| 207 | 74065 | CGPG1828 | ANTI-SENSE | −0.078 | 0.164 | 0.646 | 0.027 | 0.048 | 1.000 |
| 263 | 74217 | CGPG5144 | SENSE | −0.026 | 0.414 | 0.418 | 0.032 | 0.071 | 1.000 |
| 261 | 76105 | CGPG5041 | SENSE | 0.288 | 0.029 | −1.780 | 0.027 | 0.173 | 1.000 |
| 328 | 76576 | CGPG7281 | SENSE | 0.241 | 0.032 | −0.555 | 0.442 | 0.212 | 1.000 |
| 327 | 77536 | CGPG7272 | SENSE | 0.089 | 0.194 | 1.059 | 0.001 | 0.042 | 1.000 |
| 226 | 19767 | CGPG3918 | SENSE | 0.117 | 0.038 | 0.164 | 0.296 | / | / |
| 237 | 19947 | CGPG4069 | SENSE | −0.009 | 0.852 | −0.104 | 0.504 | / | / |
| 242 | 70994 | CGPG4122 | SENSE | 0.040 | 0.021 | −0.131 | 0.447 | / | / |
| 363 | 77103 | CGPG9134 | SENSE | 0.145 | 0.023 | −0.499 | 0.096 | / | / |

If p < 0.05 and delta or risk score mean >0, the transgenic plants showed statistically significant trait improvement as compared to the reference (p value, of the delta of a quantitative response or of the risk score of a qualitative response, is the probability that the observed difference between the transgenic plants and the reference occur by chance) If p < 0.2 and delta or risk score mean >0, the transgenic plants showed a trend of trait improvement as compared to the reference.

Transgenic plants comprising recombinant DNA expressing a protein as set forth in SEQ ID NO: 226, 237, 242, or 363 showed improved drought tolerance evidenced by the second criteria as illustrated in Example 1L and 1M.

C. Heat Stress Tolerance Screen

Under high temperatures, *Arabidopsis* seedlings become chlorotic and root growth is inhibited. This example sets forth the heat stress tolerance screen to identify *Arabidopsis* plants transformed with the gene of interest that are more resistant to heat stress based on primarily their seedling weight and root growth under high temperature. T2 seeds were plated on ½×MS salts, 1% phytagel, with 10 μg/ml BASTA (7 per plate with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was ~140 mmol/m²/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, e.g., (2001) The Plant Cell 13, 1499-1510). The growth stage data was analyzed as a qualitative response according to example 1L. A list of recombinant DNA constructs that improve heat tolerance in transgenic plants illustrated in Table 5.

TABLE 5

| PEP SEQ ID | Construct ID | Nomination ID | Orientation | Root length at day 14 Delta mean | P-value | Growth stage at day 14 Risk score mean | P-value | Seedling weight at day 14 Delta mean | P-value |
|---|---|---|---|---|---|---|---|---|---|
| 239 | 70985 | CGPG4088 | SENSE | 0.480 | 0.036 | 1.176 | 0.196 | 1.333 | 0.018 |
| 233 | 70987 | CGPG4048 | SENSE | 0.228 | 0.021 | −0.036 | 0.670 | 1.214 | 0.002 |
| 268 | 72001 | CGPG5221 | SENSE | 0.273 | 0.004 | 0.210 | 0.330 | 1.393 | 0.009 |
| 274 | 72753 | CGPG5540 | SENSE | 0.434 | 0.006 | 0.414 | 0.258 | 1.100 | 0.006 |
| 276 | 73954 | CGPG5577 | SENSE | 0.406 | 0.002 | 0.455 | 0.282 | 1.274 | 0.000 |
| 325 | 76178 | CGPG7225 | SENSE | 0.714 | 0.001 | 1.093 | 0.145 | 1.537 | 0.000 |
| 361 | 77150 | CGPG9130 | SENSE | 0.219 | 0.032 | 0.178 | 0.237 | 1.159 | 0.002 |
| 367 | 77164 | CGPG9147 | SENSE | 0.317 | 0.026 | 0.651 | 0.099 | 1.152 | 0.002 |
| 390 | 77432 | CGPG9335 | SENSE | 0.581 | 0.001 | 0.457 | 0.124 | 1.551 | 0.000 |
| 351 | 77587 | CGPG8107 | SENSE | 0.488 | 0.006 | 0.628 | 0.072 | 1.328 | 0.001 |
| 348 | 77928 | CGPG8082 | SENSE | 0.462 | 0.032 | 0.191 | 0.301 | 1.498 | 0.004 |
| 212 | 16610 | CGPG2499 | SENSE | 0.055 | 0.640 | 0.109 | 0.609 | 0.983 | 0.020 |
| 220 | 18256 | CGPG3363 | SENSE | 0.070 | 0.138 | 0.071 | 0.541 | 1.021 | 0.004 |
| 222 | 19193 | CGPG3375 | SENSE | 0.255 | 0.094 | 0.267 | 0.368 | 1.023 | 0.003 |
| 252 | 70684 | CGPG4588 | SENSE | 0.010 | 0.781 | 0.003 | 0.979 | 1.002 | 0.045 |
| 230 | 70948 | CGPG3990 | SENSE | 0.282 | 0.095 | 0.351 | 0.335 | 1.045 | 0.023 |
| 243 | 70956 | CGPG4140 | SENSE | 0.155 | 0.313 | 0.091 | 0.320 | 1.129 | 0.018 |
| 235 | 70962 | CGPG4057 | SENSE | 0.469 | 0.085 | 0.267 | 0.508 | 1.410 | 0.007 |
| 241 | 70963 | CGPG4121 | SENSE | −0.002 | 0.979 | −0.131 | 0.311 | 0.976 | 0.005 |
| 242 | 70994 | CGPG4122 | SENSE | 0.140 | 0.574 | 1.204 | 0.096 | 1.207 | 0.030 |
| 244 | 70995 | CGPG4154 | SENSE | 0.374 | 0.112 | 1.640 | 0.171 | 1.328 | 0.013 |
| 208 | 72783 | CGPG2206 | SENSE | 0.387 | 0.057 | 0.053 | 0.509 | 1.013 | 0.019 |
| 255 | 72807 | CGPG4912 | SENSE | 0.357 | 0.071 | 0.443 | 0.020 | 1.099 | 0.009 |
| 259 | 72825 | CGPG5001 | SENSE | 0.171 | 0.349 | 0.213 | 0.234 | 1.118 | 0.012 |
| 287 | 73120 | CGPG5704 | SENSE | 0.096 | 0.490 | 0.193 | 0.364 | 1.080 | 0.033 |

TABLE 5-continued

| PEP SEQ ID | Construct ID | Nomination ID | Orientation | Root length at day 14 Delta mean | P-value | Growth stage at day 14 Risk score mean | P-value | Seedling weight at day 14 Delta mean | P-value |
|---|---|---|---|---|---|---|---|---|---|
| 280 | 73127 | CGPG5640 | SENSE | −0.220 | 0.077 | −0.194 | 0.030 | 0.643 | 0.014 |
| 293 | 73172 | CGPG5783 | SENSE | 0.283 | 0.197 | 0.887 | 0.162 | 1.154 | 0.007 |
| 310 | 73411 | CGPG6440 | SENSE | 0.198 | 0.389 | 0.631 | 0.345 | 1.320 | 0.003 |
| 260 | 73628 | CGPG5025 | SENSE | 0.406 | 0.149 | 1.475 | 0.365 | 1.169 | 0.016 |
| 316 | 74566 | CGPG6796 | SENSE | 0.627 | 0.092 | 0.777 | 0.466 | 1.714 | 0.014 |
| 338 | 75654 | CGPG7804 | SENSE | 0.292 | 0.237 | 0.804 | 0.315 | 0.940 | 0.017 |
| 340 | 75657 | CGPG7828 | SENSE | 0.390 | 0.067 | 1.222 | 0.307 | 1.521 | 0.011 |
| 213 | 76602 | CGPG2653 | SENSE | 0.036 | 0.748 | 0.092 | 0.670 | 0.752 | 0.025 |
| 372 | 77180 | CGPG9180 | SENSE | 0.068 | 0.555 | −0.045 | 0.177 | 0.871 | 0.022 |
| 380 | 77275 | CGPG9236 | SENSE | 0.282 | 0.125 | 0.971 | 0.285 | 1.027 | 0.013 |
| 297 | 77312 | CGPG5927 | SENSE | 0.201 | 0.344 | 0.710 | 0.372 | 1.039 | 0.032 |
| 320 | 77518 | CGPG6953 | SENSE | 0.238 | 0.344 | 0.069 | 0.655 | 1.188 | 0.015 |
| 342 | 77549 | CGPG7933 | SENSE | 0.184 | 0.180 | −0.012 | / | 0.978 | 0.007 |
| 347 | 77580 | CGPG8062 | SENSE | 0.157 | 0.143 | −0.074 | / | 0.891 | 0.049 |
| 317 | 77610 | CGPG6805 | SENSE | 0.023 | 0.937 | −0.063 | / | 1.207 | 0.029 |
| 318 | 77618 | CGPG6810 | SENSE | 0.002 | 0.942 | −0.074 | / | 1.015 | 0.006 |
| 353 | 77619 | CGPG8152 | SENSE | 0.213 | 0.316 | −0.076 | 0.457 | 0.956 | 0.019 |
| 355 | 77629 | CGPG8377 | SENSE | 0.095 | 0.124 | −0.063 | / | 1.133 | 0.005 |
| 334 | 77816 | CGPG7529 | SENSE | 0.033 | 0.705 | 0.856 | 0.385 | 0.611 | 0.038 |

If $p < 0.05$ and delta or risk score mean >0, the transgenic plants showed statistically significant trait improvement as compared to the reference. If $p < 0.2$ and delta or risk score mean >0, the transgenic plants showed a trend of trait improvement as compared to the reference.

Transgenic plants comprising recombinant DNA expressing a protein as set forth in SEQ ID NO: 237, 307, 313, 327, 330, 349, 366, or 387 showed improved heat stress tolerance evidenced by the second criteria as illustrated in Example 1L and 1M.

D. Salt Stress Tolerance Screen

This example sets forth the high salinity stress screen to identify *Arabidopsis* plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the experiment were grown at a temperature of 22° C. at day and 20° C. at night, a 16-hour photoperiod, an average light intensity of approximately 120 umol/m². On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data was analyzed as a qualitative response according to example 1L. A list of recombinant DNA constructs that improve high salinity tolerance in transgenic plants illustrated in Table 6.

TABLE 6

| PEP SEQ ID | Construct ID | Orientation | Root length at day 11 Delta mean | P-value | Root length at day 14 Delta mean | P-value | Growth stage at day 14 Delta mean | P-value | Seedling weight at day 14 Delta mean | P-value |
|---|---|---|---|---|---|---|---|---|---|---|
| 220 | 18256 | SENSE | 0.192 | 0.232 | 0.236 | 0.080 | 1.291 | 0.151 | 0.598 | 0.039 |
| 214 | 18456 | SENSE | 0.213 | 0.089 | 0.209 | 0.197 | 2.062 | 0.197 | 0.476 | 0.046 |
| 232 | 19973 | SENSE | 0.289 | 0.012 | 0.299 | 0.002 | 0.976 | 0.054 | 1.002 | 0.013 |
| 231 | 70201 | SENSE | 0.363 | 0.030 | 0.403 | 0.052 | 2.083 | 0.229 | 1.057 | 0.014 |
| 243 | 70956 | SENSE | 0.006 | 0.923 | 0.128 | 0.016 | −0.045 | NA | −0.364 | 0.371 |
| 238 | 70969 | SENSE | 0.435 | 0.091 | 0.471 | 0.027 | 0.653 | 0.473 | 0.994 | 0.058 |
| 240 | 70971 | SENSE | 0.337 | 0.063 | 0.257 | 0.041 | 1.418 | 0.226 | 0.593 | 0.030 |
| 233 | 70987 | SENSE | 0.363 | 0.030 | 0.284 | 0.044 | 1.434 | 0.380 | 0.865 | 0.012 |
| 273 | 72788 | SENSE | 0.484 | 0.019 | 0.456 | 0.016 | 1.813 | 0.314 | 0.929 | 0.008 |
| 256 | 72811 | SENSE | 0.385 | 0.024 | 0.409 | 0.002 | 2.968 | 0.031 | 0.805 | 0.004 |
| 287 | 73120 | SENSE | 0.341 | 0.001 | 0.244 | 0.019 | 0.613 | 0.103 | 0.755 | 0.015 |
| 280 | 73127 | SENSE | 0.501 | 0.028 | 0.395 | 0.055 | 0.212 | 0.175 | 0.739 | 0.023 |
| 289 | 73134 | SENSE | 0.226 | 0.134 | 0.266 | 0.045 | 0.152 | 0.487 | 0.378 | 0.056 |
| 257 | 73235 | SENSE | 0.431 | 0.020 | 0.360 | 0.018 | 1.618 | 0.327 | 0.650 | 0.009 |
| 245 | 73306 | SENSE | 0.228 | 0.046 | 0.219 | 0.018 | 0.249 | 0.217 | 0.708 | 0.009 |
| 253 | 73330 | SENSE | 0.196 | 0.225 | 0.186 | 0.029 | 0.000 | NA | 0.543 | 0.045 |
| 316 | 74566 | SENSE | 0.331 | 0.001 | 0.076 | 0.422 | 0.597 | 0.031 | 0.716 | 0.003 |
| 312 | 74688 | SENSE | 0.480 | 0.076 | 0.415 | 0.031 | 0.000 | NA | 0.808 | 0.062 |
| 376 | 77124 | SENSE | 0.340 | 0.034 | 0.322 | 0.015 | 2.306 | 0.137 | 0.411 | 0.168 |

TABLE 6-continued

| PEP SEQ ID | Construct ID | Orientation | Root length at day 11 | | Root length at day 14 | | Growth stage at day 14 | | Seedling weight at day 14 | |
|---|---|---|---|---|---|---|---|---|---|---|
| | | | Delta mean | P-value | Delta mean | P-value | Delta mean | P-value | Delta mean | P-value |
| 364 | 77139 | SENSE | 0.339 | 0.096 | 0.287 | 0.041 | 1.683 | 0.294 | 0.602 | 0.039 |
| 375 | 77195 | SENSE | 0.445 | 0.009 | 0.345 | 0.010 | 0.367 | 0.185 | 0.582 | 0.022 |
| 384 | 77268 | SENSE | 0.495 | 0.047 | 0.468 | 0.102 | 1.906 | 0.079 | 0.992 | 0.042 |
| 386 | 77269 | SENSE | 0.454 | 0.038 | 0.426 | 0.004 | 1.996 | 0.065 | 1.136 | 0.001 |
| 380 | 77275 | SENSE | 0.457 | 0.008 | 0.487 | 0.040 | 2.119 | 0.154 | 1.070 | 0.010 |
| 297 | 77312 | SENSE | 0.335 | 0.086 | 0.361 | 0.013 | 0.960 | 0.208 | 0.723 | 0.063 |
| 389 | 77430 | SENSE | 0.303 | 0.030 | 0.360 | 0.004 | 0.131 | 0.495 | 0.894 | 0.022 |
| 320 | 77518 | SENSE | 0.171 | 0.017 | 0.185 | 0.026 | -0.134 | 0.443 | 0.339 | 0.109 |
| 345 | 77570 | SENSE | 0.326 | 0.091 | 0.241 | 0.134 | 1.396 | 0.090 | 0.862 | 0.026 |
| 351 | 77587 | SENSE | 0.178 | 0.083 | 0.096 | 0.665 | 0.995 | 0.426 | 0.632 | 0.036 |
| 353 | 77619 | SENSE | 0.389 | 0.058 | 0.398 | 0.011 | 1.913 | 0.257 | 0.857 | 0.040 |
| 355 | 77629 | SENSE | 0.404 | 0.043 | 0.389 | 0.019 | 2.523 | 0.083 | 0.826 | 0.040 |
| 336 | 77821 | SENSE | 0.393 | 0.063 | 0.444 | 0.033 | 0.196 | 0.228 | 0.619 | 0.015 |
| 356 | 77832 | SENSE | 0.134 | 0.238 | 0.304 | 0.011 | 0.914 | 0.156 | 0.413 | 0.050 |
| 352 | 77933 | SENSE | 0.112 | 0.044 | 0.165 | 0.009 | 0.749 | 0.482 | 0.517 | 0.171 |
| 347 | 77580 | SENSE | -0.019 | 0.814 | 0.087 | 0.018 | -0.158 | 0.151 | 0.124 | 0.204 |

If p < 0.05 and delta or risk score mean >0, the transgenic plants showed statistically significant trait improvement as compared to the reference. If p < 0.2 and delta or risk score mean >0, the transgenic plants showed a trend of trait improvement as compared to the reference.

Transgenic plants comprising recombinant DNA expressing a protein as set forth in SEQ ID NO: 237, 242, 255, 307, 313, 327, 330, 349, 366, or 387 showed improved salt stress tolerance evidenced by the second criteria as illustrated in Example 1L.

E. Polyethylene Glycol (PEG) Induced Osmotic Stress Tolerance Screen

There are numerous factors, which can influence seed germination and subsequent seedling growth, one being the availability of water. Genes, which can directly affect the success rate of germination and early seedling growth, are potentially useful agronomic traits for improving the germination and growth of crop plants under drought stress. In this assay, PEG was used to induce osmotic stress on germinating transgenic lines of Arabidopsis thaliana seeds in order to screen for osmotically resistant seed lines.

T2 seeds were plated on BASTA selection plates containing 3% PEG and grown under standard light and temperature conditions. Seeds were plated on each plate containing 3% PEG, ½×MS salts, 1% phytagel, and 10 µg/ml glufosinate. Plates were placed at 4° C. for 3 days to stratify seeds. On day 11, plants were measured for primary root length. After 3 more days of growth, i.e., at day 14, plants were scored for transgenic status, primary root length, growth stage, visual color, and the seedlings were pooled for fresh weight measurement. A photograph of the whole plate was taken on day 14.

Seedling weight and root length were analyzed as quantitative responses according to example 1M. The final growth stage at day 14 was scored as success or failure based on whether the plants reached 3 rosette leaves and size of leaves are greater than 1 mm. The growth stage data was analyzed as a qualitative response according to example 1L. A list of recombinant DNA constructs that improve osmotic stress tolerance in transgenic plants illustrated in Table 7.

TABLE 7

| PEP SEQ ID | Construct ID | Orientation | Root length at day 11 | | Root length at day 14 | | Growth stage at day 14 | | Seedling weight at day 14 | |
|---|---|---|---|---|---|---|---|---|---|---|
| | | | Delta mean | P-value | Delta mean | P-value | Delta mean | P-value | Delta mean | P-value |
| 199 | 12223 | SENSE | / | / | / | / | / | / | 0.353 | 0.024 |
| 214 | 18456 | SENSE | 0.320 | 0.018 | 0.274 | 0.033 | 3.109 | 0.073 | 0.553 | 0.006 |
| 302 | 70812 | SENSE | 0.195 | 0.078 | 0.078 | 0.296 | 4 | 0.000 | 0.363 | 0.016 |
| 234 | 70950 | SENSE | 0.322 | 0.056 | 0.427 | 0.016 | 4 | 0.000 | 0.381 | 0.127 |
| 239 | 70985 | SENSE | 0.270 | 0.066 | 0.221 | 0.005 | 4 | 0.000 | 0.372 | 0.007 |
| 233 | 70987 | SENSE | 0.227 | 0.205 | 0.128 | 0.470 | 4 | 0.000 | 0.495 | 0.000 |
| 228 | 70992 | SENSE | 0.369 | 0.002 | 0.370 | 0.013 | 4 | 0.000 | 0.574 | 0.027 |
| 244 | 70995 | SENSE | 0.379 | 0.049 | 0.320 | 0.065 | 4 | 0.000 | 0.491 | 0.003 |
| 208 | 72783 | SENSE | 0.154 | 0.084 | 0.043 | 0.553 | 4 | 0.000 | 0.264 | 0.044 |
| 255 | 72807 | SENSE | 0.165 | 0.080 | 0.158 | 0.150 | 4 | 0.000 | 0.333 | 0.047 |
| 256 | 72811 | SENSE | 0.489 | 0.052 | 0.491 | 0.050 | 4 | 0.000 | 0.784 | 0.016 |
| 259 | 72825 | SENSE | 0.423 | 0.055 | 0.388 | 0.080 | 2.741 | 0.161 | 0.608 | 0.020 |
| 295 | 72946 | SENSE | 0.345 | 0.053 | 0.473 | 0.050 | 0.898 | 0.632 | 0.415 | 0.181 |
| 286 | 73026 | SENSE | 0.636 | 0.021 | 0.619 | 0.028 | 2.741 | 0.161 | 0.752 | 0.045 |
| 290 | 73123 | SENSE | 0.460 | 0.048 | 0.445 | 0.007 | NA | NA | 0.609 | 0.069 |
| 278 | 73161 | SENSE | 0.510 | 0.024 | 0.506 | 0.006 | 2.624 | 0.246 | 0.626 | 0.073 |
| 284 | 73165 | SENSE | 0.304 | 0.101 | 0.285 | 0.044 | 2.499 | 0.270 | 0.643 | 0.077 |
| 293 | 73172 | SENSE | 0.197 | 0.056 | 0.137 | 0.204 | 2.374 | 0.293 | 0.660 | 0.081 |
| 262 | 73242 | SENSE | 0.305 | 0.029 | 0.332 | 0.022 | 2.249 | 0.317 | 0.677 | 0.085 |

TABLE 7-continued

| PEP SEQ ID | Construct ID | Orientation | Root length at day 11 Delta mean | Root length at day 11 P-value | Root length at day 14 Delta mean | Root length at day 14 P-value | Growth stage at day 14 Delta mean | Growth stage at day 14 P-value | Seedling weight at day 14 Delta mean | Seedling weight at day 14 P-value |
|---|---|---|---|---|---|---|---|---|---|---|
| 265 | 73256 | SENSE | 0.325 | 0.084 | 0.182 | 0.178 | 2.124 | 0.341 | 0.694 | 0.089 |
| 308 | 73485 | SENSE | 0.133 | 0.070 | 0.039 | 0.583 | 1.999 | 0.365 | 0.711 | 0.093 |
| 291 | 73981 | SENSE | 0.239 | 0.147 | 0.238 | 0.281 | 1.874 | 0.389 | 0.728 | 0.096 |
| 316 | 74566 | SENSE | 0.451 | 0.004 | 0.248 | 0.118 | 1.749 | 0.412 | 0.745 | 0.100 |
| 312 | 74688 | SENSE | 0.190 | 0.191 | 0.102 | 0.520 | 1.624 | 0.436 | 0.762 | 0.104 |
| 330 | 74863 | SENSE | 0.174 | 0.164 | 0.216 | 0.109 | 1.499 | 0.460 | 0.779 | 0.108 |
| 366 | 77140 | SENSE | 0.644 | 0.005 | 0.572 | 0.015 | 1.374 | 0.484 | 0.796 | 0.112 |
| 361 | 77150 | SENSE | 0.313 | 0.047 | 0.359 | 0.044 | 1.249 | 0.508 | 0.813 | 0.116 |
| 365 | 77187 | SENSE | 0.273 | 0.084 | 0.032 | 0.763 | 1.124 | 0.532 | 0.830 | 0.120 |
| 375 | 77195 | SENSE | 0.319 | 0.021 | 0.256 | 0.041 | NA | NA | 0.847 | 0.124 |
| 379 | 77203 | SENSE | 0.113 | 0.485 | 0.019 | 0.829 | 0.999 | 0.555 | 0.864 | 0.127 |
| 377 | 77261 | SENSE | 0.115 | 0.230 | 0.085 | 0.315 | 0.874 | 0.579 | 0.881 | 0.131 |
| 270 | 77308 | SENSE | 0.174 | 0.321 | 0.074 | 0.700 | 0.749 | 0.603 | 0.898 | 0.135 |
| 346 | 77338 | SENSE | 0.227 | 0.158 | 0.196 | 0.272 | 0.624 | 0.627 | 0.915 | 0.139 |
| 350 | 77357 | SENSE | 0.169 | 0.300 | 0.259 | 0.066 | 2.715 | 0.169 | 0.303 | 0.020 |
| 390 | 77432 | SENSE | 0.306 | 0.043 | 0.122 | 0.270 | 2.57 | 0.214 | 0.734 | 0.019 |
| 347 | 77580 | SENSE | 0.300 | 0.107 | 0.240 | 0.009 | 2.288 | 0.119 | 0.500 | 0.179 |
| 353 | 77619 | SENSE | 0.142 | 0.216 | 0.139 | 0.002 | 4 | 0.000 | 0.129 | 0.582 |
| 356 | 77832 | SENSE | 0.236 | 0.006 | 0.266 | 0.001 | 1.333 | 0.435 | 0.286 | 0.037 |
| 343 | 77917 | SENSE | 0.174 | 0.163 | 0.160 | 0.006 | 4 | 0.000 | 0.330 | 0.009 |

If $p < 0.05$ and delta or risk score mean >0, the transgenic plants showed statistically significant trait improvement as compared to the reference. If $p < 0.2$ and delta or risk score mean >0, the transgenic plants showed a trend of trait improvement as compared to the reference.

Transgenic plants comprising recombinant DNA expressing a protein as set forth in SEQ ID NO: 209, 245, 260, 274, 282, 310, 321, 325, 336, 372, 376, 378, 380, or 382 showed improved osmotic stress tolerance evidenced by the second criteria as illustrated in Example 1L and 1M.

F. Cold Shock Tolerance Screen

This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, i.e., day 28. Rosette areas were measured at day 8 and day 28, which were analyzed as quantitative responses according to example 1M. A list of recombinant nucleotides that improve cold shock stress tolerance in plants illustrated in Table 8.

TABLE 8

| PEP SEQ ID | Construct ID | Nomination ID | Orientation | Rosette area at day 8 Delta mean | Rosette area at day 8 P-value | Rosette area at day 28 Risk score mean | Rosette area at day 28 P-value | Rosette area difference Delta mean | Rosette area difference P-value |
|---|---|---|---|---|---|---|---|---|---|
| 199 | 12223 | CGPG1133 | SENSE | 0.112 | 0.617 | 0.334 | 0.014 | 0.273 | 0.143 |
| 218 | 18231 | CGPG3274 | SENSE | −0.131 | 0.269 | 1.144 | 0.002 | 1.179 | 0.003 |
| 215 | 18414 | CGPG3002 | SENSE | 0.997 | 0.034 | 1.665 | 0.001 | 1.895 | 0.001 |
| 214 | 18456 | CGPG2813 | SENSE | 0.099 | 0.757 | 0.799 | 0.001 | 0.684 | 0.001 |
| 233 | 70987 | CGPG4048 | SENSE | 0.864 | 0.136 | 1.213 | 0.010 | 1.146 | 0.002 |
| 244 | 70995 | CGPG4154 | SENSE | 1.088 | 0.008 | 1.262 | 0.023 | 1.407 | 0.025 |
| 208 | 72783 | CGPG2206 | SENSE | 0.814 | 0.023 | 0.957 | 0.018 | 0.899 | 0.052 |
| 273 | 72788 | CGPG5535 | SENSE | 0.262 | 0.058 | 1.090 | 0.016 | 1.212 | 0.021 |
| 256 | 72811 | CGPG4926 | SENSE | 0.880 | 0.058 | 0.669 | 0.002 | 0.715 | 0.018 |
| 259 | 72825 | CGPG5001 | SENSE | 0.032 | 0.887 | 0.338 | 0.071 | 0.357 | 0.027 |
| 281 | 73033 | CGPG5646 | SENSE | 0.322 | 0.394 | 1.311 | 0.012 | 1.480 | 0.017 |
| 293 | 73172 | CGPG5783 | SENSE | 0.395 | 0.209 | 1.065 | 0.030 | 1.099 | 0.074 |
| 253 | 73330 | CGPG4765 | SENSE | 0.347 | 0.515 | 0.835 | 0.065 | 1.043 | 0.007 |
| 264 | 73735 | CGPG5171 | SENSE | 0.624 | 0.076 | 0.655 | 0.001 | 0.718 | 0.005 |
| 315 | 74460 | CGPG6747 | SENSE | 0.452 | 0.005 | 0.542 | 0.043 | 0.455 | 0.154 |
| 296 | 74746 | CGPG5856 | SENSE | 0.304 | 0.346 | 0.978 | 0.001 | 1.061 | 0.007 |
| 299 | 75240 | CGPG5957 | SENSE | 0.479 | 0.153 | 0.652 | 0.143 | 0.875 | 0.039 |
| 338 | 75654 | CGPG7804 | SENSE | 0.531 | 0.140 | 1.712 | 0.010 | 1.979 | 0.015 |
| 339 | 75692 | CGPG7823 | SENSE | 0.526 | 0.063 | 2.027 | 0.001 | 2.246 | 0.001 |

TABLE 8-continued

| PEP SEQ ID | Construct ID | Nomination ID | Orientation | Rosette area at day 8 Delta mean | P-value | Rosette area at day 28 Risk score mean | P-value | Rosette area difference Delta mean | P-value |
|---|---|---|---|---|---|---|---|---|---|
| 323 | 76161 | CGPG7168 | SENSE | 0.768 | 0.000 | 1.810 | 0.004 | 2.146 | 0.003 |
| 217 | 76532 | CGPG3235 | SENSE | 0.921 | 0.008 | 1.216 | 0.001 | 1.324 | 0.002 |
| 357 | 76802 | CGPG8987 | SENSE | 0.468 | 0.097 | 1.578 | 0.000 | 1.872 | 0.000 |
| 358 | 76829 | CGPG9013 | SENSE | −0.434 | 0.329 | 0.709 | 0.010 | 0.314 | 0.118 |
| 373 | 77121 | CGPG9183 | SENSE | 0.081 | 0.385 | 0.757 | 0.023 | 0.698 | 0.014 |
| 366 | 77140 | CGPG9145 | SENSE | −0.221 | 0.165 | 0.896 | 0.007 | 1.043 | 0.005 |
| 374 | 77157 | CGPG9186 | SENSE | 0.190 | 0.566 | 1.110 | 0.016 | 1.176 | 0.015 |
| 369 | 77165 | CGPG9155 | SENSE | 1.573 | 0.043 | 0.683 | 0.038 | 0.699 | 0.022 |
| 370 | 77166 | CGPG9163 | SENSE | 0.777 | 0.011 | 1.432 | 0.016 | 1.570 | 0.025 |
| 381 | 77204 | CGPG9238 | SENSE | 0.545 | 0.139 | 1.313 | 0.003 | 1.436 | 0.006 |
| 391 | 77433 | CGPG9341 | SENSE | 1.054 | 0.103 | 0.895 | 0.027 | 0.659 | 0.084 |
| 345 | 77570 | CGPG8015 | SENSE | 0.538 | 0.215 | 0.866 | 0.025 | 0.898 | 0.023 |
| 353 | 77619 | CGPG8152 | SENSE | −0.589 | 0.322 | 0.503 | 0.068 | 0.558 | 0.049 |
| 354 | 77621 | CGPG8166 | SENSE | 0.053 | 0.863 | 0.716 | 0.044 | 0.792 | 0.040 |
| 203 | 13411 | CGPG1301 | SENSE | 0.183 | 0.427 | 0.577 | 0.033 | 0.573 | 0.031 |
| 209 | 17210 | CGPG2217 | SENSE | −0.244 | 0.685 | 0.162 | 0.038 | 0.156 | 0.104 |
| 220 | 18256 | CGPG3363 | SENSE | 0.272 | 0.400 | 0.639 | 0.008 | 0.719 | 0.020 |
| 289 | 73134 | CGPG5721 | SENSE | 0.014 | 0.947 | 1.053 | 0.000 | 1.062 | 0.025 |
| 263 | 74217 | CGPG5144 | SENSE | 0.168 | 0.390 | 0.261 | 0.043 | 0.206 | 0.075 |
| 379 | 77203 | CGPG9230 | SENSE | 0.606 | 0.051 | 0.620 | 0.032 | 0.778 | 0.039 |

If p < 0.05 and delta or risk score mean > 0, the transgenic plants showed statistically significant trait improvement as compared to the reference (p value, of the delta of a quantitative response or of the risk score of a qualitative response, is the probability that the observed difference between the transgenic plants and the reference occur by chance) If p < 0.2 and delta or risk score mean > 0, the transgenic plants showed a trend of trait improvement as compared to the reference.

Transgenic plants comprising recombinant DNA expressing a protein as set forth in SEQ ID NO: 255, 272, or 330 showed improved cold stress tolerance evidenced by the second criterial as illustrated in Example 1L.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions.

T2 seeds were plated and all seedlings used in the experiment were grown at 8° C. Seeds were first surface disinfested using chlorine gas and then seeded on assay plates containing an aqueous solution of ½× Gamborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/m$^2$/s. At 28 days post plating, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1L. A list of recombinant DNA constructs that improve cold stress tolerance in transgenic plants illustrated in Table 9.

TABLE 9

| PEP SEQ ID | Construct ID | Nomination ID | Orientation | Root length at day 28 Delta mean | P-value | Growth stage at day 28 Delta mean | P-value |
|---|---|---|---|---|---|---|---|
| 209 | 17210 | CGPG2217 | SENSE | 0.164 | 0.089 | 4.000 | 0.000 |
| 219 | 18232 | CGPG3275 | SENSE | −0.081 | 0.613 | 4.000 | 0.000 |
| 226 | 19767 | CGPG3918 | SENSE | 0.212 | 0.007 | 4.000 | 0.000 |
| 227 | 19774 | CGPG3920 | SENSE | 0.140 | 0.011 | 4.000 | 0.000 |
| 237 | 19947 | CGPG4069 | SENSE | / | / | 4.000 | 0.000 |
| 231 | 70201 | CGPG3994 | SENSE | 0.311 | 0.010 | 4.000 | 0.000 |
| 252 | 70684 | CGPG4588 | SENSE | 0.335 | 0.209 | 4.000 | 0.000 |
| 236 | 70915 | CGPG4058 | SENSE | 0.231 | 0.258 | 4.000 | 0.000 |
| 243 | 70956 | CGPG4140 | SENSE | 0.113 | 0.525 | 4.000 | 0.000 |
| 241 | 70963 | CGPG4121 | SENSE | 0.210 | 0.252 | 4.000 | 0.000 |
| 239 | 70985 | CGPG4088 | SENSE | 0.283 | 0.063 | 4.000 | 0.000 |
| 233 | 70987 | CGPG4048 | SENSE | 0.392 | 0.202 | 4.000 | 0.000 |
| 228 | 70992 | CGPG3962 | SENSE | 0.008 | 0.959 | 4.000 | 0.000 |
| 244 | 70995 | CGPG4154 | SENSE | 0.426 | 0.002 | 4.000 | 0.000 |
| 268 | 72001 | CGPG5221 | SENSE | 0.070 | 0.728 | 4.000 | 0.000 |
| 274 | 72753 | CGPG5540 | SENSE | 0.189 | 0.010 | 2.889 | 0.121 |
| 273 | 72788 | CGPG5535 | SENSE | 0.548 | 0.009 | 4.000 | 0.000 |
| 287 | 73120 | CGPG5704 | SENSE | 0.401 | 0.146 | 4.000 | 0.000 |
| 290 | 73123 | CGPG5728 | SENSE | 0.171 | 0.166 | 4.000 | 0.000 |
| 277 | 73137 | CGPG5587 | SENSE | 0.382 | 0.019 | 4.000 | 0.000 |
| 283 | 73141 | CGPG5659 | SENSE | 0.348 | 0.029 | 1.891 | 0.219 |

TABLE 9-continued

| PEP SEQ ID | Construct ID | Nomination ID | Orientation | Root length at day 28 | | Growth stage at day 28 | |
|---|---|---|---|---|---|---|---|
| | | | | Delta mean | P-value | Delta mean | P-value |
| 285 | 73155 | CGPG5684 | SENSE | 0.194 | 0.105 | 4.000 | 0.000 |
| 278 | 73161 | CGPG5594 | SENSE | 0.327 | 0.018 | 2.889 | 0.121 |
| 265 | 73256 | CGPG5194 | SENSE | 0.176 | 0.473 | 4.000 | 0.000 |
| 266 | 73260 | CGPG5200 | SENSE | 0.256 | 0.047 | 4.000 | 0.000 |
| 253 | 73330 | CGPG4765 | SENSE | 0.229 | 0.016 | 4.000 | 0.000 |
| 310 | 73411 | CGPG6440 | SENSE | 0.232 | 0.213 | 4.000 | 0.000 |
| 260 | 73628 | CGPG5025 | SENSE | 0.304 | 0.040 | 1.330 | 0.467 |
| 204 | 73944 | CGPG1458 | SENSE | 0.426 | 0.026 | 4.000 | 0.000 |
| 207 | 74065 | CGPG1828 | ANTI-SENSE | 0.215 | 0.026 | 2.599 | 0.205 |
| 248 | 74536 | CGPG442 | SENSE | −0.054 | 0.431 | 4.000 | 0.000 |
| 312 | 74688 | CGPG6653 | SENSE | 0.645 | 0.006 | 4.000 | 0.000 |
| 340 | 75657 | CGPG7828 | SENSE | 0.394 | 0.017 | 2.680 | 0.180 |
| 325 | 76178 | CGPG7225 | SENSE | 0.334 | 0.107 | 4.000 | 0.000 |
| 321 | 76460 | CGPG7121 | SENSE | 0.136 | 0.381 | 4.000 | 0.000 |
| 305 | 76527 | CGPG6306 | SENSE | 0.238 | 0.001 | 0.335 | 0.421 |
| 217 | 76532 | CGPG3235 | SENSE | 0.250 | 0.331 | 4.000 | 0.000 |
| 213 | 76602 | CGPG2653 | SENSE | 0.283 | 0.387 | 4.000 | 0.000 |
| 306 | 77020 | CGPG6318 | SENSE | 0.507 | 0.038 | 0.000 | 0.000 |
| 364 | 77139 | CGPG9137 | SENSE | 0.445 | 0.005 | 0.000 | 0.000 |
| 372 | 77180 | CGPG9180 | SENSE | 0.370 | 0.046 | 4.000 | 0.000 |
| 365 | 77187 | CGPG9141 | SENSE | 0.456 | 0.036 | 4.000 | 0.000 |
| 381 | 77204 | CGPG9238 | SENSE | 0.314 | 0.002 | 4.000 | 0.000 |
| 382 | 77266 | CGPG9259 | SENSE | 0.017 | 0.948 | 4.000 | 0.000 |
| 389 | 77430 | CGPG9322 | SENSE | 0.095 | 0.233 | 4.000 | 0.000 |
| 392 | 77444 | CGPG9344 | SENSE | 0.171 | 0.292 | 4.000 | 0.000 |
| 319 | 77517 | CGPG6952 | SENSE | 0.132 | 0.001 | 2.507 | 0.235 |
| 327 | 77536 | CGPG7272 | SENSE | −0.084 | 0.675 | 4.000 | 0.000 |
| 351 | 77587 | CGPG8107 | SENSE | 0.415 | 0.112 | 4.000 | 0.000 |
| 317 | 77610 | CGPG6805 | SENSE | 0.267 | 0.180 | 4.000 | 0.000 |
| 356 | 77832 | CGPG8976 | SENSE | 0.153 | 0.579 | 4.000 | 0.000 |

If $p < 0.05$ and delta or risk score mean >0, the transgenic plants showed statistically significant trait improvement as compared to the reference. If $p < 0.2$ and delta or risk score mean >0, the transgenic plants showed a trend of trait improvement as compared to the reference.

Transgenic plants comprising recombinant DNA expressing a protein as set forth in SEQ ID NO: 347 showed improved cold stress tolerance evidenced by the second criteria as illustrated in Example 1L and 1M.

H. Shade Tolerance Screen

Plants undergo a characteristic morphological response in shade that includes the elongation of the petiole, a change in the leaf angle, and a reduction in chlorophyll content. While these changes may confer a competitive advantage to individuals, in a monoculture the shade avoidance response is thought to reduce the overall biomass of the population. Thus, genetic alterations that prevent the shade avoidance response may be associated with higher yields. Genes that favor growth under low light conditions may also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½×MS salts, 1% Phytagel, 10 ug/ml BASTA. Plants were grown on vertical plates at a temperature of 22° C. at day, 20° C. at night and under low light (approximately 30 uE/m²/s, far/red ratio (655/665/725/735) ~0.35 using PLAQ lights with GAM color filter #680). Twenty-three days after seedlings were sown, measurements were recorded including seedling status, number of rosette leaves, status of flower bud, petiole leaf angle, petiole length, and pooled fresh weights. A digital image of the whole plate was taken on the measurement day. Seedling weight and petiole length were analyzed as quantitative responses according to example 1M. The number of rosette leaves, flowering bud formation and leaf angel were analyzed as qualitative responses according to example 1L.

A list of recombinant DNA constructs that improve shade tolerance in plants illustrated in Table 10.

TABLE 10

| PEP SEQ ID | Construct ID | Nomination ID | Orientation | Leaf angle at day 23 | | Seedling weight at day 23 | | Petiole length at day 23 | |
|---|---|---|---|---|---|---|---|---|---|
| | | | | RS mean | P-value | Delta mean | P-value | Delta mean | P-value |
| 251 | 70755 | CGPG4473 | SENSE | NA | NA | −0.751 | 0.017 | −0.307 | 0.059 |
| 244 | 70995 | CGPG4154 | SENSE | NA | NA | 0.251 | 0.070 | 0.008 | 0.944 |
| 275 | 72709 | CGPG5568 | SENSE | NA | NA | −0.903 | 0.070 | −0.608 | 0.019 |
| 210 | 72724 | CGPG2292 | SENSE | NA | NA | −0.707 | 0.098 | −0.638 | 0.020 |

TABLE 10-continued

| PEP SEQ ID | Construct ID | Nomination ID | Orientation | Leaf angle at day 23 RS mean | Leaf angle at day 23 P-value | Seedling weight at day 23 Delta mean | Seedling weight at day 23 P-value | Petiole length at day 23 Delta mean | Petiole length at day 23 P-value |
|---|---|---|---|---|---|---|---|---|---|
| 272 | 72774 | CGPG5518 | SENSE | NA | NA | −0.268 | 0.110 | −0.195 | 0.087 |
| 258 | 72813 | CGPG4977 | SENSE | NA | NA | −0.469 | 0.092 | −0.186 | 0.054 |
| 294 | 73020 | CGPG5791 | SENSE | NA | NA | −1.443 | 0.010 | −1.265 | 0.010 |
| 288 | 73133 | CGPG5714 | SENSE | NA | NA | −0.852 | 0.009 | −0.896 | 0.012 |
| 260 | 73628 | CGPG5025 | SENSE | NA | NA | 0.311 | 0.011 | 0.317 | 0.146 |
| 271 | 73766 | CGPG5432 | SENSE | NA | NA | −0.988 | 0.048 | −0.671 | 0.088 |
| 314 | 74435 | CGPG6737 | SENSE | NA | NA | −0.735 | 0.042 | −0.755 | 0.049 |
| 331 | 74858 | CGPG7371 | SENSE | NA | NA | −0.667 | 0.010 | −0.808 | 0.008 |
| 330 | 74863 | CGPG7316 | SENSE | NA | NA | 0.176 | 0.060 | 0.168 | 0.515 |
| 332 | 74933 | CGPG7457 | SENSE | NA | NA | −0.100 | 0.801 | −0.533 | 0.094 |
| 340 | 75657 | CGPG7828 | SENSE | NA | NA | 0.193 | 0.059 | 0.244 | 0.085 |
| 337 | 75685 | CGPG7767 | SENSE | NA | NA | −0.917 | 0.075 | −0.974 | 0.049 |
| 267 | 75822 | CGPG5210 | SENSE | NA | NA | −0.267 | 0.194 | −0.297 | 0.090 |
| 324 | 76171 | CGPG7206 | SENSE | NA | NA | −0.350 | 0.065 | −0.570 | 0.049 |
| 254 | 76202 | CGPG4788 | SENSE | NA | NA | −1.153 | 0.009 | −1.713 | 0.019 |
| 326 | 76467 | CGPG7267 | SENSE | NA | NA | −0.484 | 0.177 | −0.743 | 0.088 |
| 359 | 76961 | CGPG9080 | SENSE | NA | NA | −0.425 | 0.098 | −0.265 | 0.051 |
| 360 | 76973 | CGPG9081 | SENSE | NA | NA | 0.333 | 0.052 | 0.248 | 0.003 |
| 363 | 77103 | CGPG9134 | SENSE | NA | NA | 0.363 | 0.093 | 0.198 | 0.072 |
| 374 | 77157 | CGPG9186 | SENSE | NA | NA | 0.287 | 0.044 | 0.107 | 0.086 |
| 369 | 77165 | CGPG9155 | SENSE | NA | NA | −0.081 | 0.413 | −0.572 | 0.012 |
| 368 | 77176 | CGPG9148 | SENSE | NA | NA | −0.577 | 0.025 | −0.651 | 0.085 |
| 365 | 77187 | CGPG9141 | SENSE | NA | NA | 0.335 | 0.002 | 0.263 | 0.046 |
| 385 | 77209 | CGPG9278 | SENSE | NA | NA | 0.671 | 0.027 | 0.451 | 0.011 |
| 383 | 77220 | CGPG9271 | SENSE | NA | NA | 0.463 | 0.008 | 0.231 | 0.228 |
| 225 | 77334 | CGPG3638 | SENSE | NA | NA | 0.531 | 0.067 | 0.336 | 0.031 |
| 349 | 77349 | CGPG8083 | SENSE | NA | NA | 0.133 | 0.001 | 0.035 | 0.781 |
| 319 | 77517 | CGPG6952 | SENSE | NA | NA | −0.843 | 0.142 | −1.458 | 0.062 |
| 320 | 77518 | CGPG6953 | SENSE | NA | NA | 0.354 | 0.007 | 0.380 | 0.010 |
| 307 | 77609 | CGPG6326 | SENSE | NA | NA | 0.252 | 0.087 | 0.211 | 0.145 |

For "seeding weight" and "leaf angle", if p < 0.05 and delta or risk score mean >0, the transgenic plants showed statistically significant trait improvement as compared to the reference. If p < 0.2 and delta or risk score mean >0, the transgenic plants showed a trend of trait improvement as compared to the reference with p < 0.2. For "petiole length", if p < 0.05 and delta <0, the transgenic plants showed statistically significant trait improvement as compared to the reference. If p < 0.2 and delta <0, the transgenic plants showed a trend of trait improvement as compared to the reference.

Transgenic plants comprising recombinant DNA expressing a protein as set forth in SEQ ID NO: 246, 295, 303, 325, or 375 showed enhanced shade tolerance by the second criteria as illustrated in Example 1L and 1M.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day 14 after seed planting.

T2 seeds were plated on glufosinate selection plates and grown under standard conditions (~100 uE/m$^2$/s, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at day 14 were analyzed as quantitative responses according to example 1M.

A list recombinant DNA constructs that improve early plant growth and development illustrated in Table 11.

TABLE 11

| PEP SEQ ID | Construct ID | Nomination ID | Orientation | Root length at day 10 Delta mean | Root length at day 10 P-value | Root length at day 14 Delta mean | Root length at day 14 P-value | Seedling weight at day 14 Delta mean | Seedling weight at day 14 P-value |
|---|---|---|---|---|---|---|---|---|---|
| 227 | 19774 | CGPG3920 | SENSE | 0.488 | 0.097 | 0.307 | 0.100 | 0.550 | 0.163 |
| 229 | 19956 | CGPG3972 | SENSE | 0.248 | 0.062 | 0.154 | 0.214 | 0.284 | 0.001 |
| 232 | 19973 | CGPG4026 | SENSE | 0.326 | 0.047 | 0.066 | 0.577 | 0.444 | 0.012 |
| 302 | 70812 | CGPG607 | SENSE | 0.704 | 0.037 | 0.546 | 0.031 | 0.740 | 0.033 |
| 236 | 70915 | CGPG4058 | SENSE | 0.292 | 0.005 | 0.278 | 0.008 | 0.331 | 0.114 |
| 230 | 70948 | CGPG3990 | SENSE | 0.255 | 0.269 | 0.093 | 0.229 | 0.375 | 0.026 |
| 234 | 70950 | CGPG4052 | SENSE | 0.106 | 0.577 | 0.124 | 0.374 | 0.239 | 0.041 |
| 235 | 70962 | CGPG4057 | SENSE | 0.171 | 0.075 | 0.144 | 0.226 | 0.283 | 0.015 |
| 241 | 70963 | CGPG4121 | SENSE | 0.149 | 0.057 | 0.112 | 0.074 | 0.062 | 0.513 |
| 242 | 70994 | CGPG4122 | SENSE | 0.198 | 0.063 | 0.121 | 0.114 | 0.240 | 0.124 |

TABLE 11-continued

| PEP SEQ ID | Construct ID | Nomination ID | Orientation | Root length at day 10 Delta mean | Root length at day 10 P-value | Root length at day 14 Delta mean | Root length at day 14 P-value | Seedling weight at day 14 Delta mean | Seedling weight at day 14 P-value |
|---|---|---|---|---|---|---|---|---|---|
| 244 | 70995 | CGPG4154 | SENSE | 0.132 | 0.052 | 0.101 | 0.006 | 0.198 | 0.045 |
| 249 | 71328 | CGPG4454 | SENSE | 0.209 | 0.136 | 0.251 | 0.122 | 0.445 | 0.093 |
| 268 | 72001 | CGPG5221 | SENSE | 0.183 | 0.060 | 0.142 | 0.042 | 0.195 | 0.149 |
| 274 | 72753 | CGPG5540 | SENSE | 0.113 | 0.045 | 0.053 | 0.348 | 0.081 | 0.730 |
| 282 | 73105 | CGPG5656 | SENSE | 0.046 | 0.577 | 0.138 | 0.057 | 0.298 | 0.142 |
| 292 | 73136 | CGPG5764 | SENSE | 0.212 | 0.077 | 0.133 | 0.027 | 0.330 | 0.037 |
| 265 | 73256 | CGPG5194 | SENSE | 0.123 | 0.503 | 0.371 | 0.135 | 0.623 | 0.069 |
| 313 | 74420 | CGPG6712 | SENSE | 0.249 | 0.085 | 0.093 | 0.358 | 0.363 | 0.042 |
| 316 | 74566 | CGPG6796 | SENSE | 0.169 | 0.003 | 0.147 | 0.114 | 0.173 | 0.171 |
| 304 | 74662 | CGPG6185 | SENSE | −0.205 | 0.337 | 0.009 | 0.878 | −0.009 | 0.958 |
| 312 | 74688 | CGPG6653 | SENSE | 0.221 | 0.083 | 0.059 | 0.358 | 0.295 | 0.163 |
| 329 | 74862 | CGPG7308 | SENSE | 0.201 | 0.122 | 0.044 | 0.515 | 0.383 | 0.006 |
| 325 | 76178 | CGPG7225 | SENSE | 0.217 | 0.018 | 0.093 | 0.364 | 0.240 | 0.234 |
| 322 | 77069 | CGPG7163 | SENSE | / | / | / | / | 0.641 | 0.074 |
| 376 | 77124 | CGPG9207 | SENSE | 0.337 | 0.121 | 0.256 | 0.045 | 0.762 | 0.034 |
| 371 | 77155 | CGPG9170 | SENSE | 0.181 | 0.262 | 0.265 | 0.035 | 0.419 | 0.000 |
| 367 | 77164 | CGPG9147 | SENSE | 0.589 | 0.068 | 0.369 | 0.066 | 0.899 | 0.051 |
| 370 | 77166 | CGPG9163 | SENSE | 0.383 | 0.025 | 0.391 | 0.006 | 0.787 | 0.019 |
| 372 | 77180 | CGPG9180 | SENSE | 0.442 | 0.058 | 0.267 | 0.031 | 0.402 | 0.339 |
| 362 | 77186 | CGPG9133 | SENSE | 0.448 | 0.022 | 0.383 | 0.079 | 0.654 | 0.057 |
| 365 | 77187 | CGPG9141 | SENSE | 0.453 | 0.043 | 0.227 | 0.127 | 0.660 | 0.013 |
| 375 | 77195 | CGPG9205 | SENSE | 0.221 | 0.114 | 0.188 | 0.160 | 0.259 | 0.064 |
| 385 | 77209 | CGPG9278 | SENSE | 0.360 | 0.092 | 0.181 | 0.203 | 0.594 | 0.047 |
| 382 | 77266 | CGPG9259 | SENSE | / | / | / | / | 0.470 | 0.020 |
| 384 | 77268 | CGPG9275 | SENSE | 0.353 | 0.111 | 0.170 | 0.244 | 0.386 | 0.041 |
| 378 | 77273 | CGPG9220 | SENSE | 0.255 | 0.070 | 0.023 | 0.586 | 0.510 | 0.141 |
| 297 | 77312 | CGPG5927 | SENSE | / | / | / | / | 1.006 | 0.065 |
| 393 | 77409 | CGPG9345 | SENSE | 0.410 | 0.027 | 0.396 | 0.011 | 0.461 | 0.040 |
| 389 | 77430 | CGPG9322 | SENSE | 0.209 | 0.183 | 0.211 | 0.247 | 0.399 | 0.092 |
| 390 | 77432 | CGPG9335 | SENSE | 0.342 | 0.113 | 0.285 | 0.122 | 0.425 | 0.055 |
| 391 | 77433 | CGPG9341 | SENSE | 0.204 | 0.120 | 0.222 | 0.041 | 0.382 | 0.085 |
| 392 | 77444 | CGPG9344 | SENSE | 0.185 | 0.068 | 0.227 | 0.003 | 0.276 | 0.002 |
| 387 | 77451 | CGPG9309 | SENSE | 0.266 | 0.097 | 0.208 | 0.042 | 0.014 | 0.981 |
| 388 | 77452 | CGPG9311 | SENSE | 0.286 | 0.021 | 0.182 | 0.123 | 0.284 | 0.201 |
| 327 | 77536 | CGPG7272 | SENSE | 0.121 | 0.389 | 0.147 | 0.026 | 0.384 | 0.027 |
| 342 | 77549 | CGPG7933 | SENSE | 0.349 | 0.006 | 0.207 | 0.032 | 0.383 | 0.022 |
| 344 | 77568 | CGPG8012 | SENSE | 0.312 | 0.020 | 0.157 | 0.015 | 0.359 | 0.071 |
| 351 | 77587 | CGPG8107 | SENSE | 0.151 | 0.128 | 0.223 | 0.014 | 0.370 | 0.030 |
| 318 | 77618 | CGPG6810 | SENSE | 0.179 | 0.018 | 0.104 | 0.276 | 0.154 | 0.388 |
| 334 | 77816 | CGPG7529 | SENSE | 0.145 | 0.400 | 0.171 | 0.142 | 0.312 | 0.181 |
| 336 | 77821 | CGPG7737 | SENSE | 0.114 | 0.406 | 0.126 | 0.208 | 0.311 | 0.079 |
| 343 | 77917 | CGPG7986 | SENSE | 0.136 | 0.083 | 0.162 | 0.011 | −0.242 | 0.458 |

If p < 0.05 and delta or risk score mean >0, the transgenic plants showed statistically significant trait improvement as compared to the reference. If p < 0.2 and delta or risk score mean >0, the transgenic plants showed a trend of trait improvement as compared to the reference.

Transgenic plants comprising recombinant DNA expressing a protein as set forth in SEQ ID NO: 252, 309, or 310 showed improved early plant growth and development evidenced by the second criteria as illustrated in Example 1L and 1M.

J. Late Plant Growth and Development Screen

This example sets forth a soil based phenotypic platform to identify genes that confer advantages in the processes of leaf development, flowering production and seed maturity to plants.

*Arabidopsis* plants were grown on a commercial potting mixture (Metro Mix 360, Scotts Co., Marysville, Ohio) consisting of 30-40% medium grade horticultural vermiculite, 35-55% sphagnum peat moss, 10-20% processed bark ash, 1-15% pine bark and a starter nutrient charge. Soil was supplemented with Osmocote time-release fertilizer at a rate of 30 mg/ft$^3$. T2 seeds were imbibed in 1% agarose solution for 3 days at 4° C. and then sown at a density of ~5 per 2½" pot. Thirty-two pots were ordered in a 4 by 8 grid in standard greenhouse flat. Plants were grown in environmentally controlled rooms under a 16 h day length with an average light intensity of ~200 μmoles/m$^2$/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M.

A list of recombinant DNA constructs that improve late plant growth and development illustrated in Table 12.

TABLE 12

| PEP SEQ ID | Construct ID | Rosette dry weight at day 53 | | Rosette radius at day 25 | | Seed net dry weight at day 62 | | Silique dry weight at day 53 | | Silique length at day 40 | |
|---|---|---|---|---|---|---|---|---|---|---|---|
| | | Delta mean | P-value | Delta mean | P-value | Delta mean | P-value | Delta mean | P-value | Delta mean | P-value |
| 394 | 12313 | −0.075 | 0.489 | | | 0.654 | 0.000 | 0.157 | 0.174 | −0.024 | 0.275 |
| 221 | 18258 | −0.494 | 0.017 | −0.183 | 0.083 | 0.533 | 0.006 | −0.269 | 0.234 | 0.056 | 0.009 |
| 246 | 70657 | 0.373 | 0.040 | 0.187 | 0.037 | 0.355 | 0.081 | −0.187 | 0.222 | −0.003 | 0.972 |
| 247 | 70660 | −0.010 | 0.936 | −0.072 | 0.431 | 0.445 | 0.026 | 0.116 | 0.369 | 0.145 | 0.045 |
| 216 | 71538 | −0.167 | 0.168 | 0.017 | 0.686 | 0.521 | 0.005 | −0.196 | 0.113 | 0.023 | 0.557 |
| 269 | 72056 | 0.563 | 0.008 | NA | NA | −0.251 | 0.159 | −0.289 | 0.314 | −0.046 | 0.314 |
| 279 | 73057 | −0.266 | 0.035 | 0.167 | 0.114 | 0.396 | 0.034 | −0.304 | 0.085 | 0.023 | 0.543 |
| 311 | 73568 | −0.140 | 0.115 | −0.085 | 0.340 | 0.553 | 0.019 | 0.344 | 0.010 | 0.040 | 0.458 |
| 222 | 19193 | −0.296 | 0.110 | 0.081 | 0.385 | 1.076 | 0.011 | NA | NA | 0.073 | 0.001 |
| 262 | 73242 | 0.159 | 0.132 | 0.133 | 0.050 | 1.074 | 0.009 | 0.652 | 0.002 | 0.045 | 0.048 |
| 309 | 73433 | 0.477 | 0.026 | 0.113 | 0.120 | 1.140 | 0.006 | 0.552 | 0.016 | −0.009 | 0.872 |
| 316 | 74566 | −0.387 | 0.023 | 0.104 | 0.047 | 1.213 | 0.003 | −0.169 | 0.130 | 0.012 | 0.598 |
| 338 | 75654 | 0.604 | 0.012 | −0.006 | 0.899 | −1.193 | 0.004 | −0.258 | 0.057 | −0.004 | 0.962 |
| 361 | 77150 | 0.611 | 0.003 | −0.098 | 0.115 | −0.363 | 0.011 | −0.398 | 0.203 | 0.001 | 0.990 |
| 327 | 77536 | 0.043 | 0.692 | 0.089 | 0.040 | 0.725 | 0.015 | 0.419 | 0.016 | 0.075 | 0.105 |
| 334 | 77816 | −0.324 | 0.021 | 0.005 | 0.954 | 1.207 | 0.000 | −0.038 | 0.679 | 0.039 | 0.378 |

If p < 0.05 and delta or risk score mean >0, the transgenic plants showed statistically significant trait improvement as compared to the reference. If p < 0.2 and delta or risk score mean >0, the transgenic plants showed a trend of trait improvement as compared to the reference.

K. Low Nitrogen Tolerance Screen

Under low nitrogen conditions, *Arabidopsis* seedlings become chlorotic and have less biomass. This example sets forth the limited nitrogen tolerance screen to identify *Arabidopsis* plants transformed with the gene of interest that are altered in their ability to accumulate biomass and/or retain chlorophyll under low nitrogen condition.

T2 seeds were plated on glufosinate selection plates containing 0.5×N-Free Hoagland's T 0.1 mM NH$_4$NO$_3$ T 0.1% sucrose T 1% phytagel media and grown under standard light and temperature conditions. At 12 days of growth, plants were scored for seedling status (i.e., viable or non-viable) and root length. After 21 days of growth, plants were scored for BASTA resistance, visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L. The leaf color raw data were collected on each plant as the percentages of five color elements (Green, Dark-Green, LightGreen, RedPurple, YellowChlorotic) using a computer imaging system. A statistical logistic regression model was developed to predict an overall value based on five colors for each plant.

A list of recombinant DNA constructs that improve low nitrogen availability tolerance in plants illustrated in Table 13.

TABLE 13

| PEP SEQ ID | Construct ID | Nomination ID | Orientation | Root length | | Leaf color | | Rosette weight | |
|---|---|---|---|---|---|---|---|---|---|
| | | | | Delta mean | P-value | Risk score mean | P-value | Delta mean | P-value |
| 200 | 10422 | CGPG117 | ANTI-SENSE | −0.435 | 0.008 | 1.311 | 0.021 | 0.050 | 0.396 |
| 206 | 12602 | CGPG170 | SENSE | −0.004 | 0.941 | −0.052 | 0.895 | 0.115 | 0.048 |
| 202 | 13235 | CGPG1288 | SENSE | −0.047 | 0.267 | −0.085 | 0.864 | 0.128 | 0.068 |
| 203 | 13411 | CGPG1301 | SENSE | 0.323 | 0.202 | −3.233 | 0.126 | 0.174 | 0.044 |
| 201 | 13485 | CGPG1226 | ANTI-SENSE | 0.311 | 0.096 | 1.162 | 0.038 | 0.241 | 0.019 |
| 205 | 13846 | CGPG1542 | ANTI-SENSE | −0.267 | 0.190 | 1.506 | 0.004 | 0.176 | 0.281 |
| 212 | 16610 | CGPG2499 | SENSE | −0.037 | 0.677 | 1.325 | 0.004 | −0.004 | 0.918 |
| 211 | 17805 | CGPG2457 | ANTI-SENSE | −0.348 | 0.016 | 3.523 | 0.067 | −0.105 | 0.116 |
| 218 | 18231 | CGPG3274 | SENSE | −0.207 | 0.117 | 0.925 | 0.062 | −0.093 | 0.094 |
| 224 | 18354 | CGPG3534 | SENSE | 0.104 | 0.070 | −0.407 | 0.124 | 0.189 | 0.048 |
| 252 | 70684 | CGPG4588 | SENSE | 0.379 | 0.001 | −3.676 | 0.003 | 0.328 | 0.030 |
| 223 | 71301 | CGPG3528 | SENSE | −0.394 | 0.027 | 1.269 | 0.042 | −0.128 | 0.026 |
| 250 | 71329 | CGPG4456 | SENSE | −0.169 | 0.230 | 0.475 | 0.074 | −0.365 | 0.337 |
| 258 | 72813 | CGPG4977 | SENSE | −0.361 | 0.193 | 0.521 | 0.076 | 0.013 | 0.120 |
| 309 | 73433 | CGPG6429 | SENSE | 0.129 | 0.201 | −0.091 | 0.794 | 0.186 | 0.002 |
| 300 | 74349 | CGPG5967 | SENSE | −0.139 | 0.019 | 0.592 | 0.080 | 0.045 | 0.080 |
| 313 | 74420 | CGPG6712 | SENSE | 0.612 | 0.043 | −3.086 | 0.063 | 0.173 | 0.002 |
| 298 | 75237 | CGPG5941 | SENSE | −0.097 | 0.237 | 0.948 | 0.031 | 0.074 | 0.136 |
| 333 | 75379 | CGPG7520 | SENSE | 0.000 | 0.998 | 0.529 | 0.048 | −0.017 | 0.755 |
| 335 | 75434 | CGPG7636 | SENSE | −0.336 | 0.039 | 1.208 | 0.076 | −0.109 | 0.107 |

TABLE 13-continued

|  |  |  |  | Root length | | Leaf color | | Rosette weight | |
| --- | --- | --- | --- | --- | --- | --- | --- | --- | --- |
| PEP SEQ ID | Construct ID | Nomination ID | Orientation | Delta mean | P-value | Risk score mean | P-value | Delta mean | P-value |
| 341 | 75622 | CGPG7833 | SENSE | −0.503 | 0.001 | 1.776 | 0.007 | 0.096 | 0.497 |
| 339 | 75692 | CGPG7823 | SENSE | −0.055 | 0.165 | −0.377 | 0.328 | 0.132 | 0.083 |
| 301 | 76422 | CGPG6040 | SENSE | 0.197 | 0.178 | −0.263 | 0.734 | 0.162 | 0.094 |
| 359 | 76961 | CGPG9080 | SENSE | −0.361 | 0.136 | 1.472 | 0.013 | −0.190 | 0.066 |
| 369 | 77165 | CGPG9155 | SENSE | 0.366 | 0.041 | −1.982 | 0.143 | 0.253 | 0.099 |
| 303 | 77322 | CGPG6178 | SENSE | / | / | 1.691 | 0.060 | −0.185 | 0.052 |
| 207 | 16322 | CGPG1828 | SENSE | / | / | −0.021 | 0.982 | 0.116 | 0.043 |
| 356 | 77832 | CGPG8976 | SENSE | / | / | 2.472 | 0.011 | −0.028 | 0.445 |

For leaf color and rosette weight, if p < 0.05 and delta or risk score mean >0, the transgenic plants showed statistically significant trait improvement as compared to the reference. If p < 0.2 and delta or risk score mean >0, the transgenic plants showed a trend of trait improvement as compared to the reference with p < 0.2. For root length, if p < 0.05, the transgenic plants showed statistically significant trait improvement as compared to the reference. If p < 0.2, the transgenic plants showed a trend of trait improvement as compared to the reference.

Transgenic plants comprising recombinant DNA expressing a protein as set forth in SEQ ID NO: 198 or 327 showed improved tolerance to low nitrogen condition evidenced by the second criteria as illustrated in Example 1L and 1M.

L. Statistic Analysis for Qualitative Responses

A list of responses that were analyzed as qualitative responses illustrated in Table 14.

TABLE 14

| response | screen | categories (success vs. failure) |
| --- | --- | --- |
| Wilting response Risk Score | Soil drought tolerance screen | non-wilted vs. wilted |
| growth stage at day 14 | heat stress tolerance screen | 50% of plants reach stage1.03 vs. not |
| growth stage at day 14 | salt stress tolerance screen | 50% of plants reach stage1.03 vs. not |
| growth stage at day 14 | PEG induced osmotic stress tolerance screen | 50% of plants reach stage1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| Flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to Table 14. First, the risk (R) was calculated, which is the proportion of plants that were scored as of failure plants within the group. Then the relative risk (RR) was calculated as the ratio of R (transgenic) to R (reference). Risk score (RS) was calculated as $-\log_2{RR}$. Two criteria were used to determine a transgenic with enhanced trait(s). Transgenic plants comprising recombinant DNA disclosed herein showed trait enhancement according to either or both of the two criteria.

For the first criteria, the risk scores from multiple events of the transgene of interest were evaluated for statistical significance by t-test using SAS statistical software (SAS 9, SAS/STAT User's Guide, SAS Institute Inc, Cary, N.C., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference. If p<0.05 and risk score mean >0, the transgenic plants showed statistically significant trait enhancement as compared to the reference. If p<0.2 and risk score mean >0, the transgenic plants showed a trend of trait enhancement as compared to the reference.

For the second criteria, the RS from each event was evaluated for statistical significance by t-test using SAS statistical software (SAS 9, SAS/STAT User's Guide, SAS Institute Inc, Cary, N.C., USA). The RS with a value greater than 0 indicates that the transgenic plants from this events perform better than the reference. The RS with a value less than 0 indicates that the transgenic plants from this event perform worse than the reference. The RS with a value equal to 0 indicates that the performance of the transgenic plants from this event and the reference don't show any difference. If p<0.05 and risk score mean >0, the transgenic plants from this event showed statistically significant trait enhancement as compared to the reference. If p<0.2 and risk score mean >0, the transgenic plants showed a trend of trait enhancement as compared to the reference. If two or more events of the transgene of interest showed improvement in the same response, the transgene was deemed to show trait enhancement.

M. Statistic Analysis for Quantitative Responses

A list of responses that were analyzed as quantitative responses illustrated in Table 15.

TABLE 15

| response | screen |
|---|---|
| seed yield | Soil drought stress tolerance screen |
| seedling weight at day 14 | heat stress tolerance screen |
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day 28 | cold shock tolerance screen |
| difference in rosette area from day 8 to day 28 | cold shock tolerance screen |
| root length at day 28 | cold germination tolerance screen |
| seedling weight at day 23 | Shade tolerance screen |
| petiole length at day 23 | Shade tolerance screen |
| root length at day 14 | Early plant growth and development screen |
| Seedling weight at day14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |
| Seedling weight at day 21 | Limited nitrogen tolerance screen |
| Root length at day 21 | Limited nitrogen tolerance screen |

The measurements (M) of each plant were transformed by $\log_2$ calculation. The Delta was calculated as $\log_2 M(\text{transgenic}) - \log_2 M(\text{reference})$. Two criteria were used to determine trait enhancement. A transgene of interest could show trait enhancement according to either or both of the two criteria. The measurements (M) of each plant were transformed by $\log_2$ calculation. The Delta was calculated as $\log_2 M(\text{transgenic}) - \log_2 M(\text{reference})$. If the measured response was Petiole Length for the Low Light assay, Delta was subsequently multiplied by −1, to account for the fact that a shorter petiole length is considered an indication of trait enhancement.

For the first criteria, the Deltas from multiple events of the transgene of interest were evaluated for statistical significance by t-test using SAS statistical software (SAS 9, SAS/STAT User's Guide, SAS Institute Inc, Cary, N.C., USA). Delta with a value greater than 0 indicates that the transgenic plants perform better than the reference. Delta with a value less than 0 indicates that the transgenic plants perform worse than the reference. The Delta with a value equal to 0 indicates that the performance of the transgenic plants and the reference don't show any difference. If $p<0.05$ and risk score mean $>0$, the transgenic plants showed statistically significant trait enhancement as compared to the reference. If $p<0.2$ and risk score mean $>0$, the transgenic plants showed a trend of trait enhancement as compared to the reference.

For the second criteria, the delta from each event was evaluated for statistical significance by t-test using SAS statistical software (SAS 9, SAS/STAT User's Guide, SAS Institute Inc, Cary, N.C., USA). The Delta with a value greater than 0 indicates that the transgenic plants from this event performs better than the reference. The Delta with a value less than 0 indicates that the transgenic plants from this event perform worse than the reference. The Delta with a value equal to 0 indicates that the performance of the transgenic plants from this event and the reference don't show any difference. If $p<0.05$ and delta mean $>0$, the transgenic plants from this event showed statistically significant trait improvement as compared to the reference. If $p<0.2$ and delta mean $>0$, the transgenic plants showed a trend of trait enhancement as compared to the reference. If two or more events of the transgene of interest showed enhancement in the same response, the transgene was deemed to show trait improvement.

Example 2

Identification of Homologs

A BLAST searchable "All Protein Database" is constructed of known protein sequences using a proprietary sequence database and the National Center for Biotechnology Information (NCBI) non-redundant amino acid database (nr.aa). For each organism from which a DNA sequence provided herein was obtained, an "Organism Protein Database" is constructed of known protein sequences of the organism; the Organism Protein Database is a subset of the All Protein Database based on the NCBI taxonomy ID for the organism.

The All Protein Database is queried using amino acid sequence of cognate protein for gene DNA used in trait-improving recombinant DNA, i.e., sequences of SEQ ID NO: 198 through SEQ ID NO: 394 using "blastp" with E-value cutoff of 1e-8. Up to 1000 top hits were kept, and separated by organism names. For each organism other than that of the query sequence, a list is kept for hits from the query organism itself with a more significant E-value than the best hit of the organism. The list contains likely duplicated genes, and is referred to as the Core List. Another list was kept for all the hits from each organism, sorted by E-value, and referred to as the Hit List.

The Organism Protein Database is queried using amino acid sequences of SEQ ID NO: 198 through SEQ ID NO: 394 using "blastp" with E-value cutoff of 1e-4. Up to 1000 top hits are kept. A BLAST searchable database is constructed based on these hits, and is referred to as "SubDB". SubDB was queried with each sequence in the Hit List using "blastp" with E-value cutoff of 1e-8. The hit with the best E-value is compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 395 to SEQ ID NO: 19938. These orthologs are reported in Tables 2 as homologs to the proteins cognate to genes used in trait-improving recombinant DNA.

TABLE 2

| SEQ ID NO: | homolog SEQ ID NOs | | | | | | | | | | | |
|---|---|---|---|---|---|---|---|---|---|---|---|---|
| 198: | 3331 | 2914 | 8408 | 6836 | 10845 | 14799 | 13562 | 8848 | 2509 | 13003 | 875 | 10945 |
| | 4176 | 7318 | 4820 | 19156 | 19137 | 14942 | 17166 | 13809 | 3506 | 3410 | 1343 | 8019 |
| | 7882 | 6490 | 3550 | 4999 | 3130 | 12635 | 8774 | 10864 | 17857 | 18089 | 16263 | 7295 |
| | 10882 | 18252 | 3728 | 14833 | 11485 | 15463 | 18826 | 2924 | 18723 | 1446 | 2812 | 7847 |
| | 3395 | 4209 | 15768 | 10679 | 18379 | 14040 | 3974 | 1087 | 11574 | 6329 | 5482 | 5609 |

TABLE 2-continued

| SEQ ID NO: | homolog SEQ ID NOs | | | | | | | | | | |
|---|---|---|---|---|---|---|---|---|---|---|---|
| | 6441 | 5537 | 17042 | 4716 | 4516 | 12643 | 11384 | 12736 | 8137 | 1344 | 19473 | 8452 |
| | 4094 | 2460 | 18071 | 16891 | 5620 | 2364 | 7018 | 5200 | 11131 | 18133 | 12170 | 2731 |
| | 1687 | 5014 | 18511 | 9343 | 19283 | 6682 | 8123 | 8124 | 10597 | 10622 | 10608 | 10600 |
| | 16221 | 4280 | 11494 | 4867 | 9035 | 9507 | 7969 | 19159 | 19425 | 5248 | 17367 | 8135 |
| | 8773 | 1287 | 2671 | 9365 | 18729 | 13828 | 8754 | 7170 | 14529 | 16604 | 8341 | 1135 |
| | 6224 | 9739 | 11212 | 12962 | 4331 | 13555 | 14356 | 14357 | 14783 | 7509 | 2032 | 4692 |
| | 5243 | | | | | | | | | | | |
| 199: | 15320 | | | | | | | | | | | |
| 200: | 7710 | 14519 | 16336 | 7019 | 7872 | 7719 | 18299 | 10453 | 4650 | 15008 | 10089 | 699 |
| | 15645 | 10533 | 11751 | 12924 | 10526 | 5313 | 17532 | 8825 | 6941 | 7743 | 4155 | 14541 |
| | 9797 | 16905 | 8304 | 12080 | 19803 | 3087 | 1397 | 7534 | 5547 | 2423 | | |
| 201: | 11777 | 6444 | 1416 | 4353 | 15071 | 3413 | 14526 | | | | | |
| 202: | 19073 | 6651 | 15740 | 7399 | 15791 | 2977 | 7789 | 9248 | 14697 | 15923 | 12131 | 5470 |
| | 965 | 11100 | 11069 | 12624 | 12892 | 3580 | 5270 | 18663 | 2916 | 1684 | 8107 | 4240 |
| | 19240 | 18582 | 19054 | 15775 | 7301 | 17416 | 10566 | 16351 | 13846 | 16386 | 18431 | 4439 |
| | 4056 | 8159 | 8292 | 12484 | 7316 | 3763 | 4783 | 18427 | 15501 | 16164 | 7762 | 4015 |
| | 4556 | 18955 | 12061 | 8636 | 9665 | 9713 | 10212 | 17555 | 5330 | 12850 | 16436 | 19045 |
| | 16034 | 16692 | 2571 | 11676 | 12666 | 11853 | 5348 | 8771 | 12218 | 3157 | 10749 | |
| 203: | 5608 | 2382 | 17993 | 16598 | 7505 | 6976 | | | | | | |
| 204: | 11369 | 13527 | 10897 | 6893 | 6962 | 11592 | 837 | 5116 | 19669 | 1655 | 7244 | 2623 |
| | 2591 | 16504 | 17797 | 4636 | 15133 | 4141 | 7112 | 7939 | 6898 | 15965 | 16706 | 16979 |
| | 11784 | 16115 | 9620 | 15750 | 14652 | 3008 | 7838 | 14787 | 4563 | 1873 | 15811 | 7271 |
| | 4317 | 16603 | 1715 | 14288 | 11341 | 6188 | 1546 | 5683 | 5225 | 3033 | 6069 | 11268 |
| | 15981 | 15490 | 4181 | 8633 | 6058 | 7993 | 6763 | 9671 | 14892 | 17296 | 990 | 8184 |
| | 2935 | 8536 | 11232 | 12598 | 12638 | 5112 | 10787 | 1107 | 13858 | 5864 | 16398 | 16380 |
| | 17071 | 16520 | 1973 | 5455 | 13852 | 19228 | 1695 | 17402 | 2865 | 17120 | 2507 | 5601 |
| | 14952 | 1462 | 6616 | 6973 | 3092 | 1382 | 7755 | 3870 | 9765 | 5711 | 1257 | 6119 |
| | 15310 | 3792 | 15970 | 16032 | 14584 | 7282 | 15140 | 7273 | 3013 | 15249 | 13253 | 13241 |
| | 2265 | 17700 | 18976 | 4009 | 17354 | 2223 | 17559 | 3151 | 6320 | 17010 | 8939 | 11258 |
| | 734 | 573 | 15015 | 3050 | 16344 | 3931 | 11238 | 7691 | 11499 | 1112 | 4825 | 8344 |
| | 13519 | 11669 | 5640 | 13588 | 5473 | 15108 | 7210 | 17617 | 5994 | 5980 | 16627 | 17906 |
| | 5876 | 6079 | 18894 | 6956 | 12887 | 14694 | 10968 | 1061 | 2778 | 6096 | 10570 | 680 |
| | 974 | 3120 | 16300 | 5885 | 7626 | 13881 | 4244 | 4233 | 15039 | 4486 | 3103 | 3115 |
| | 7654 | 11890 | 12359 | 10800 | 9409 | 12657 | 8977 | 9182 | 17818 | 2942 | 9780 | 9899 |
| | 18496 | 4118 | 18188 | 10437 | 13907 | 17312 | 15730 | 13906 | 2603 | 12770 | 4837 | 12953 |
| | 16663 | 9237 | 9546 | 16293 | 18238 | 6022 | 13908 | 10266 | 9180 | 5538 | 15536 | 10370 |
| | 15958 | 5217 | 8154 | 13095 | 15972 | 14841 | 15262 | 12702 | 10766 | 15960 | 18726 | 19395 |
| | 10345 | 5964 | 13064 | 3946 | 17225 | 17262 | 17220 | 17266 | 17224 | 17252 | 5465 | 5495 |
| | 12800 | 12814 | 12758 | 3021 | 12400 | 12492 | 16461 | 13638 | 5616 | 17449 | 8397 | 17258 |
| | 5669 | 5675 | 6852 | 9796 | 17601 | 17569 | 9775 | 17664 | | | | |
| 205: | 14023 | 6117 | 12539 | 6696 | 18601 | 1463 | 19893 | 6621 | 9577 | 9166 | 17890 | 17889 |
| | 528 | 5413 | 18313 | 2784 | 8102 | 3988 | 890 | 19106 | 571 | 6791 | 2402 | 912 |
| 206: | 17912 | 8799 | 6566 | 12137 | 4356 | 5803 | 5253 | 6078 | 9123 | 17523 | 12392 | 17806 |
| | 6917 | 19039 | 7350 | 17767 | 11311 | 17082 | 15535 | 19392 | 11233 | 470 | 8318 | 14963 |
| | 16736 | 8867 | 14135 | 5246 | 4674 | 2124 | 9901 | 13302 | 15459 | 18997 | 2954 | 1026 |
| | 667 | 7561 | 16841 | 8092 | 9084 | 4065 | 1836 | 13713 | 13697 | 17640 | 7422 | 19580 |
| | 4565 | 15193 | 526 | 13108 | 7065 | 11703 | 11362 | 3633 | 19430 | 6221 | 17433 | 15616 |
| | 10082 | 10189 | 3089 | 15238 | 6633 | 8106 | 16180 | 15317 | 16364 | | | |
| 207: | 14575 | 8831 | 11211 | 14985 | 17619 | 18829 | 2521 | 5219 | 15413 | 15835 | 1204 | 6569 |
| | 4661 | 4457 | 6066 | 14578 | 932 | 13694 | 7541 | 4813 | 15707 | 19563 | 1326 | 16107 |
| | 5009 | 7518 | 14825 | 13777 | 6175 | 15925 | 13617 | 5765 | 14838 | 9091 | 10776 | 15679 |
| | 5909 | 19373 | 756 | | | | | | | | | |
| 208: | 19581 | 18655 | 16310 | 7497 | 6382 | 8261 | 936 | 7358 | 8883 | 4866 | 2146 | 8601 |
| | 2932 | 1626 | 10354 | 15192 | 11509 | 9909 | 13503 | 488 | 17477 | 14483 | 16941 | 2824 |
| | 1072 | 4989 | 14179 | 4883 | 13751 | | | | | | | |
| 209: | 3493 | 16588 | 7031 | 5155 | 11150 | 17294 | 5241 | 10621 | 5786 | 5591 | 16509 | 2021 |
| | 1324 | 12454 | 15061 | 1670 | 15143 | 16506 | 17002 | 8741 | 18091 | 4013 | 5959 | 19370 |
| | 4239 | 12885 | 12174 | 3709 | 3431 | 9596 | 3378 | 1018 | 5963 | 13212 | 3150 | 2952 |
| | 1619 | 19861 | 19114 | 15446 | 19582 | 12663 | 19603 | | | | | |
| 210: | 17777 | 843 | 11020 | 1337 | 18495 | 1493 | 6396 | 15336 | 14087 | 2568 | 4517 | 1157 |
| | 10741 | 4553 | 14999 | 425 | 4258 | 17388 | 5327 | 748 | 11691 | 10174 | 17805 | 16628 |
| | 10117 | 7980 | 8902 | | | | | | | | | |
| 211: | 9637 | 17261 | 13232 | 7387 | 10506 | 19067 | 12021 | 872 | 11620 | 13603 | 841 | 1450 |
| | 2848 | 16911 | | | | | | | | | | |
| 212: | 14398 | 1558 | 18339 | 13428 | 13431 | 4182 | 16260 | 10619 | 6127 | 12005 | 7704 | 5064 |
| | 13072 | 4395 | 9032 | 19907 | 9588 | 478 | 12782 | 9917 | 13100 | 5202 | 10562 | 2044 |
| | 4452 | 10775 | 3543 | 14840 | 14071 | 14020 | 10406 | 14218 | 1797 | 16955 | 3879 | 10312 |
| | 12432 | 14824 | 7082 | 14554 | 15744 | 1508 | 15866 | 16232 | 6797 | 7077 | 5816 | 3597 |
| | 3596 | 3311 | 15022 | 881 | 2638 | 12037 | 12039 | 3458 | 2270 | 8812 | 3217 | |
| | 9466 | 18102 | 610 | 9042 | 2431 | 18349 | 16650 | 14418 | 2251 | 4235 | 6826 | 1244 |
| | 16651 | 13004 | 7852 | 14435 | 9553 | 9262 | 15603 | 4340 | 9235 | 1413 | 10538 | 8296 |
| | 17223 | 16048 | 16071 | 2120 | 19847 | 10420 | 11239 | 18968 | 2995 | 7551 | 15854 | 12345 |
| | 5685 | 18180 | 2381 | 4814 | 2159 | 16862 | 8677 | 11435 | 6649 | 6015 | 8097 | |
| | 11230 | 16025 | 9440 | 1353 | 16151 | 16249 | 15930 | 11226 | 9398 | 2870 | 12373 | 15043 |
| | 11765 | 10145 | 11071 | 285 | 9270 | 9537 | 9095 | 2350 | 13362 | 5496 | 7924 | 11756 |
| | 2624 | 7967 | 6715 | 15074 | 17068 | 9275 | 10177 | 11007 | 14857 | 8951 | 12182 | 11643 |
| | 13590 | 7684 | 1740 | 929 | 910 | 9093 | 10018 | 13344 | 16978 | 17544 | 6305 | 11378 |
| | 1393 | 14108 | 15937 | 16631 | 11803 | 13126 | 11969 | 18524 | 9644 | 8425 | 8421 | 8420 |

TABLE 2-continued

| SEQ ID NO: | homolog SEQ ID NOs | | | | | | | | | | |
|---|---|---|---|---|---|---|---|---|---|---|---|
| | 10755 | 10757 | 16696 | 15994 | 1143 | 3549 | 5868 | 5126 | 7506 | 12547 | 12669 | 19032 |
| | 4707 | 4710 | 4708 | 4732 | 4736 | 4733 | 8772 | 4730 | 4711 | 3385 | 1831 | 2528 |
| | 2304 | 15098 | 13223 | 15197 | 11673 | 4386 | 11884 | 2336 | 14693 | 9118 | 9633 | 14548 |
| | 12725 | 2399 | 18359 | 11011 | 14692 | 5652 | 5434 | 9755 | 9513 | 2681 | 4364 | 12903 |
| | 19777 | 13525 | 4326 | 6859 | 6088 | 11611 | 3068 | 13940 | 3578 | 14440 | 8582 | 9826 |
| | 19618 | 18012 | 17233 | 10057 | 18222 | 15021 | 9371 | 5985 | 14888 | 14001 | 1279 | 7826 |
| | 14232 | 18172 | 7425 | 11502 | 15565 | 17431 | 8317 | 10294 | 17742 | 5564 | 5531 | 18144 |
| | 7400 | 10835 | 14389 | 13461 | 13857 | 7113 | 16444 | 4722 | 2115 | 7276 | 18254 | 1237 |
| | 5256 | 13951 | 2920 | 16719 | 1045 | 15371 | 19022 | 684 | 8004 | 2781 | 19811 | 19766 |
| | 3279 | 18712 | 4940 | 14312 | 6426 | 10076 | 15772 | 7906 | 19836 | 11219 | 18985 | 2673 |
| | 3933 | 14263 | 11860 | 1907 | 4672 | 15599 | 13737 | 4944 | 2252 | 15415 | 11543 | 3433 |
| | 7746 | 17114 | 4115 | 4881 | 9445 | 14696 | 9525 | 14484 | 16112 | 5392 | 10428 | 1400 |
| | 9349 | 7616 | 18930 | 2533 | 12585 | 10497 | 10236 | 18415 | 4874 | 19793 | 4633 | 12544 |
| | 1995 | 17255 | 6130 | 10439 | 15261 | 6768 | 15985 | 17752 | 8504 | 12863 | 7487 | 14875 |
| | 12020 | 2036 | 18127 | 9264 | 3628 | 5019 | 7498 | 15865 | 1448 | 9636 | 2840 | 3161 |
| | 6207 | 2644 | 1059 | 2065 | 10031 | 2171 | 16927 | 4747 | 18701 | 19271 | 4174 | 1389 |
| | 9893 | 12527 | 9018 | 10035 | 5039 | 10698 | 13943 | 7894 | 12671 | 5651 | 19586 | 12810 |
| | 1254 | 3519 | 16114 | 4286 | 13948 | 14493 | 8294 | 14606 | 2586 | 14069 | 7712 | 16988 |
| | 737 | 16797 | 16826 | 18966 | 5145 | 17610 | 6304 | 8895 | 7744 | 9280 | 9284 | 10647 |
| | 16558 | | | | | | | | | | | |
| 213: | 12662 | 5295 | 19093 | 10971 | 15359 | 1163 | 18513 | 889 | 2151 | 3536 | 7105 | 3292 |
| | 8466 | 18205 | 3579 | 1504 | 19486 | 13768 | 18047 | 6871 | 7174 | 11029 | 11505 | 17782 |
| | 5697 | 18822 | 4892 | 12656 | 1284 | 3062 | 4697 | 5993 | 18343 | 18790 | 3057 | 7014 |
| | 12265 | 10981 | 15204 | 11631 | 17704 | 17941 | 10633 | 19776 | 933 | 10363 | 8446 | 17800 |
| | 9822 | 2953 | 13693 | 19862 | 14551 | 15692 | 17673 | 6081 | 5049 | 12581 | 6910 | |
| 214: | 15345 | 19484 | 4871 | 3871 | 6695 | 3993 | 11459 | 9199 | 15899 | 13821 | 14206 | 19489 |
| | 13765 | 712 | 19072 | 11649 | | | | | | | | |
| 215: | 1607 | 15669 | 13168 | 19044 | 790 | 9515 | 4511 | 13776 | 11573 | 13000 | | |
| 216: | 4929 | 17143 | 10058 | 17506 | 15064 | 3332 | 5268 | 6968 | 16252 | 15949 | 6180 | 3000 |
| | 14937 | 18454 | 13071 | | | | | | | | | |
| 217: | 6807 | 19716 | 480 | 14021 | 4179 | 12236 | 6337 | 12237 | 6338 | 6336 | 12234 | 4815 |
| | 2261 | 18555 | 4706 | 7836 | 9176 | 18851 | 3443 | 9382 | 9439 | 8870 | 16691 | 16646 |
| | 11516 | 11500 | 11515 | 11498 | 16670 | 16660 | 16683 | 11513 | 11496 | 16668 | 16664 | 11519 |
| | 16686 | 11479 | 11481 | 7146 | 16643 | 16659 | 4850 | 17951 | 7144 | 4824 | 7163 | 4851 |
| | 11234 | 4860 | 17956 | 7160 | 17977 | 4827 | 4826 | 4859 | 7147 | 11475 | 7165 | 17928 |
| | 17958 | 4853 | 11473 | 7143 | 11477 | 5129 | 18893 | 18914 | 17526 | 17529 | 17548 | 17547 |
| | 17549 | 18917 | 13686 | 19089 | 13683 | 4938 | 16999 | 13666 | 4494 | 12074 | 17097 | 12093 |
| | 16874 | 12095 | 15878 | 17159 | 17154 | 17156 | 17153 | 5681 | 15126 | 10052 | 19712 | 4288 |
| | 15399 | 742 | 11607 | 15654 | 7006 | 8041 | 715 | 2713 | 11522 | 7695 | 3581 | 7865 |
| | 3776 | 15738 | 19821 | 17259 | 3948 | 13388 | 17427 | 15523 | 14216 | 8711 | 15423 | 19060 |
| | 16814 | 14298 | 18720 | 7885 | 3967 | 9710 | 3568 | 3573 | 3575 | 8503 | 15486 | 12932 |
| | 7870 | 989 | 3595 | 17756 | 9202 | 520 | 11205 | 14771 | 3574 | 2443 | 8036 | 19537 |
| | 14641 | 6739 | 15375 | 2400 | 6753 | 3336 | | | | | | |
| 218: | 13099 | 6217 | 4454 | 4699 | 11292 | 4702 | 1554 | 6467 | 15339 | 15722 | 11035 | 12964 |
| | 16317 | 13914 | 17486 | 18809 | 14651 | 4189 | 9581 | 14957 | 2871 | 1561 | 17618 | 3835 |
| | 14955 | 3868 | 9158 | 13663 | 10042 | 7575 | 19824 | 6200 | 10522 | 3600 | 4064 | 14590 |
| | 12731 | 7201 | 19572 | 9060 | 4035 | 6255 | 3457 | 11320 | 7986 | 8818 | | |
| 219: | 19325 | 10450 | 4487 | 12312 | 2564 | 10096 | 5641 | 1947 | 4367 | 6964 | 18031 | 1012 |
| | 11041 | 15078 | 12255 | 5761 | 5061 | 9832 | 16834 | 18348 | | | | |
| 220: | 8238 | 19207 | 18657 | 1358 | 2734 | 9320 | 13526 | 12631 | 17660 | 16548 | 15528 | 18501 |
| | 18049 | 15274 | 19470 | | | | | | | | | |
| 221: | 2724 | 17089 | 9639 | 9208 | 17722 | 6817 | 11848 | 18904 | 13673 | 2347 | 11585 | 3054 |
| | 7486 | 6056 | 1290 | 14932 | 14930 | 12636 | 14230 | 1572 | 15708 | 18912 | 18177 | 1699 |
| | 10460 | 2090 | 5583 | 18802 | 606 | 5929 | 5041 | 19148 | 14224 | 9144 | 2643 | 17144 |
| | 14142 | 14674 | 16275 | | | | | | | | | |
| 222: | 14820 | 18626 | 11591 | 649 | 3005 | 3037 | 5453 | 5430 | 14248 | 2371 | 4626 | 11661 |
| | 9784 | 10560 | 16219 | 11699 | | | | | | | | |
| 223: | 17739 | 13288 | 4139 | 15466 | 19773 | 753 | 1277 | 14333 | 4211 | 14510 | 662 | 7930 |
| | 18703 | 3268 | 19400 | 17533 | 2302 | 9078 | | | | | | |
| 224: | 13859 | 17816 | 12692 | 10417 | 7051 | 5444 | 12975 | 1611 | 7050 | 17105 | 5023 | 3397 |
| | 13149 | 14751 | 10564 | 7331 | 7329 | 11868 | 9210 | 9211 | 18860 | 18879 | 14568 | 17920 |
| | 14497 | 12723 | 19352 | 10587 | | | | | | | | |
| 225: | 11265 | 17061 | 11261 | 17058 | 11267 | 17064 | 8014 | 8033 | 8018 | 508 | 8035 | 8038 |
| | 8013 | 8017 | 3554 | 13411 | 12545 | 12528 | 11997 | 12566 | 11922 | 12520 | 11958 | 12525 |
| | 12522 | 12553 | 11961 | 11979 | 5030 | 3464 | 3910 | 18901 | 14601 | 14600 | 840 | 15664 |
| | 15668 | 15121 | 15142 | 15119 | 15686 | 15690 | 15657 | 15688 | 15146 | 15164 | 15716 | 15148 |
| | 15656 | 11191 | 13623 | 12732 | 5050 | 5029 | 5011 | 5055 | 5035 | 5036 | 5032 | 5081 |
| | 5058 | 5013 | 5078 | 5026 | 5059 | 5077 | 5008 | 5053 | 5076 | 11939 | 11976 | 12541 |
| | 2898 | 17207 | 5179 | 5115 | 13674 | 16078 | 9689 | 11174 | 5252 | 17279 | 17277 |
| | 11177 | 1867 | 1865 | 1823 | 1844 | 1842 | 1793 | 1824 | 1820 | 10671 | 3139 | 1123 |
| | 5805 | 12934 | 12755 | 7504 | 1091 | 17904 | 17909 | 17926 | 17902 | 17938 | 17907 | 17929 |
| | 10598 | 17935 | 17933 | 5298 | 17980 | 10601 | 5383 | 14050 | 6585 | 11379 | 16583 | 17978 |
| | 17814 | 4838 | 17812 | 2633 | 3257 | 3189 | 774 | 12008 | 9988 | 14268 | 18392 | 12567 |
| | 14920 | 12980 | 11959 | 7682 | 7685 | 13235 | 4127 | 3740 | 3766 | 3770 | 3769 | 3795 |
| | 14966 | 457 | 8521 | 19464 | 4847 | 13386 | 5024 | 13387 | 13401 | 5957 | 6571 | 7932 |
| | 8369 | 10496 | 10492 | 10490 | 10495 | 10517 | 7943 | 4958 | 4956 | 4923 | 4986 | 4961 |
| | 4951 | 5007 | 4937 | 4934 | 4984 | 4933 | 4924 | 4921 | 4936 | 4979 | 4932 | 4981 |
| | 4988 | 18200 | 18196 | 7176 | 4739 | 5479 | 8351 | 7177 | 12886 | 9521 | 6464 | 17681 |

TABLE 2-continued

| SEQ ID NO: | homolog SEQ ID NOs | | | | | | | | | | | |
|---|---|---|---|---|---|---|---|---|---|---|---|---|
| | 14504 | 907 | 16793 | 1869 | 14509 | 8882 | 19727 | 8798 | 1197 | 3419 | 14168 | 12846 |
| | 15739 | 1115 | 14165 | 19715 | 492 | 8873 | 1119 | 497 | 1194 | 3251 | 1116 | 8876 |
| | 13982 | 12860 | 14430 | 451 | 14969 | 6102 | 4358 | 2650 | 2649 | 11790 | 12925 | 5882 |
| | 19696 | 9551 | 3867 | 19796 | 18933 | 18929 | 833 | 4908 | 14217 | 4852 | 4858 | 16064 |
| | 14208 | 10736 | 4886 | 14214 | 16062 | 14172 | 10735 | 14210 | 10720 | 1885 | 14187 | 14190 |
| | 14184 | 14207 | 14703 | 14707 | 14709 | 14706 | 14390 | 7658 | 7659 | 7661 | 2582 | 13794 |
| | 5204 | 17305 | 16541 | 8914 | 16959 | 17283 | 9043 | 3924 | 2696 | 8656 | 6648 | 2675 |
| | 18504 | 17311 | 6052 | 9425 | 9406 | 9410 | 9411 | 6051 | 9452 | 6033 | 15964 | 6267 |
| | 6031 | 8489 | 8463 | 8865 | 9427 | 6268 | 8490 | 8493 | 15602 | 15621 | 14616 | 15649 |
| | 15652 | 15606 | 11723 | 17247 | 9423 | 15595 | 15624 | 16148 | 2240 | 7428 | 11722 | 11363 |
| | 2225 | 2196 | 5480 | 15579 | 15626 | 16142 | 7413 | 5483 | 11741 | 16145 | 16162 | 11725 |
| | 5481 | 18072 | 10973 | 12451 | 12340 | 15511 | 12185 | 4348 | 12754 | 8722 | 14544 | 6171 |
| | 10732 | 9492 | 19795 | 12165 | 15082 | 6617 | 9613 | 739 | 19520 | 2497 | 14005 | 11128 |
| | 18795 | 14331 | 14329 | 14334 | 16439 | 12070 | 4053 | 3942 | 2387 | 2391 | 2394 | 755 |
| | 754 | 2950 | 752 | 2377 | 19819 | 17119 | 7118 | 1360 | 2273 | 11458 | 13758 | 11215 |
| | 11274 | 11229 | 13178 | 5110 | 16239 | 12884 | 18765 | 16637 | 19693 | 16831 | 17824 | 10810 |
| | 15395 | 15420 | 17470 | 10005 | 16397 | 16394 | 14711 | 14728 | 15503 | 4401 | 801 | 12244 |
| | 12292 | 12308 | 12219 | 9033 | 16763 | 14392 | 16804 | 16785 | 9566 | 16806 | 14409 | 14391 |
| | 16762 | 9027 | 9568 | 9029 | 16788 | 9009 | 16780 | 14410 | 16781 | 16782 | 16802 | 3330 |
| | 3357 | 3326 | 9001 | 3358 | 5789 | 14387 | 14412 | 3360 | 3356 | 1643 | 1805 | 14061 |
| | 15787 | 5632 | | | | | | | | | | |
| 226: | 19514 | 17912 | 10095 | 10091 | 10252 | 15927 | 5360 | 18385 | 12313 | 19719 | 12823 | 5182 |
| | 1491 | 8631 | 4666 | 2562 | 9358 | 10461 | 3952 | 19610 | 9255 | 7782 | 16516 | 5161 |
| | 6343 | 4894 | 5577 | 16734 | 1381 | 16378 | 14552 | 12707 | 11907 | 7651 | 10404 | 17767 |
| | 2417 | 11311 | 17082 | 17741 | 11253 | 11254 | 7473 | 13718 | 6269 | 3242 | 7085 | 5224 |
| | 8787 | 16268 | 19692 | 10769 | 8867 | 1434 | 16082 | 19530 | 14789 | 13615 | 18997 | 2954 |
| | 9175 | 8092 | 9082 | 1813 | 1815 | 1817 | 639 | 3883 | 15427 | 2035 | 4435 | 3601 |
| | 414 | 7005 | 8000 | 1812 | 1131 | 1455 | 6221 | 11231 | 10817 | 15601 | 16270 | 6118 |
| | 2193 | 17500 | 14186 | 9141 | 3449 | 3089 | 13886 | 15786 | 15238 | 2001 | 3945 | 14973 |
| | 16180 | 15317 | 18083 | 18695 | | | | | | | | |
| 227: | 17372 | 8093 | 5527 | 2439 | 13784 | 14768 | 10702 | 11535 | 7750 | 761 | 18735 | 5946 |
| | 17426 | 17988 | 10652 | 2928 | 18398 | 2009 | 9559 | 5094 | 12948 | 8522 | 1305 | 17785 |
| | 5852 | | | | | | | | | | | |
| 228: | 2790 | 5299 | 15433 | 5501 | 18128 | 16466 | 14960 | 6564 | 8782 | 4397 | 19662 | 16008 |
| | 10829 | 19118 | 18086 | 3428 | 17943 | 10935 | 15806 | 8101 | 1184 | 4968 | 6059 | 10388 |
| 229: | 7539 | 3499 | 12437 | 19471 | 14158 | 11575 | 6399 | 15966 | 17187 | 13512 | 7688 | 2131 |
| | 10858 | 4169 | 19567 | 7834 | 7585 | 14073 | 3954 | 1991 | 12940 | 7756 | 8167 | 18994 |
| | 9449 | 15859 | 4341 | 17025 | 14373 | 12191 | 12982 | 983 | 13764 | 19774 | 16247 | 12665 |
| | 12664 | 2619 | 18875 | 7515 | 11785 | 2849 | 10913 | 10717 | 4653 | 11887 | 905 | 1641 |
| | 3563 | 6183 | 16765 | 17773 | 4166 | 4694 | 14328 | 11986 | 12084 | 1625 | 12695 | 9681 |
| | 14082 | 17341 | 15047 | 17498 | 3530 | 3531 | 7241 | 7972 | 4790 | 15643 | 14365 | |
| 230: | 12430 | 9914 | 10470 | 14976 | 6139 | 18895 | 8072 | 18544 | 7257 | 6437 | 15066 | |
| 231: | 7185 | 13859 | 12150 | 12692 | 5555 | 6319 | 14735 | 16754 | 3121 | 2208 | 14915 | 18531 |
| | 2991 | 7950 | 2419 | 4378 | 18922 | 4377 | 18705 | 17105 | 5023 | 3397 | 2203 | 5350 |
| | 895 | 18953 | 5090 | 9210 | 9211 | 14568 | 19723 | 12433 | 3877 | 17892 | 19476 | 11685 |
| | 9653 | 9066 | 16392 | 7989 | 5056 | 6545 | 19418 | | | | | |
| 232: | 10845 | 14019 | 10546 | 14942 | 7302 | 8774 | 13992 | 10864 | 7129 | 12564 | 10723 | 2440 |
| | 19878 | 3172 | 18252 | 12532 | 9942 | 2129 | 18826 | 13723 | 17324 | 19791 | 8580 | 3395 |
| | 5915 | 9604 | 7572 | 16359 | 8047 | 3408 | 5482 | 12915 | 9969 | 16513 | 1344 | 16044 |
| | 19210 | 18748 | 11940 | 14402 | 19311 | 5620 | 2364 | 19283 | 5249 | 3646 | 17251 | 17844 |
| | 14459 | 5315 | 9268 | 16190 | 19143 | 15124 | 418 | 3076 | 16204 | 17414 | 18692 | 13164 |
| | 8191 | 10636 | 13894 | 3423 | 2842 | 1173 | 7663 | 13250 | 18208 | 14090 | 19680 | 15815 |
| | 4805 | 10584 | 1287 | 15495 | 9256 | 2229 | 10166 | 19534 | 11163 | 2292 | 2687 | 19082 |
| | 9365 | 2465 | 5381 | 18660 | 3073 | 9545 | 17750 | | | | | |
| 233: | 19344 | 12031 | 1229 | 15123 | 14123 | 19501 | 7767 | 5944 | 11173 | 4596 | 11614 | 10841 |
| | 14129 | 2393 | 7360 | 621 | 14382 | 8136 | 14668 | 7577 | 1652 | 2491 | 3392 | |
| | 2160 | 4767 | 17696 | 6615 | 12377 | 3471 | 2985 | 17194 | 17177 | 10988 | 5084 | 9695 |
| | 16519 | 11445 | 3213 | 10846 | 16453 | 19346 | 18274 | 17478 | 17798 | 15663 | 6823 | 5131 |
| | 14272 | 3777 | 19911 | 19724 | 6132 | 19722 | 14803 | 17148 | 1605 | 11787 | 14359 | 15796 |
| | 645 | 10159 | 13264 | 12931 | 6357 | 4621 | 16774 | 18913 | 5746 | 7161 | | |
| 234: | 11849 | 7119 | 1272 | 13625 | 6244 | 7780 | 7229 | 640 | 15779 | 14967 | 5388 | 14480 |
| | 1349 | 17525 | 12768 | 10327 | 8976 | 5113 | 5895 | 15006 | 4428 | 16619 | 4613 | 3393 |
| | 18954 | 4451 | 3799 | 17712 | 12488 | 15863 | 18697 | 18482 | 7844 | | | |
| 235: | 8664 | 9584 | 8904 | 18497 | 19265 | 8237 | 2617 | 7729 | 17728 | 8659 | 13842 | 11016 |
| | 9197 | 10827 | 5351 | 3224 | 7379 | | | | | | | |
| 236: | 12797 | 7459 | 12082 | 1618 | 7740 | 16856 | 7623 | 8994 | 7602 | 19549 | 12596 | 7644 |
| | 18396 | 13883 | 7266 | 18758 | 3328 | 18998 | 1660 | 12434 | 2139 | 19899 | 12252 | 5883 |
| | 3266 | 19587 | 11474 | 5870 | 5443 | | | | | | | |
| 237: | 14746 | 16460 | 7754 | 9978 | 16450 | 18053 | 18050 | 18466 | 8866 | 10337 | 8245 | 1604 |
| | 8568 | 13606 | 19627 | 18283 | 15611 | 10648 | 13871 | 9910 | 10297 | 3025 | 18486 | 8908 |
| | 14474 | 11654 | 2349 | 10867 | 14488 | 13901 | 7336 | 11511 | 14836 | 1906 | 13400 | 5568 |
| | 19527 | 4351 | 18319 | 6689 | 10519 | 15977 | 15760 | 7605 | 16652 | 14204 | 14665 | 727 |
| | 9225 | 12804 | 2776 | 11108 | 14258 | 1882 | 4357 | 1972 | 8324 | 6435 | 18239 | 6728 |
| | 18983 | 9555 | 13551 | 10797 | 18458 | 4622 | 14064 | 2771 | 1818 | 18410 | 13553 | 15912 |
| | 10854 | 9475 | 10873 | 15530 | 14816 | 6283 | 703 | 8105 | 16216 | 7038 | 957 | 11908 |
| | 13853 | 10718 | 11237 | 5623 | 10262 | 12248 | 6541 | 7053 | 4480 | 14011 | 17142 | 6691 |
| | 7795 | 17981 | 2822 | 1473 | 3561 | 4545 | 13347 | 1348 | 11256 | 6511 | 11356 | 13955 |
| | 6699 | 6555 | 6559 | 3185 | 16166 | 17894 | 9307 | 6011 | 10635 | 1391 | 13177 | 16458 |

TABLE 2-continued

| SEQ ID NO: | homolog SEQ ID NOs | | | | | | | | | | |
|---|---|---|---|---|---|---|---|---|---|---|---|
| | 702 | 18335 | 18740 | 16787 | 4175 | 10950 | 3412 | 4193 | 951 | 13870 | 19183 | 18644 |
| | 947 | 16280 | 6184 | 13111 | 3667 | 10338 | 4125 | 14782 | 18479 | 18004 | 19084 | 12471 |
| | 16645 | 866 | 1895 | 10049 | 11122 | 12521 | 7132 | 2660 | 12759 | 14534 | 18429 | 15615 |
| | 17611 | 9347 | 12704 | 1525 | 7492 | 3451 | 18373 | 17125 | 5972 | 9777 | 16039 | 12350 |
| | 4073 | 8962 | 17221 | 1961 | 1958 | 11156 | 12899 | 3908 | 7429 | 10977 | 15040 | 16234 |
| | 17004 | 17293 | 13355 | 4977 | 260 | 10645 | 14133 | 9251 | 12220 | 12633 | 7087 | 9535 |
| | 8894 | 11452 | 2346 | 6125 | 2062 | 6710 | 13299 | 12947 | 12943 | 4422 | 5817 | 13502 |
| | 14378 | 13504 | 14379 | 4770 | 1451 | 19815 | 12842 | 4405 | 13837 | 9184 | 10051 | 10999 |
| | 9565 | 12305 | 11330 | 16546 | 17073 | 1402 | 5263 | 7189 | 6160 | 2372 | 6567 | 1248 |
| | 3858 | 14455 | 1766 | 2516 | 1656 | 14550 | 16864 | 14989 | 14368 | 15573 | 9312 | 7786 |
| | 13516 | 2969 | 1952 | 2541 | 11207 | 10625 | 9198 | 19674 | 10334 | 18065 | 3495 | 8519 |
| | 12201 | 3921 | 13249 | 18592 | 857 | 17545 | 11757 | 15455 | 2164 | 789 | 4350 | 3117 |
| | 8649 | 11708 | 11463 | | | | | | | | | |
| 238: | 9324 | 12427 | 663 | 6064 | 9836 | 19556 | 9348 | 1900 | 17219 | 13657 | 7086 | 7381 |
| | 6006 | 7357 | 10469 | 6466 | 8472 | 10588 | 17047 | 609 | 1637 | 10699 | 6450 | 14299 |
| | 15101 | 10536 | 18759 | 2378 | 18013 | 9269 | 3343 | 12489 | 11305 | 18178 | 2269 | 16890 |
| | 10629 | 18665 | 15962 | 9375 | 9437 | 16312 | 6501 | 11737 | 6339 | 10847 | 5290 | 4667 |
| | 5522 | 18388 | 1804 | 11566 | 2369 | 15872 | 12465 | 7687 | 6209 | 11354 | 15667 | 15938 |
| | 18971 | 18258 | 3774 | | | | | | | | | |
| 239: | 13622 | 9907 | 10802 | 1635 | 19607 | 8218 | 11862 | 18989 | 19820 | 1430 | 15998 | 4855 |
| | 18040 | 3455 | 2471 | 6506 | 7587 | 11932 | 17440 | 16155 | 13643 | 12011 | 13012 | 11289 |
| | 14270 | 17959 | 10271 | 5763 | 19020 | 5904 | 7809 | | | | | |
| 240: | 19167 | 14809 | 6116 | 11171 | 10424 | 1445 | 13848 | 1387 | 18366 | 9887 | 3732 | 10953 |
| | 2175 | | | | | | | | | | | |
| 241: | 939 | 3338 | 2461 | 7962 | 16158 | 15297 | 19138 | 7398 | 3035 | 1767 | 9983 | 16494 |
| | 10256 | 11165 | 13953 | 18376 | 4113 | 4116 | 10457 | 11995 | 19241 | 2063 | 19340 | 15435 |
| | 14028 | 14611 | 14366 | 18488 | 9171 | 5494 | 10438 | 18123 | 11822 | 13093 | 15526 | 9516 |
| | 18346 | 4375 | 8716 | | | | | | | | | |
| 242: | 12077 | 11851 | 16904 | 8919 | 18979 | 6443 | 17768 | 3571 | 5105 | | | |
| 243: | 12862 | 6311 | 17138 | 19420 | 12939 | 8147 | 18538 | 16023 | 6580 | 8709 | 16080 | 4700 |
| | 2940 | 9554 | 5556 | 503 | 12303 | 7072 | 8226 | 11973 | 19415 | 12551 | 9852 | 13704 |
| | 7982 | 1030 | 14887 | 12346 | 1435 | 1437 | 6242 | 16606 | 2041 | 5356 | 12706 | 9139 |
| | 2872 | 10869 | 9028 | 7957 | 7190 | 19892 | 16505 | 9383 | 6589 | 11472 | 8394 | 8396 |
| | 3626 | 16568 | 19220 | 18648 | 14425 | 15305 | 13545 | 8443 | 8427 | 1247 | 17078 | 14914 |
| | 5103 | 19922 | 14358 | 18892 | 8972 | 16582 | 12124 | 19870 | 9538 | 19845 | 19867 | 19195 |
| | 19221 | 19191 | 19323 | 19242 | 19215 | 19307 | 19275 | 19273 | 19356 | 19192 | 19173 | 19350 |
| | 19279 | 19216 | 19852 | 19223 | 19250 | 19326 | 19848 | 19330 | 19214 | 19869 | 19351 | 19332 |
| | 19276 | 19247 | 19177 | 19163 | 19305 | 19328 | 19851 | 19353 | 19197 | 19850 | 19358 | 19175 |
| | 11034 | 19871 | 6578 | 17445 | 3832 | 3831 | 6233 | 7090 | 9456 | 6970 | 13917 | 13920 |
| | 4539 | 4537 | 4542 | 4028 | | | | | | | | |
| 244: | 1245 | 4324 | 12202 | 4379 | 6967 | 9036 | 9880 | 10540 | 13263 | 13138 | 18122 | 19047 |
| | 2008 | 19483 | 2468 | 7439 | 5787 | 10979 | 15035 | 10982 | 3699 | 11097 | 14482 | 17829 |
| | 11866 | 4198 | 14130 | 17239 | 6111 | 14956 | 17492 | 11385 | 4004 | 10448 | 9464 | 9894 |
| | 15398 | 1231 | 12878 | 12829 | 3833 | 2080 | | | | | | |
| 245: | 11361 | 5661 | 8686 | 17264 | 8328 | 8330 | 7550 | 10232 | 18956 | 315 | 8720 | 1696 |
| | 5922 | 16632 | 14340 | 11996 | 8012 | 4522 | 16791 | 10038 | 5066 | 4969 | 4634 | 17213 |
| | 14401 | 7284 | 2099 | 6718 | 8030 | 14321 | 1903 | 15554 | 15028 | 12204 | 3060 | 19178 |
| | 11653 | 9316 | 17858 | 18132 | 18589 | 9667 | 17297 | 5418 | 17508 | 15450 | 6147 | 5012 |
| | 18588 | 18020 | 862 | 4920 | 15050 | 16525 | 3064 | 2884 | 5607 | 12297 | 11396 | 18052 |
| | 2912 | 17060 | 1697 | 17604 | 18870 | 1732 | 5968 | 18761 | 4044 | 5088 | 10593 | 5242 |
| | 4527 | 13682 | 8054 | 16503 | 1962 | 19380 | 1623 | 10664 | 4597 | 15319 | 3478 | 16945 |
| | 18584 | 3108 | 12724 | 15546 | 15764 | 15754 | 18354 | 18416 | 4890 | 19678 | 19130 | 15532 |
| | 5213 | 11374 | 9753 | 14702 | 15217 | 15921 | 5855 | 18752 | 1904 | 15721 | 18203 | 18156 |
| | 18864 | 8700 | 7560 | 16924 | 636 | 6811 | 16379 | 19046 | 11063 | 14929 | 16207 | 15425 |
| | 17368 | 11052 | 14975 | 6574 | 9560 | 10349 | 3830 | 8250 | 2015 | 18785 | 8196 | 7713 |
| | 11586 | 14490 | 18301 | 18792 | 15378 | 7699 | 18803 | 19816 | 16104 | 14468 | 17612 | 11556 |
| | 1765 | 5525 | 2247 | 5751 | 11815 | 17200 | 10136 | 6205 | 16567 | 10487 | 18141 | 6202 |
| | 8537 | 8518 | 7037 | 8133 | 6764 | 827 | 4941 | 818 | 8356 | 19365 | 7588 | 3017 |
| | 6400 | 5637 | 8416 | 12444 | 510 | 12026 | 11634 | 9859 | 1460 | 18194 | 11314 | 2685 |
| | 4226 | 984 | 19513 | 8932 | 12905 | 4112 | 18873 | | | | | |
| 246: | 13549 | 2112 | 6794 | 8833 | 12086 | 2984 | 5421 | 7868 | 9325 | 19092 | 9699 | 19026 |
| | 1631 | 4555 | 804 | 8588 | 19422 | 8685 | 6218 | 17573 | 17039 | 12147 | 4754 | 10543 |
| | 6834 | 6733 | 864 | 9209 | 4190 | 9301 | 16571 | 2360 | 4996 | 8081 | 11140 | 13006 |
| | 10637 | 5281 | 17394 | 4637 | 9663 | 1828 | 12569 | 1215 | 14407 | 13300 | 6644 | 11688 |
| | 17465 | 631 | 16880 | 3874 | 16141 | 975 | 8011 | 16154 | 18389 | 13579 | 15094 | 8944 |
| | 3735 | 8021 | 2288 | 15334 | 16083 | 15801 | 12760 | 10618 | 13208 | 19889 | 18999 | 4870 |
| | 13710 | 12132 | 15259 | 9267 | 11470 | 13144 | 17588 | 628 | 17272 | 14844 | 14000 | 19900 |
| | 15096 | 12603 | 13869 | 6532 | 16013 | 5431 | 1192 | 10395 | | | | |
| 247: | 14941 | 2202 | 18124 | 13094 | 7945 | 3968 | 8551 | 2458 | 18176 | 15639 | 12789 | 5427 |
| | 16829 | 9519 | 1674 | 19789 | 16819 | 4712 | 18517 | 13990 | 16185 | 6271 | 15089 | 5575 |
| | 1227 | 1331 | 10634 | 4978 | 6366 | 14209 | 9402 | 12738 | 589 | 6685 | 16243 | 2070 |
| | 14026 | 12494 | | | | | | | | | | |
| 248: | 4050 | 14993 | 16855 | 19797 | 5528 | 9097 | 18611 | 19631 | 18510 | 8376 | 8956 | 10289 |
| | 11370 | 13805 | 18078 | 19606 | 8202 | 15826 | 16478 | 19041 | 5700 | 6765 | 8134 | 14325 |
| | 10101 | 16816 | 4765 | 16287 | 5377 | 18675 | 7230 | 7964 | 876 | 9597 | 19802 | 11403 |
| | 4833 | 17530 | 18265 | 13417 | 12779 | 8885 | 11923 | 18564 | 3790 | 19147 | 1406 | 7066 |
| | 10573 | 7108 | 3783 | 4727 | 19785 | 1458 | 16375 | 8415 | 9522 | 10729 | 6071 | 9047 |
| | 9113 | 3248 | 6378 | 1799 | 14779 | 3630 | 4294 | 7608 | 13707 | 16321 | 15368 | 12743 |

TABLE 2-continued

| SEQ ID NO: | homolog SEQ ID NOs | | | | | | | | | | |
|---|---|---|---|---|---|---|---|---|---|---|---|
| | 11299 | 2413 | 1584 | 11214 | 4012 | 2710 | 4268 | 19546 | 17625 | 6940 | 1273 | 5755 |
| | 413 | 5952 | 3098 | 15675 | 11098 | 3286 | 8068 | 2690 | 1222 | 13381 | 15257 | 4756 |
| | 4725 | 9351 | 7586 | 5770 | 10868 | 3420 | 12012 | 775 | 7742 | 8422 | 6103 | 15004 |
| | 16010 | 12445 | 13845 | 17033 | 16212 | 3842 | 19401 | 4100 | 8417 | 13255 | 1233 | 5307 |
| | 7664 | 11820 | 4960 | 4282 | 2333 | 17315 | 12161 | 4217 | 10485 | 8151 | 16203 | 1002 |
| | 11057 | 5823 | 9298 | 1567 | 411 | 5686 | 2787 | 6556 | 17045 | 5742 | 3090 | 12019 |
| | 12930 | 14231 | 15548 | 11694 | 8266 | 16248 | 1579 | 4806 | 2747 | 11349 | 6186 | 8303 |
| | 4499 | 14141 | 8094 | 16001 | 12109 | 10916 | 10761 | 2142 | 4592 | 5947 | 1880 | 5294 |
| | 16111 | 2594 | 9869 | 6575 | 13083 | 17382 | 14364 | 11324 | 2341 | 14545 | 1596 | 15428 |
| | 18963 | 1929 | 10976 | 3736 | 16709 | 5662 | 4501 | 19083 | 17865 | 14066 | 8045 | 18782 |
| | 2866 | 19741 | 12401 | 690 | 3507 | 2118 | 8721 | 10292 | 3096 | 7017 | 5861 | 9569 |
| | 15479 | 6800 | 14522 | 15996 | 3926 | 12508 | 9266 | 7508 | 3882 | 1770 | 18129 | 2452 |
| | 16753 | 7303 | 5038 | 17638 | 14421 | 11636 | 19188 | 2092 | 5721 | 781 | 700 | 15887 |
| | 8872 | 5320 | 5466 | 10259 | 7441 | 13041 | 10874 | 7249 | 4514 | 9725 | 18158 | 17609 |
| | 18140 | 18293 | 17059 | 18509 | 4888 | 9306 | 5484 | 7091 | 1826 | 19360 | 3124 | 1056 |
| | 2563 | 3177 | 16370 | 10946 | 6177 | 11856 | 17835 | 15766 | 9377 | 14858 | 9666 | 2881 |
| | 4713 | 18553 | 10081 | 3260 | 6030 | 16206 | 11892 | 10319 | 18672 | 3859 | 2663 | 15443 |
| | 5089 | 10992 | 2411 | 12439 | 17434 | 6053 | 18213 | 1552 | 16896 | 16303 | 2170 | 4062 |
| | 9729 | 5506 | 4195 | 2496 | 9435 | 18250 | 3643 | 10322 | 8871 | 11520 | 8307 | 10814 |
| | 4172 | 3616 | 467 | 2220 | 2765 | 10994 | 7181 | 9294 | 9019 | 14302 | 16474 | 5797 |
| | 4407 | 12612 | 9186 | 18928 | 4415 | 11982 | 14037 | 3959 | 1335 | 507 | 14948 | 9483 |
| | 17387 | 6806 | 8933 | 14886 | 13678 | 506 | 12462 | 6785 | 2667 | 19322 | 5005 | 14242 |
| | 11045 | 12403 | 2390 | 19573 | 11726 | 9949 | 5099 | 9853 | 16159 | 15920 | 13256 | 615 |
| | 3439 | 10834 | 8240 | 12330 | 19303 | 17872 | 12750 | 7494 | 2539 | 12602 | 5373 | 16910 |
| | 3341 | 11873 | 10613 | 7321 | 18101 | 12158 | 14798 | 8096 | 5837 | 1986 | 13521 | 5384 |
| | 7186 | 4164 | 12183 | 5907 | 11172 | 15553 | 726 | 4059 | 6816 | 6374 | 16761 | 7732 |
| | 6913 | 1868 | 15780 | 18634 | 16779 | 6640 | 3707 | 4959 | 10722 | 8632 | 18898 | |
| 249: | 8837 | 9354 | 459 | 481 | 15638 | 15637 | 10951 | 1014 | 1011 | 10934 | 460 | 456 |
| | 1750 | 19841 | 3504 | 7770 | 7490 | 2370 | 12273 | 8627 | 10651 | 13584 | 13749 | 13618 |
| | 14339 | 12485 | 7233 | 18749 | 12207 | 7057 | 408 | 14300 | 5215 | 19033 | 14163 | 1226 |
| | 1228 | 5775 | 5424 | 8505 | 18275 | 18314 | 10203 | 8674 | 11707 | 15070 | 19005 | 8386 |
| | 2693 | 9051 | 4549 | 8477 | 13649 | 15215 | 13783 | 10149 | 13027 | 13294 | 15862 | 674 |
| | 9926 | 18724 | 12578 | 8169 | 1419 | 6285 | 15077 | 2147 | 14574 | 6516 | 1177 | 13510 |
| | 9181 | 2520 | 4618 | 7286 | 7290 | 7135 | 6455 | 7288 | 9787 | 11002 | 551 | 2679 |
| | 8942 | 1701 | 8928 | 8930 | 1097 | 17269 | 12778 | 15439 | 17593 | 12347 | 1453 | 10948 |
| | 15909 | 19108 | 8061 | 16885 | 8964 | 5642 | 15311 | 18841 | 8881 | 9067 | 2902 | 10703 |
| | 8544 | 18226 | 18698 | 18197 | 7766 | 17357 | 6778 | 13002 | 10083 | 15189 | 7944 | 1067 |
| | 13701 | 18247 | 5067 | 8858 | 2375 | 10780 | 12562 | 6618 | 1888 | 368 | 13569 | 16443 |
| | 14088 | 17735 | 6201 | 1162 | 9317 | 18221 | 17786 | 9563 | 9562 | 2386 | 3903 | 5156 |
| | 18001 | 547 | 12480 | 13049 | 2495 | 8339 | 18977 | 12208 | 19466 | 10488 | 15681 | 11974 |
| | 4385 | 19012 | 8291 | 16077 | 16024 | 5878 | 19014 | 8302 | 17408 | 16026 | 16018 | 16022 |
| | 4841 | 9829 | 9828 | 17831 | 4690 | 2646 | 9830 | 13874 | 14131 | 9842 | 9827 | 9849 |
| | 8403 | 9844 | 9847 | 9865 | 9851 | 8406 | 8404 | 6995 | 7012 | 8405 | 4019 | 10234 |
| | 7448 | 17662 | 1677 | 19490 | 2475 | 6216 | 13658 | 5135 | 4005 | 982 | 15959 | 17990 |
| | 3508 | 17774 | 17778 | 15478 | 7855 | 9687 | 17808 | 10782 | 7592 | 268 | 18627 | 12803 |
| | 17776 | 12927 | | | | | | | | | | |
| 250: | 12939 | 8147 | 18538 | 6832 | 13653 | 16376 | 2940 | 8025 | 9554 | 5556 | 503 | 12303 |
| | 11973 | 12551 | 9852 | 1030 | 10923 | 12346 | 1435 | 1437 | 2658 | 15612 | 16349 | 9028 |
| | 13226 | 19568 | 6589 | 11472 | 4670 | 17175 | 1302 | 15214 | 13545 | 992 | 5103 | 19327 |
| | 18189 | 7434 | 13340 | 9873 | 7090 | 16545 | 6970 | 15069 | 19166 | 16647 | | |
| 251: | 6603 | 10030 | 13559 | 6740 | 11390 | 7765 | 3614 | 11615 | 15027 | 11616 | 14213 | 11329 |
| | 19168 | 2567 | 13201 | 10961 | 3308 | 11492 | 2325 | 6423 | 11527 | 3741 | 11560 | 8630 |
| | 7463 | 1786 | 14408 | 10585 | 15696 | 14167 | | | | | | |
| 252: | 17378 | 17392 | 17375 | 19787 | 819 | 9037 | 18778 | 15271 | 2631 | 2615 | 2616 | 2606 |
| | 15288 | 2607 | 15269 | 15283 | 15286 | 15282 | 15287 | 15285 | 2609 | 2629 | 2613 | 2604 |
| | 1472 | 3730 | 6707 | 4595 | | | | | | | | |
| 253: | 16186 | 14031 | 2169 | 19019 | 14212 | 16029 | 16170 | 16973 | 2492 | 10956 | 13426 | |
| 254: | 9072 | 16169 | 1130 | 12933 | 1592 | 17856 | 19381 | 14964 | 19031 | 3682 | | |
| 255: | 15936 | 5121 | 14535 | 14860 | 1527 | 1041 | 997 | 4031 | 18021 | 12960 | 12659 | 6385 |
| | 17513 | 15910 | 6705 | 15441 | 15200 | 3272 | 16975 | 18974 | 12341 | 5796 | | |
| 256: | 15904 | 2266 | 1296 | 6085 | 10365 | 4818 | 7630 | 6936 | 18652 | 4715 | 9134 | 15714 |
| | 2506 | 5391 | 14801 | 12410 | 18804 | 2831 | 19264 | 7856 | 15547 | 14814 | 17301 | 17179 |
| | 18891 | 11410 | 1475 | 11170 | 7067 | 17441 | 12196 | | | | | |
| 257: | 1879 | 1595 | 12797 | 7459 | 8363 | 12502 | 12756 | 5854 | 465 | 1425 | 1893 | 12362 |
| | 12596 | 7644 | 16328 | 15689 | 4599 | 17970 | 5443 | 17245 | 10708 | 17790 | | |
| 258: | 3828 | 1761 | 11325 | 17218 | 18307 | 14003 | 12997 | 4456 | 6236 | 19270 | 8499 | 7402 |
| | 5087 | 10067 | 3938 | 3953 | 3939 | 17913 | 19475 | 5664 | 3918 | 12870 | 8678 | 9700 |
| 259: | 12266 | 4307 | 12661 | 6842 | 6841 | 6413 | 17238 | 16962 | 15778 | 516 | 7796 | 7046 |
| | 7155 | 8841 | 7260 | 9891 | 13142 | 2868 | 8814 | 9110 | 9530 | 14169 | 17860 | 3971 |
| | 6657 | 13557 | 14715 | 9995 | 14954 | 9514 | 14428 | 5521 | 11000 | 8008 | 6231 | 6796 |
| | 6894 | 12969 | 15894 | 13220 | 469 | 19780 | 17022 | 2260 | 17210 | 1668 | 1624 | 17554 |
| | 9991 | 2888 | 10752 | 8717 | 1792 | 7940 | 17358 | 7238 | 580 | 582 | 583 | 2828 |
| | 4970 | 4995 | 18273 | 1838 | 4998 | 4967 | 8488 | 14536 | 1477 | 13690 | 10891 | 14229 |
| | 7730 | 15048 | 9774 | 18163 | 9481 | 10644 | 2992 | 6652 | 4943 | 7469 | 6637 | 19611 |
| | 6346 | 6577 | 5487 | 15216 | 8436 | 7531 | 19737 | 9498 | 7963 | 8585 | 17924 | 10815 |
| | 10055 | 9630 | 14139 | 8171 | 9921 | 12928 | 12473 | 13070 | 793 | 5190 | 2500 | 9328 |
| | 1480 | 13432 | 15272 | 14189 | 13728 | | | | | | | |

TABLE 2-continued

| SEQ ID NO: | homolog SEQ ID NOs | | | | | | | | | | |
|---|---|---|---|---|---|---|---|---|---|---|---|
| 260: | 14746 | 16460 | 18053 | 7754 | 9978 | 16450 | 18050 | 18466 | 8866 | 10337 | 10391 | 8245 |
| | 1604 | 8568 | 8843 | 13606 | 19627 | 18283 | 15825 | 15808 | 15611 | 13871 | 2627 | 2601 |
| | 19077 | 1485 | 5898 | 5916 | 8835 | 2570 | 9910 | 10297 | 3025 | 18486 | 8908 | 14474 |
| | 11654 | 2349 | 10867 | 14488 | 9940 | 13901 | 7336 | 11511 | 19746 | 14836 | 1906 | 13400 |
| | 19527 | 5568 | 4351 | 18319 | 6689 | 10519 | 15977 | 15760 | 7605 | 16652 | 14204 | 14665 |
| | 2776 | 9225 | 1972 | 12804 | 727 | 14258 | 18708 | 1882 | 6435 | 11108 | 8324 | 18239 |
| | 3913 | 10328 | 4357 | 12240 | 6728 | 18983 | 18808 | 5969 | 9555 | 13551 | 18458 | 4622 |
| | 13553 | 10797 | 1818 | 14064 | 18410 | 6283 | 10854 | 2771 | 9475 | 10873 | 15912 | 15530 |
| | 8946 | 16216 | 7038 | 957 | 13243 | 13853 | 11908 | 12331 | 10718 | 11237 | 5623 | 10262 |
| | 12248 | 6541 | 17142 | 7053 | 14011 | 4480 | 2822 | 17981 | 7795 | 6691 | 3561 | 1473 |
| | 17141 | 4545 | 13347 | 1348 | 11256 | 6511 | 11356 | 8651 | 13955 | 6699 | 6555 | 16166 |
| | 6559 | 3185 | 17894 | 9307 | 6011 | 10635 | 1391 | 13177 | 702 | 16458 | 18740 | 16787 |
| | 4175 | 10950 | 3412 | 4193 | 951 | 13870 | 19183 | 18644 | 947 | 18835 | 6184 | 13111 |
| | 3667 | 10338 | 4125 | 14782 | 18479 | 18004 | 19084 | 12471 | 16645 | 866 | 1895 | 10049 |
| | 11122 | 12521 | 7132 | 14534 | 2660 | 12759 | 18429 | 17611 | 15615 | 12704 | 1525 | 9347 |
| | 7492 | 3451 | 18373 | 17125 | 5972 | 9777 | 16039 | 12350 | 4073 | 8962 | 17221 | 1961 |
| | 1958 | 11156 | 12899 | 18769 | 11606 | 3225 | 3930 | 12985 | 3908 | 7429 | 18285 | 10977 |
| | 15040 | 16234 | 17004 | 17293 | 13355 | 15499 | 2062 | 11463 | 11416 | 11708 | 6710 | 4422 |
| | 5817 | 13502 | 14378 | 14379 | 13504 | 1451 | 19815 | 12842 | 4405 | 10999 | 9565 | 11330 |
| | 5263 | 7189 | 6160 | 2372 | 3858 | 1248 | 6567 | 14455 | 1766 | 14550 | 2516 | 1656 |
| | 14989 | 16864 | 9312 | 19300 | 19408 | 13516 | 2556 | 2969 | 1952 | 2541 | 11207 | 10625 |
| | 19674 | 9198 | 10334 | 18065 | 3495 | 8519 | 12201 | 3921 | 13249 | 18592 | 857 | 17545 |
| | 11757 | 15455 | 2164 | 789 | 4350 | 3117 | 14133 | 12220 | 7087 | 11452 | 6125 | 4977 |
| 261: | 6807 | 480 | 6337 | 12236 | 4678 | 12917 | 9439 | 9382 | 11513 | 11500 | 16670 | 16646 |
| | 16691 | 16660 | 11516 | 11515 | 11496 | 11498 | 16668 | 16683 | 16686 | 16664 | 11519 | 16659 |
| | 16643 | 14322 | 2737 | 1932 | 12955 | 12317 | 19334 | 12435 | 12976 | 5809 | 18730 | 11183 |
| | 705 | 12278 | 16937 | 13026 | 12999 | 1928 | 15878 | 8321 | 12130 | 11053 | 9846 | 17306 |
| | 15324 | 10531 | 11328 | 12167 | 19474 | 12203 | 2827 | 878 | 9720 | 4228 | 5762 | 4288 |
| | 13228 | 10010 | 14908 | 1017 | 679 | 14784 | 677 | 1487 | 10919 | 18296 | 10669 | 11200 |
| | 9055 | 18733 | 17838 | 16389 | 728 | 715 | 1375 | 1396 | 6901 | 3743 | 12599 | |
| 262: | 11852 | 1409 | 16572 | 9074 | 6600 | 4427 | 824 | 15705 | 6709 | 10791 | 14587 | 9823 |
| | 18325 | 515 | 12450 | 18527 | 604 | 6043 | 12455 | 2071 | 10310 | 18162 | 3176 | 2577 |
| | 15203 | 12952 | 14467 | 6645 | 6698 | 12807 | 6113 | 4709 | 8824 | 6274 | 8311 | 3411 |
| | 18810 | 17940 | 19805 | 17162 | 665 | 12693 | 1309 | 15412 | 18084 | 5235 | 8314 | 13722 |
| | 15858 | 15969 | 18135 | 2305 | 13611 | 4030 | 14864 | 5363 | 4470 | 8271 | 5178 | 12458 |
| 263: | 8837 | 481 | 15637 | 10951 | 10934 | 19841 | 460 | 3504 | 15638 | 1014 | 1011 | 459 |
| | 1750 | 456 | 12273 | 4264 | 8627 | 13584 | 13749 | 19375 | 12485 | 18749 | 7057 | 408 |
| | 7233 | 12207 | 13068 | 5215 | 5515 | 14163 | 8781 | 1228 | 1226 | 5775 | 5424 | 8505 |
| | 18275 | 18314 | 10203 | 8674 | 2693 | 19005 | 14053 | 9051 | 8386 | 8477 | 4549 | 6597 |
| | 15215 | 10149 | 13783 | 1372 | 1370 | 13027 | 13294 | 4287 | 12578 | 1419 | 15077 | 2147 |
| | 2905 | 14574 | 17504 | 6516 | 6455 | 9181 | 2520 | 7135 | 7288 | 7290 | 2679 | 4618 |
| | 7286 | 551 | 9787 | 11002 | 1701 | 8942 | 8928 | 8930 | 1097 | 17269 | 12778 | 13750 |
| | 18947 | 15439 | 17593 | 1453 | 19108 | 8061 | 17556 | 5642 | 16885 | 8964 | 10019 | 2902 |
| | 1548 | 5257 | 1728 | 7766 | 17357 | 5647 | 10631 | 1888 | 18777 | 18221 | 17786 | |
| | 9562 | 9563 | 5156 | 2386 | 3903 | 18001 | 547 | 12480 | 13049 | 8197 | 2495 | 8339 |
| | 19466 | 12208 | 18977 | 11974 | 4385 | 19014 | 8302 | 19012 | 17408 | 8291 | 16077 | 5878 |
| | 16024 | 16026 | 16016 | 16018 | 16022 | 4841 | 9828 | 9829 | 9830 | 9827 | 14131 | 13874 |
| | 9849 | 9847 | 4690 | 2646 | 9842 | 17831 | 8403 | 9851 | 9865 | 8405 | 8404 | 6995 |
| | 9844 | 7012 | 4019 | 15785 | 10234 | 7448 | 17896 | 1513 | 13878 | 7287 | | |
| 264: | 10139 | 8837 | 1318 | 481 | 15637 | 10951 | 10934 | 19841 | 460 | 3504 | 15638 | 1014 |
| | 1011 | 459 | 456 | 1750 | 17473 | 5931 | 11424 | 7490 | 1243 | 2370 | 12273 | 4264 |
| | 8627 | 13584 | 13749 | 14339 | 12485 | 18749 | 7233 | 12207 | 408 | 7057 | 19033 | 6702 |
| | 13068 | 5215 | 5515 | 14163 | 8781 | 5775 | 1228 | 5424 | 1226 | 8505 | 8674 | 18275 |
| | 18314 | 10203 | 11707 | 15070 | 2693 | 15215 | 13884 | 10149 | 13783 | 13027 | 13294 | 15807 |
| | 4287 | 9926 | 12578 | 2905 | 17504 | 6516 | 7290 | 9181 | 6455 | 7135 | 2679 | 2520 |
| | 7286 | 4618 | 551 | 7288 | 9787 | 11002 | 1701 | 8928 | 8930 | 8942 | 1097 | 17269 |
| | 15267 | 13750 | 18947 | 15439 | 17593 | 9816 | 11871 | 13684 | 1453 | 19108 | 8061 | 5642 |
| | 10443 | 12994 | 4925 | 6825 | 16676 | 7766 | 13011 | 12993 | 13010 | 17357 | 9582 | 4071 |
| | 15183 | 1888 | 11394 | 1145 | 18221 | 17786 | 9563 | 9562 | 18001 | 3903 | 2495 | 17171 |
| | 19146 | 18977 | 12208 | 8339 | 19466 | 10488 | 15681 | 4385 | 17408 | 19012 | 8291 | 5878 |
| | 16077 | 19014 | 8302 | 16018 | 16024 | 16026 | 16022 | 4841 | 16828 | 9842 | 9830 | 9828 |
| | 8403 | 4690 | 2646 | 9827 | 9829 | 13874 | 14131 | 17831 | 9847 | 9849 | 9844 | 9851 |
| | 8405 | 9865 | 8404 | 6995 | 7012 | 4019 | 7448 | 538 | 4587 | 4576 | 14863 | 2709 |
| | 10770 | | | | | | | | | | | |
| 265: | 10339 | 11051 | 4273 | 6693 | 11042 | 16475 | 7274 | 1052 | 18146 | 6194 | 6195 | 18166 |
| | 10865 | 4396 | 638 | 10021 | 15834 | 6518 | | | | | | |
| 266: | 12371 | 1790 | 10658 | 8747 | 10474 | 4583 | | | | | | |
| 267: | 19068 | 13736 | 19730 | 2398 | 4156 | 8189 | 14176 | 3642 | 16457 | 13680 | 12542 | |
| 268: | 16601 | 2370 | 12273 | 10651 | 18749 | 7233 | 7057 | 12207 | 408 | 14163 | 1226 | 1228 |
| | 5775 | 5424 | 8505 | 18314 | 10203 | 18275 | 8674 | 11707 | 14053 | 19005 | 8477 | 8386 |
| | 7370 | 6597 | 2693 | 9051 | 4549 | 13649 | 15215 | 10149 | 13027 | 9926 | 8169 | 1419 |
| | 6285 | 2147 | 15077 | 2905 | 17504 | 13510 | 7290 | 7286 | 7135 | 7288 | 2520 | 6455 |
| | 9181 | 9787 | 2679 | 4618 | 551 | 11002 | 1701 | 8930 | 8942 | 8928 | 1097 | 12778 |
| | 13750 | 15439 | 18947 | 17593 | 13684 | 19108 | 8061 | 16885 | 5642 | 8964 | 8881 | 18841 |
| | 15311 | 10703 | 8544 | 18226 | 18698 | 7766 | 13011 | 12993 | 17357 | 6778 | 15189 | 13002 |
| | 10083 | 1067 | 7944 | 13701 | 18247 | 8858 | 2375 | 10780 | 12562 | 6618 | 1888 | 13569 |
| | 368 | 16443 | 17735 | 14088 | 6201 | 18221 | 17786 | 9563 | 9562 | 5156 | 3903 | 2386 |
| | 547 | 12480 | 18001 | 13049 | 8197 | 2495 | 8339 | 12208 | 19466 | 18977 | 10488 | 11974 |

TABLE 2-continued

| SEQ ID NO: | homolog SEQ ID NOs | | | | | | | | | | |
|---|---|---|---|---|---|---|---|---|---|---|---|
| | 4385 | 8302 | 19014 | 8291 | 16077 | 19012 | 16024 | 5878 | 16026 | 17408 | 16018 | 16022 |
| | 16016 | 4841 | 4690 | 2646 | 17831 | 9830 | 9842 | 9828 | 9829 | 13874 | 14131 | 9849 |
| | 7012 | 9847 | 9827 | 8403 | 9851 | 9865 | 8405 | 9844 | 8406 | 4019 | 10234 | 7448 |
| | 538 | 12803 | 17808 | 10782 | 7592 | 17774 | 7855 | 9687 | 15478 | 3508 | 2475 | 17776 |
| | 12927 | 17662 | 982 | 4005 | 17990 | 6216 | 13658 | | | | | |
| 269: | 14096 | 14101 | 3422 | 9935 | 9907 | 11404 | 3149 | 1688 | 10616 | 10023 | 13889 | 4400 |
| | 13959 | 6604 | 8205 | 13382 | 8564 | 13019 | 14460 | 15364 | 2532 | 8729 | 14099 | 19644 |
| | 19650 | 19653 | 11186 | 19315 | 2228 | 13473 | 8252 | 19754 | 7420 | 12978 | 18550 | 13931 |
| | 11080 | 8842 | 17395 | 1271 | 18960 | 9745 | 4617 | 1713 | 12914 | 5411 | 11902 | 15306 |
| | 3958 | 14094 | 14091 | 14074 | 7042 | 19574 | 7859 | 17118 | 9165 | 9458 | 1459 | 14832 |
| | 13165 | 14520 | 10512 | 17335 | 15352 | 14170 | 13097 | 5335 | 9461 | 13601 | 12995 | 8362 |
| | 2662 | 13567 | 14785 | 3435 | 11646 | 11805 | 18390 | 4017 | 8969 | 6711 | 4962 | 8794 |
| | 9291 | 7926 | 18526 | 14047 | 14393 | 7407 | 3866 | 5766 | 11775 | 19021 | 15525 | 1840 |
| | 13661 | 14072 | 18260 | | | | | | | | | |
| 270: | 16324 | 10027 | 16399 | 19626 | 19600 | 18167 | 7908 | 9950 | 15476 | 16909 | 13757 | 17032 |
| | 10125 | 16306 | 5372 | 19301 | 1764 | 9641 | 11812 | 14642 | 18106 | 18647 | 13221 | 9050 |
| | 13225 | 2608 | 858 | 9561 | 5437 | 14594 | 5439 | 6002 | 12210 | 12290 | 5485 | 6003 |
| | 13981 | 16840 | 17398 | 15782 | 13385 | 4464 | 894 | 19838 | 9505 | 11810 | 18088 | 18145 |
| | 16187 | 1329 | 14353 | 14351 | 14349 | 10819 | 8846 | 9429 | 16618 | 17714 | 16634 | 13050 |
| | 10112 | 19589 | 3140 | 14486 | 3444 | 16943 | 12766 | 19496 | 9070 | | | |
| 271: | 2051 | 2869 | 19263 | 12625 | 10041 | 11778 | 3745 | 15945 | 19372 | 16735 | 5498 | 12285 |
| | 7206 | 9395 | 16559 | 5318 | 10659 | 1955 | 8048 | 19028 | 5197 | 13490 | 4306 | 15568 |
| | 14829 | 8639 | | | | | | | | | | |
| 272: | 16396 | 2024 | 2104 | 12134 | 16012 | 12790 | 10384 | 16093 | 7594 | 16424 | 3265 | 5193 |
| | 1401 | 2076 | 7270 | 19843 | 9331 | 4976 | 4079 | 18320 | 7860 | 6861 | 14631 | 5218 |
| | 2559 | 6330 | 4039 | 736 | 7978 | 11712 | 7058 | 13306 | 9913 | 17623 | 5261 | 3627 |
| | 1734 | 12108 | 18532 | 10878 | 3240 | 10925 | 8343 | 13484 | 10007 | 17652 | 6295 | 15677 |
| | 4058 | 5272 | | | | | | | | | | |
| 273: | 12662 | 15327 | 19093 | 953 | 5512 | 10971 | 2513 | 18064 | 17932 | 1221 | 19584 | 4462 |
| | 3536 | 19638 | 12776 | 5617 | 18924 | 7810 | 19428 | 13350 | 11809 | 13768 | 18047 | 11036 |
| | 10750 | 3825 | 17782 | 18804 | 2831 | 18060 | 18535 | 9083 | 17800 | 9822 | 14551 | 11830 |
| | 6598 | 8161 | 6081 | 5049 | 6923 | 6951 | 12249 | | | | | |
| 274: | 4873 | 8617 | 18355 | 6309 | 6356 | 19579 | 11946 | 18342 | 7376 | 17347 | 13047 | 4927 |
| | 14649 | 12482 | 15068 | 14383 | 10603 | 3075 | 5557 | 16054 | 5542 | 5206 | 17331 | 19720 |
| | 11637 | 5366 | 16537 | 14444 | 11823 | 2345 | 18756 | 7228 | 11287 | 3136 | 3972 | 2054 |
| | 13176 | 4279 | 12726 | 19609 | 19002 | 3887 | 18393 | 12190 | 2873 | 4093 | 15745 | 19571 |
| | 15950 | 5128 | | | | | | | | | | |
| 275: | 3391 | 5673 | 17748 | 12970 | 2049 | 2756 | 10716 | 780 | 5570 | 15625 | 17600 | 2057 |
| | 17079 | 14041 | 6494 | 10663 | 7787 | 10440 | 10550 | 12319 | 2852 | 13899 | 6288 | 6170 |
| | 14404 | 7408 | 2857 | 4218 | 2808 | 18604 | 6362 | 17551 | 11818 | 511 | 5580 | 16146 |
| | 1803 | 12576 | 13505 | 7130 | 9614 | 2287 | 6383 | 500 | 13389 | 19443 | 13855 | 8834 |
| | 1779 | 5989 | 19035 | 7368 | 11731 | 19702 | 17630 | 783 | 15741 | 15774 | 15442 | 17674 |
| | 2205 | 5474 | 2153 | 18915 | 13290 | 9728 | 17044 | 8267 | 18171 | 1334 | 15222 | 15195 |
| | 7733 | 5047 | 8922 | 18281 | 12929 | 8992 | 5696 | 12619 | 2026 | 6208 | 13543 | |
| | 17275 | 13703 | 15244 | 18936 | 16496 | 17942 | 12986 | 13118 | 16224 | 18419 | 10277 | 4864 |
| | 9332 | 2640 | 16067 | 11844 | 6736 | 15403 | 4550 | 3500 | 4202 | | | |
| 276: | 9040 | 9153 | 13748 | 18710 | 9288 | 19447 | 1096 | 7103 | 8455 | 3624 | 18607 | 16311 |
| | 18304 | 14306 | 9854 | 17310 | 16393 | 9187 | 17043 | 17574 | 17689 | 8273 | 13937 | 14386 |
| | 4911 | 19063 | 18212 | 18817 | 18819 | 3310 | 3329 | 18815 | 3312 | 18959 | 8476 | 1386 |
| | 2263 | 8742 | 15253 | 7396 | 3159 | 5367 | 18632 | 11510 | 4953 | 18618 | 495 | 19426 |
| | 10261 | 849 | 13607 | 1099 | 15505 | 16314 | 14154 | 11065 | 14523 | 19079 | 3856 | |
| 277: | 6298 | 11547 | 9455 | 3560 | 3298 | 1224 | 6573 | 17886 | 3688 | 17535 | 6514 | 11001 |
| | 16832 | | | | | | | | | | | |
| 278: | 9342 | 1148 | 8880 | 13995 | 9598 | 18620 | 16354 | 596 | 3713 | 12096 | 7035 | 13429 |
| | 19465 | 13583 | 8623 | 4778 | 4775 | 4758 | 6813 | 14722 | 2970 | 16245 | 18993 | 16658 |
| | 3106 | 6966 | 18030 | 8468 | 3622 | 3111 | 5706 | 1317 | 7832 | 18473 | 17421 | 13587 |
| | 13609 | 3484 | 2614 | 11857 | 11213 | 7994 | 14581 | 14105 | 8667 | 8513 | 779 | 14862 |
| | 6228 | 14830 | 2526 | 13752 | 2961 | 4199 | 676 | 14238 | 15588 | 17472 | 5776 | 1150 |
| | 15882 | 3232 | 11072 | 7812 | 12851 | 3715 | 13664 | 13123 | 9048 | 17974 | 449 | 2155 |
| | 3081 | 9548 | 12652 | 8280 | 15483 | 16721 | 8031 | 13645 | 18580 | 7580 | 3619 | 3479 |
| | 6971 | 18732 | 15594 | 9508 | 10074 | 14377 | 14469 | 1702 | 11710 | 13599 | 19866 | 8968 |
| | 12053 | 12047 | 4245 | 4259 | | | | | | | | |
| 279: | 19107 | 3731 | 10544 | 1365 | 18558 | 3521 | 315 | 15072 | 9222 | 995 | 13810 | 10579 |
| | 12184 | 1169 | 10820 | 8682 | 17063 | 17115 | 11426 | 7610 | 8335 | 6680 | 19590 | 669 |
| | 12808 | 2095 | 3210 | 7981 | 8975 | 13797 | 19673 | 10108 | 12140 | 14891 | 4849 | 9589 |
| | 10013 | 11489 | 5848 | 8508 | 16961 | 14635 | 3335 | 5341 | 9626 | 18112 | 14644 | 12785 |
| | 9168 | 9484 | 8109 | 9837 | 3294 | 15636 | 3494 | 2017 | 19052 | 19769 | 16972 | 7811 |
| | 19903 | 14579 | 7377 | 4121 | 7557 | 13806 | 6626 | 9547 | 10641 | 12326 | 19729 | 7235 |
| | 1411 | 3644 | 10157 | 10154 | 2648 | 7794 | 10100 | 12628 | 15633 | 12168 | 7589 | 15853 |
| | 19745 | 14933 | 10255 | 1291 | 17736 | 2414 | 7188 | 16138 | 9089 | 9415 | 11728 | 12818 |
| | 6609 | 8114 | 10065 | 12609 | 4638 | 16498 | 2517 | 12709 | 17410 | 15136 | 17048 | 16713 |
| | 18469 | 19832 | 12689 | 1479 | 15584 | 12811 | 17562 | 13267 | 13892 | 10949 | 9327 | 472 |
| | 5713 | 11273 | 9716 | 15698 | 5082 | 17282 | 1612 | 7565 | 10794 | 11434 | 8216 | 10240 |
| | 6588 | 15316 | 15700 | 6461 | 7231 | 10826 | 9945 | 1966 | 767 | 9017 | 8428 | 9216 |
| | 1791 | 12429 | 5223 | 4910 | 19009 | 13274 | 12648 | 16308 | 4798 | 9611 | 5747 | 13303 |
| | 2839 | 10405 | 4049 | 4046 | 969 | 5871 | 13542 | 17764 | 7597 | 9272 | 18722 | 14315 |
| | 13433 | 12396 | 17102 | 19120 | 3267 | 2911 | 2934 | 2480 | 15593 | 1566 | 15118 | 17099 |
| | 13495 | 18798 | 16391 | 13630 | 12936 | 4072 | 17390 | 11981 | 14556 | 12247 | 14559 | 12268 |

TABLE 2-continued

| SEQ ID NO: | homolog SEQ ID NOs | | | | | | | | | | |
|---|---|---|---|---|---|---|---|---|---|---|---|
| | 14560 | 14577 | 14558 | 12267 | 14576 | 12226 | 9387 | 332 | 2109 | 7841 | 18828 | 9615 |
| | 11137 | 19936 | 14986 | 3553 | 9388 | 17887 | 11929 | 4554 | 18866 | 5440 | 3007 | 845 |
| | 18184 | 4097 | 2805 | 16099 | 12066 | 16033 | 3934 | 3003 | 1594 | 10929 | 12343 | 16214 |
| | 17420 | 5606 | 4643 | 10415 | 14917 | 6601 | 15702 | 10449 | 19711 | 13552 | 1507 | 19835 |
| | 1698 | 9321 | 11696 | 2863 | 14802 | 17698 | 1498 | 17572 | 14405 | 13598 | 12043 | 2262 |
| | 567 | 1583 | 2618 | 3734 | 18793 | 19614 | 14449 | 16036 | 8175 | 4878 | 19636 | 13279 |
| | 17286 | 5486 | 17542 | 9087 | 15980 | 2290 | 11904 | 428 | 10747 | 9550 | 13537 | 3804 |
| | 8971 | 5843 | 3250 | 1514 | 18175 | 14056 | 11021 | 12535 | 9436 | 8113 | 10697 | 15175 |
| | 13365 | 7725 | 5679 | 15598 | 19442 | 16718 | 6306 | 9803 | 17134 | 10762 | 2355 | 13282 |
| | 9344 | 18414 | 962 | 10707 | 13732 | 15247 | 16140 | 14944 | 8665 | 3901 | 12556 | 13238 |
| | 3850 | 16213 | 15720 | 5407 | 7133 | 17222 | 15571 | 4342 | 952 | 16118 | 708 | 14879 |
| | 19403 | 2997 | 14894 | 498 | 14617 | 11730 | 18476 | 3794 | 6451 | 3609 | 16585 | 3917 |
| | 3066 | 16371 | 13698 | 6380 | 5627 | 5614 | 3881 | 18493 | 6416 | 12573 | 15178 | 11348 |
| | 7043 | 8200 | 17880 | 11947 | 15915 | 7621 | 7041 | 8209 | 18926 | 10681 | 14294 | 3702 |
| | 8567 | 18263 | 9236 | 1978 | 3932 | 19800 | 9976 | 13414 | 8046 | 11624 | 1429 | 3768 |
| | 17319 | 17779 | 7609 | 16512 | 3551 | 630 | 3171 | 7227 | 9996 | 16499 | 5172 | 8855 |
| | 13654 | 9117 | 3812 | 16292 | 19434 | 10320 | 1982 | 3126 | 14582 | 9645 | 1807 | 19478 |
| | 7519 | 12941 | 17861 | 14481 | 4909 | 1899 | 3459 | 1922 | 19333 | 4083 | 1541 | 12260 |
| | 11304 | 16432 | 3209 | 9163 | 2838 | 17263 | 2745 | 9173 | 17072 | 5826 | 7351 | 9534 |
| | 19739 | 19536 | 7374 | 17185 | 14542 | 17759 | 5670 | 4857 | 6297 | 13448 | 7546 | 11655 |
| | 18214 | 11988 | 3497 | 12119 | 18421 | 2238 | 9138 | 8088 | 14015 | 6428 | 10563 | 6419 |
| | 14637 | 4955 | 9470 | 1521 | 11999 | 10694 | 19034 | 314 | 18961 | 1819 | 15545 | 10660 |
| | 10122 | 1038 | 15537 | 16448 | 8891 | 10556 | 10553 | 13996 | 16085 | 16717 | 16720 | 16629 |
| | 3416 | 6712 | 18028 | 18027 | 18046 | 18045 | 18018 | 2046 | 2280 | 11438 | 7044 | 432 |
| | 10580 | 10575 | 17329 | 2438 | 2435 | 12466 | 13227 | 13331 | 3373 | 4354 | 1137 | 14182 |
| | 14180 | 17288 | 17285 | 17287 | 17309 | 18279 | 17281 | 5134 | 13133 | 13134 | 7591 | 7579 |
| | 7578 | 7590 | 7622 | 7593 | 7619 | 8710 | 11257 | 10155 | 17393 | 5497 | 7611 | 7613 |
| | 3368 | 3371 | 3345 | 3347 | 3346 | 11146 | 18562 | 15875 | 3327 | 11270 | 617 | 12175 |
| | 16942 | 6398 | 14919 | 6019 | 6427 | 16524 | 15844 | 4568 | 13742 | 8545 | 8646 | 17237 |
| | 10441 | 15117 | 4903 | 16684 | 7548 | 4237 | 4891 | 11339 | 18131 | 14205 | 916 | 15666 |
| | 812 | 8359 | 2239 | 6482 | 16408 | 10426 | 1946 | 16250 | 7313 | 7296 | 10169 | 13861 |
| | 16153 | 7466 | 6375 | 11598 | 1049 | 14326 | 7059 | 9757 | 6237 | 2331 | 4295 | 3739 |
| | 1600 | 4339 | 9125 | 15701 | 18725 | 10147 | 17364 | 5245 | 694 | 5869 | 7830 | 14712 |
| | 3680 | 8784 | 12459 | 4338 | 15013 | 3889 | 4760 | 2323 | 2136 | 16586 | 3470 | 11223 |
| | 13993 | 8676 | 4320 | 6154 | 958 | 7689 | 4997 | 6877 | 12357 | 17840 | 823 | 1007 |
| | 2433 | 5629 | 7080 | 8534 | 2047 | 12554 | 18572 | 15080 | 13812 | 14010 | 15955 | 19762 |
| | 16570 | 11714 | 12363 | 13476 | 19136 | 3340 | 8548 | 16230 | 13481 | 15749 | 6845 | 2819 |
| | 2803 | 2874 | 2798 | 2851 | 2774 | 2772 | 2847 | 2769 | 11161 | 2801 | 14362 | 3590 |
| | 1712 | 8501 | 2235 | 2242 | 2245 | 2243 | 18869 | 17430 | 17096 | 16063 | 16061 | 4419 |
| | 4399 | 7500 | 7499 | 7479 | 7507 | 7501 | 7478 | 2530 | 9228 | 852 | 5988 | 15329 |
| | 19925 | 15542 | 16445 | 15520 | 16918 | 16920 | 16451 | 14285 | 16922 | 15560 | 3473 | 2729 |
| | 2751 | 2748 | 2730 | 1449 | 313 | 6008 | 10997 | 19320 | 14355 | 13633 | | |
| 280: | 15402 | 17754 | 15436 | 17629 | 9518 | 8079 | 14324 | 10849 | 9618 | 16771 | 13444 | 11169 |
| | 12000 | 16733 | 11507 | 10938 | 18192 | 18292 | 19813 | 13096 | 7912 | 8166 | 14940 | 10205 |
| | 3198 | 12339 | 17093 | 6121 | 18940 | 9368 | 16294 | 13760 | 16750 | 10258 | 19864 | 717 |
| | 17453 | 996 | 3004 | 19619 | 15600 | 2042 | 7099 | 14437 | 10711 | 13380 | 19640 | 16532 |
| | 2201 | 1802 | 2309 | 6647 | 9806 | 6879 | 9457 | 8208 | 12113 | 10109 | 11945 | 9605 |
| | 12639 | 15237 | 13105 | 11307 | 15891 | 3950 | 15781 | 412 | 17950 | 8118 | 5602 | 1129 |
| | 18116 | 15989 | 10069 | 5174 | 1902 | 2069 | 8549 | 11084 | 3460 | 2119 | 3544 | 5463 |
| | 19760 | 6025 | 2277 | 7245 | 14680 | 12142 | 11315 | 10103 | 11686 | 7410 | 5674 | 18381 |
| | 3114 | 6700 | 7140 | 6390 | 1801 | 5927 | 9743 | 14343 | 16776 | 14417 | 6038 | 14869 |
| | 8795 | 12626 | 14704 | 15315 | 19906 | 16747 | 15411 | 2945 | 6780 | 4297 | 8158 | 3758 |
| | 5621 | 3569 | 4034 | 12467 | 19872 | 13169 | 1081 | 8095 | 1736 | 18688 | 9902 | 11293 |
| | 1423 | 19566 | 17541 | 1444 | 2075 | 19482 | 17202 | 17020 | 15746 | 15846 | 16117 | 2321 |
| | 9835 | 4123 | 7173 | 5998 | 4409 | 19765 | 10646 | 9885 | 10056 | 18669 | 12506 | 11744 |
| | 14243 | 2630 | 5877 | 7111 | 5671 | 1675 | 7444 | 6146 | 3023 | 3898 | 18187 |
| | 1165 | 11993 | 15839 | 10330 | 6061 | 5491 | 4227 | 3781 | 9058 | 17595 | 11079 | 11202 |
| | 7362 | 10144 | 11840 | 8333 | 13318 | 3170 | 6878 | 6916 | 16201 | 15777 | 19884 | 5750 |
| | 12644 | 18885 | 13200 | 8731 | 18368 | 8181 | 14701 | 7566 | 13576 | 7966 | 16096 | 3440 |
| | 4942 | 4573 | 2833 | 10605 | 7925 | 14032 | 3404 | 4390 | 11831 | 17429 | 15424 | 19414 |
| | 16495 | 16622 | 11298 | 10131 | 6694 | 18316 | 8214 | 4497 | 14461 | 11010 | 15850 | 4991 |
| | 15394 | 15401 | 5554 | 7553 | 7642 | 6491 | 5072 | 16712 | 18970 | 17407 | 1013 | 5799 |
| | 15429 | 13670 | 4021 | 17706 | 15034 | 10501 | 15109 | 5127 | 9817 | 12262 | 12837 | 1717 |
| | 18387 | 17051 | 1748 | 3020 | 8327 | 5847 | 16045 | 1172 | 5230 | 13057 | 10892 | 8743 |
| | 3975 | 4171 | 5329 | 579 | 17409 | 16177 | 5306 | 5472 | 11154 | 9931 | 4136 | 5374 |
| | 2437 | 15963 | 2773 | 17124 | 17810 | 18806 | 13785 | 2757 | 10243 | 16360 | 5612 | 16322 |
| | 12186 | 2514 | 18051 | 19245 | 15150 | 17624 | 1481 | 7727 | 15029 | 17521 | 3890 | 2359 |
| | 5655 | 15000 | 19595 | 10596 | 9889 | 9655 | 9987 | 11358 | 19111 | 11956 | 4272 | 6625 |
| | 9408 | 15892 | 4615 | 17792 | 13508 | 980 | 2199 | 5653 | 15516 | 15373 | 15610 | 13373 |
| | 9133 | 4362 | 10774 | 17361 | 10744 | 477 | 554 | 11553 | 14415 | 17110 | 12358 | 14292 |
| | 13332 | 11804 | 11811 | 9941 | 13978 | 11248 | 18909 | 19512 | 16233 | 3315 | 13090 | 18834 |
| | 11850 | 7862 | 19388 | 5804 | 19237 | 19460 | 4704 | 13932 | 6772 | 6661 | 6659 | 2180 |
| | 12650 | 18850 | 12384 | 12309 | 430 | 13903 | 13110 | 18218 | 9954 | 6627 | 6151 | 4388 |
| | 18332 | 16577 | 10907 | 816 | 14925 | 18100 | 1185 | 19304 | 652 | 9511 | 10006 | 6151 |
| | 12106 | 6150 | 12493 | 7145 | 15562 | 2025 | 18478 | 7025 | 7026 | 4485 | 14496 | 7121 |
| | 15494 | 13310 | 16051 | 8638 | 5236 | 11905 | 7716 | 16724 | 17428 | 13977 | 12065 | 14350 |
| | 8192 | 14225 | 12919 | 19150 | 3456 | 17883 | 4875 | 7007 | 6429 | 17497 | 12548 | 9527 |
| | 12164 | 398 | 13983 | 6190 | 3241 | 2352 | 5757 | 2425 | 19500 | 3188 | 13614 | 16480 |

TABLE 2-continued

| SEQ ID NO: | homolog SEQ ID NOs | | | | | | | | | | |
|---|---|---|---|---|---|---|---|---|---|---|---|
| | 1042 | 2584 | 18280 | 17452 | 1855 | 15112 | 8640 | 9646 | 8269 | 17863 | 2113 | 19671 |
| | 4472 | 8213 | 10111 | 7758 | 11259 | 15393 | 17215 | 10615 | 14115 | 18114 | 19469 | 2426 |
| | 8337 | 9601 | 19412 | 1557 | 13838 | 5949 | 16547 | 12016 | 6009 | 17996 | 16020 | 13608 |
| | 18118 | 4335 | 2510 | 2358 | 6156 | 10954 | 3031 | 10072 | 16042 | 9333 | 971 | 1426 |
| | 6023 | 16744 | 18147 | 18700 | 17680 | 17679 | 4200 | 2825 | 14313 | 17189 | 9300 | 3978 |
| | 3376 | 2704 | 12344 | 17083 | 7635 | 8941 | 10128 | 19694 | 13357 | 12141 | 8860 | 8119 |
| | 8265 | 15908 | 3690 | 8287 | 5054 | 16229 | 19707 | 8187 | 12767 | 8492 | 1917 | 743 |
| | 3160 | 17877 | 8353 | 12737 | 8570 | 6610 | 16241 | 17568 | 17643 | 18099 | 7570 | 6986 |
| | 13046 | 14790 | 11141 | 18103 | 19929 | 4945 | 4863 | 7823 | 1957 | 13295 | 8615 | 7666 |
| | 19503 | 18182 | 17400 | 18683 | 13167 | 474 | 4854 | 8015 | 15919 | 17049 | 6539 | 8967 |
| | 18743 | 18229 | 1022 | 7970 | 16839 | 19367 | 17290 | 18980 | 13370 | 3941 | 6507 | 16184 |
| | 8973 | 2098 | 2078 | 3254 | 17794 | 10311 | 17483 | 2883 | 18643 | 13517 | 3729 | 1887 |
| | 1368 | 14447 | 2804 | 10407 | 12834 | 17444 | 18805 | 15242 | 15905 | 18413 | 11332 | 15147 |
| | 5790 | 12206 | 12866 | 11142 | 2298 | 19828 | 19319 | 18179 | 10150 | 5563 | 17462 | 11283 |
| | 10674 | 17994 | 7653 | 11921 | 8670 | 18362 | 11531 | 10803 | 14348 | 18130 | 4425 | 7792 |
| | 3742 | 4069 | 13020 | 8929 | 12909 | 5891 | 3491 | 11742 | 10960 | 1707 | 7447 | 11965 |
| | 14102 | 16993 | 19751 | 4688 | 6075 | 5409 | 928 | 14103 | 17862 | 5849 | 11486 | 3424 |
| | 13098 | 6417 | 1263 | 14274 | 3937 | 4584 | 19652 | 3860 | 4922 | 7959 | 16775 | |
| 281: | 8694 | 12679 | 18529 | 10066 | 2678 | 7179 | 6485 | 2766 | 9063 | 12300 | 13395 | 10238 |
| | 7333 | 12286 | 11528 | 7686 | 10627 | 19423 | 16297 | 3477 | 14307 | 14332 | 4683 | 6386 |
| | 14764 | 18946 | 11842 | 6708 | 4206 | 7511 | 14161 | 4948 | 18236 | 16555 | 19706 | 16935 |
| | 9276 | 1705 | 8251 | 17729 | 14148 | 10222 | 1114 | 14562 | 7443 | 7171 | 12646 | 525 |
| | 3814 | 3651 | 11471 | 13348 | 17253 | 3355 | 5958 | 18560 | 9986 | 5060 | 4869 | 4769 |
| | 4656 | 9642 | 648 | 1410 | 2931 | 18886 | 8791 | 11423 | 16482 | 11075 | 17009 | 10151 |
| | 4552 | 4158 | 14670 | 5141 | 19526 | 19457 | 6070 | 18446 | 10680 | 4669 | 10087 | 10957 |
| | 4753 | 6048 | 16338 | 807 | 6752 | 7620 | 2892 | 903 | 10046 | 10520 | 10397 | 14613 |
| | 1203 | 19013 | 13180 | 13847 | 9021 | 8726 | 11936 | 9469 | 19630 | 17914 | 1539 | 16852 |
| | 2684 | 10230 | 15144 | 7414 | 15169 | 16341 | 18719 | 4705 | 14987 | 1054 | 1301 | 8183 |
| | 10260 | 12916 | 14291 | 9101 | 5800 | 9224 | 19194 | 2786 | 14896 | 17070 | 13453 | 10805 |
| | 8590 | 1236 | 3657 | 17563 | 5588 | 19064 | 6364 | 15198 | 2518 | 14895 | 12534 | 11548 |
| | 11147 | 5143 | 4729 | 18858 | 19784 | 5715 | 6997 | 19753 | 10859 | 13393 | 5535 | 514 |
| | 6792 | 15326 | 7576 | 4957 | 14042 | 1374 | 8856 | 9698 | 10313 | 12942 | 14998 | 18662 |
| | 4919 | 12571 | 16319 | 920 | 17169 | 6335 | 5044 | 6370 | 18927 | 5610 | 2268 | 12436 |
| | 6087 | 3030 | 2039 | 16323 | 8447 | 18750 | 16277 | 2412 | 18682 | 18358 | 12549 | 18406 |
| | 1390 | 8657 | 15832 | 8609 | 6974 | 6281 | 8591 | 1357 | 5973 | 16208 | 12678 | 10423 |
| | 18094 | 17711 | 4111 | 10235 | 10848 | 1743 | 3109 | 9476 | 6992 | 16202 | 18853 | 17948 |
| | 2213 | 12570 | 4347 | 4954 | 1510 | 15130 | 3018 | 12888 | 12264 | 16727 | 16884 | 19498 |
| | 10768 | 14695 | 16944 | 12594 | 14452 | 18055 | 12881 | 19189 | 10784 | 2720 | 13143 | 5352 |
| | 7662 | 15194 | 18003 | 5874 | 16708 | 14822 | 14749 | 15941 | 2031 | 15715 | 10075 | 12830 |
| | 6407 | 9819 | 6114 | 8177 | 6890 | 5432 | 15138 | 19857 | 18139 | 1174 | 8978 | 8120 |
| | 9900 | 6781 | 18900 | | | | | | | | | |
| 282: | 9488 | 13616 | 15590 | 2297 | 2284 | 4876 | 8155 | 4503 | 12483 | 1657 | 3791 | 899 |
| | 884 | 18026 | 18515 | 18521 | 18025 | 17955 | 559 | 18537 | 557 | 16157 | 10429 | 13191 |
| | 7467 | 11321 | 7432 | 14150 | 2723 | 12764 | 12504 | 16859 | 19196 | 19198 | 19204 | 18436 |
| | 19288 | 19227 | 19280 | 19200 | 19248 | 19885 | 18438 | 19282 | 18463 | 19259 | 19224 | 19904 |
| | 19285 | 18461 | 19231 | 19909 | 19908 | 19292 | 19887 | 19310 | 19924 | 19920 | 19912 | 19255 |
| | 19201 | 19905 | 18443 | 19860 | 19222 | 18441 | 18425 | 19252 | 19253 | 19233 | 16129 | 15836 |
| | 3701 | 13372 | 6579 | 3072 | 10251 | 10921 | 11241 | 1852 | 14936 | 13471 | 2795 | 13570 |
| | 13592 | 5773 | 13546 | 3179 | 4658 | 5425 | 19564 | 6136 | 5441 | 19623 | 527 | 19056 |
| | 16702 | 16685 | 2755 | 4581 | 1965 | 4319 | 3694 | 3892 | 6668 | 6060 | 18290 | 1483 |
| | 12475 | 6925 | 2154 | 2749 | 11421 | 12831 | 15432 | 10442 | 12991 | 12491 | 11934 | 17139 |
| | 10324 | 10227 | 2579 | 15389 | 7706 | 18794 | 1036 | 10124 | 11030 | 10073 | 15797 | 12617 |
| | 3046 | 10666 | 11189 | 6165 | 6563 | 8600 | 2237 | 11718 | 1494 | 17677 | 1968 | 11225 |
| | 3759 | 19617 | 1963 | 1230 | 9162 | 14979 | 2576 | 10989 | 16101 | 1141 | 17522 | 11388 |
| | 19518 | 14314 | 9391 | 12490 | 9259 | 9858 | 9861 | 9878 | 3027 | 8297 | 6634 | 2580 |
| | 564 | 536 | 513 | 13257 | 12751 | 2800 | 4947 | 6596 | 6727 | 12672 | 13807 | 4898 |
| | 6067 | 7002 | 9776 | 9305 | 5205 | 17859 | 10706 | 9919 | 5631 | 3026 | 14137 | 17947 |
| | 13952 | 10969 | 17270 | 11134 | 11135 | 1464 | 1994 | 7337 | 4302 | 19858 | 14835 | 3132 |
| | 18541 | 18685 | 15115 | 13477 | 7242 | 5034 | 4232 | 4229 | 7849 | 3936 | 9400 | 7074 |
| | 1711 | 13593 | 1267 | 7020 | 6203 | 5752 | 11017 | 19211 | 16500 | 5464 | 16481 | 16479 |
| | 11262 | 9474 | 2657 | 9912 | 17012 | 17455 | 16989 | 2421 | 11405 | 4134 | 4135 | 13791 |
| | 3760 | 4746 | 7250 | 11301 | 16165 | 19238 | 6369 | 8863 | 6260 | 10640 | 806 | 1373 |
| | 1942 | 9798 | 10528 | 1672 | 6827 | 6035 | 18378 | 2844 | 12503 | 12481 | 18439 | 9335 |
| | 6502 | 16929 | 6137 | 3738 | 14085 | 11558 | 7893 | 670 | 2543 | 714 | 7694 | 12393 |
| | 8619 | 7916 | 5416 | 4052 | 6540 | 18074 | 16465 | 12699 | 15044 | 7738 | 6074 | 5428 |
| | 10870 | 18932 | 19505 | 13905 | 15650 | 18814 | 14236 | 16809 | 16695 | 16811 | 6358 | 6377 |
| | 9099 | 13233 | 15830 | 15855 | 16971 | 9952 | 13720 | 19312 | 2882 | 17849 | 13346 | 11894 |
| | 13927 | 10068 | 15728 | 15724 | 1669 | 10842 | 5211 | 5573 | 11524 | 15993 | 10964 | 11561 |
| | 8701 | 8076 | 2340 | 9030 | 12177 | 8173 | 15874 | 13078 | 13080 | 15578 | 16552 | 11954 |
| | 17694 | 13066 | 11930 | 9502 | 8839 | 10015 | 14690 | 15514 | 14413 | 543 | 5118 | 19602 |
| | 14943 | 17995 | 1533 | 15898 | 17708 | 13695 | 8703 | 7375 | 12243 | 12246 | 10408 | 1134 |
| | 7047 | 7069 | 1384 | 664 | 14725 | 13989 | 14727 | 12311 | 550 | 588 | 2405 | 3105 |
| | 1325 | 3085 | 4328 | 12896 | 10416 | 5716 | 5734 | 5080 | 10206 | 14083 | 5736 | 12511 |
| | 7935 | 9350 | 11129 | 2367 | 15487 | 18863 | 6310 | 6136 | 16616 | 17976 | 3605 | 11762 |
| | 6296 | 7735 | 3664 | 15502 | 16857 | 13747 | 16858 | 1704 | 8970 | 8242 | 3966 | 18776 |
| | 2037 | 13001 | 18364 | 8423 | 12792 | 14596 | 1694 | 2481 | 2503 | 17868 | 531 | 18007 |
| | 7674 | 7678 | 2470 | 5590 | 15264 | 15917 | 13152 | 11243 | 11441 | 18206 | 19145 | 19302 |
| | 5018 | 2605 | 15951 | 15519 | 11689 | 3205 | 8293 | 4752 | 4648 | 2589 | 3319 | 3377 |

TABLE 2-continued

| SEQ ID NO: | homolog SEQ ID NOs | | | | | | | | | | |
|---|---|---|---|---|---|---|---|---|---|---|---|
| | 6240 | 2569 | 2542 | 4651 | 4796 | 4774 | 4647 | 4644 | 4101 | 4693 | 4777 | 4022 |
| | 4018 | 4020 | 4714 | 3995 | 4133 | 4060 | 4668 | 4197 | 1988 | 16865 | 1441 | 16612 |
| | 758 | 17827 | 17825 | 6420 | 6905 | 12143 | 5753 | 17242 | 18540 | 553 | 5233 | 15097 |
| | 3540 | 2308 | 14280 | 13379 | 15914 | 9672 | 9677 | 653 | 5107 | 10689 | 462 | 16974 |
| | 6046 | 7495 | 7028 | 14188 | 17597 | 18006 | 10434 | 5334 | 13292 | 9733 | 15419 | 1170 |
| | 1187 | 16770 | 17137 | 16828 | 16680 | 5597 | 11937 | 16404 | 17267 | 5157 | 13849 | 8607 |
| | 18671 | 4234 | 14051 | 1528 | 11389 | 17864 | 17893 | 17962 | 561 | 12269 | 12414 | 14893 |
| | 13196 | 10758 | 18547 | 563 | 558 | 18543 | 532 | 5357 | 13969 | 17925 | 3015 | 560 |
| | 3362 | 5820 | 7763 | 960 | 17879 | 10047 | 537 | 3873 | 8224 | 535 | 555 | 556 |
| | 585 | 17895 | 562 | 2019 | 11745 | 11746 | 8692 | 18545 | 533 | 19830 | 13796 | 13716 |
| | 3761 | 15630 | 15770 | 10070 | 7827 | 6148 | 2018 | 7825 | 7828 | 8464 | 8157 | 7805 |
| | 3409 | 3407 | 3366 | 3430 | 3387 | 3429 | 7806 | 7768 | 7804 | 7797 | 7772 | 7799 |
| | 7771 | 7776 | 7822 | 7820 | 5838 | 18949 | 16551 | 2875 | 14511 | 15973 | 10383 | 9041 |
| | 11443 | 17876 | 17871 | 1216 | 3604 | 18867 | 11364 | 7984 | 7564 | 5619 | 16508 | 9249 |
| | 19817 | 11408 | 4489 | 7775 | 16600 | 11204 | 11343 | 6760 | 16109 | 12509 | 11456 | 1471 |
| | 12963 | 1159 | 14149 | 17898 | 4525 | 8069 | 5516 | 3522 | 17718 | 17147 | 2073 | 10352 |
| | 9958 | 12355 | 4590 | 8758 | 17922 | 17979 | 15581 | 2550 | 4547 | 11843 | 1492 | 9863 |
| | 9732 | 12824 | 4458 | 4446 | 2432 | 8850 | 10795 | 2573 | 12282 | 1601 | 2523 | 1313 |
| | 4569 | 6686 | 7903 | 18104 | 7660 | 11455 | 7569 | 10308 | 14385 | 17379 | 16758 | |
| 283: | 15531 | 6256 | 3677 | 12101 | 13037 | 10190 | 10248 | 11043 | 822 | 16817 | 7460 | 8374 |
| | 602 | 15713 | 1872 | 6858 | 11835 | 10862 | 12518 | 10351 | 1380 | 17170 | 18399 | 10269 |
| | 9599 | 10039 | 5643 | 1398 | 5309 | 2941 | 13830 | 626 | 17116 | 19140 | 11467 | 18598 |
| | 13371 | 8055 | 11493 | 2929 | 12146 | 10801 | 14962 | 19804 | 16176 | 17439 | 2811 | 496 |
| | 2695 | 19371 | 12254 | 9322 | 16426 | 17763 | 3303 | 7474 | 8440 | 6587 | 7356 | 10022 |
| | 7182 | 7542 | 19708 | 4269 | 14632 | 12375 | 12229 | 13513 | 5894 | 17174 | 11372 | 14162 |
| | 15843 | 13669 | 2318 | 4478 | 4374 | 2133 | 1853 | 5420 | 9504 | 9838 | 8996 | 1878 |
| | 5702 | 13717 | 1634 | 18754 | 3402 | 15053 | 14759 | 16550 | 3082 | 4918 | 14755 | 14416 |
| | 9281 | 8312 | 16172 | 11469 | 9564 | 18095 | 19075 | 13665 | 14192 | 9419 | 14729 | 2368 |
| | 10551 | 14620 | 6612 | 19450 | 454 | 8874 | 19239 | 7854 | 8878 | 17842 | 15819 | 18002 |
| | 13934 | 12440 | 12425 | 7219 | 13659 | 3489 | 18080 | 14572 | 6789 | 15128 | 8759 | 17772 |
| | 11836 | 13231 | 12637 | 8764 | 17762 | 17882 | 18242 | 8340 | 4916 | 1839 | 12027 | 518 |
| | 6044 | 6520 | 14817 | 9982 | 15655 | 16991 | 6478 | 8575 | 17011 | 7819 | 19454 | 11008 |
| | 3852 | 16238 | 12816 | 18889 | 19856 | 3049 | 6004 | 4420 | 14200 | 19451 | 3399 | 3287 |
| | 757 | 4411 | 3141 | 3803 | 3354 | 2485 | 600 | 11184 | 11333 | 15248 | 4728 | 19407 |
| | 13987 | 16072 | 13120 | 493 | 7888 | 811 | 14946 | 2583 | 8687 | 9939 | 14742 | 4000 |
| | 19160 | 16329 | 17352 | 7798 | 9075 | 11087 | 16289 | 13321 | 3576 | 5304 | 6605 | 16610 |
| | 12700 | 5370 | 15030 | 7544 | 2014 | 8691 | 16557 | 17396 | 12352 | 3485 | 16266 | 13480 |
| | 19873 | 8847 | 11387 | 13745 | 2392 | 8223 | 5726 | 12517 | 14311 | 13416 | 14639 | 10763 |
| | 14203 | 18402 | 3129 | 12616 | 9840 | 18774 | 18715 | 15765 | 15812 | 8125 | 18204 | 4445 |
| | 799 | 8531 | 4265 | 17783 | 16560 | 14953 | 11093 | 3886 | 5539 | 6863 | 15521 | 13084 |
| | 19629 | 18230 | 15314 | 6456 | 5130 | 7907 | 9874 | 4068 | 9185 | 2982 | 8263 | 8178 |
| | 11555 | 12456 | 2286 | 17432 | 6568 | 1183 | 1923 | 13056 | 400 | 18905 | 11046 | 17586 |
| | 15182 | 10135 | 12752 | 9213 | 14279 | 7205 | 650 | 6593 | 6212 | 18450 | 15704 | 9964 |
| | 7123 | 5422 | 14997 | 16892 | 14156 | 16838 | 19853 | 13287 | 1951 | 6717 | 14456 | 16168 |
| | 7220 | 6525 | 16069 | 12673 | 11280 | 9572 | 7263 | 16613 | 1000 | 3100 | 1497 | 17231 |
| | 9541 | 2750 | 6439 | 3980 | 10290 | 15824 | 17100 | 4572 | 9670 | 8215 | 6984 | 12801 |
| | 10455 | 3696 | 17104 | 11037 | 10557 | 7817 | 7141 | 11642 | 18768 | 18492 | 12742 | 7415 |
| | 8653 | 14608 | 13015 | 13405 | 13121 | 8857 | 17133 | 16228 | 14222 | 5302 | 7237 | 7488 |
| | 5999 | 3641 | 566 | 2958 | 11175 | 2130 | 2764 | 16189 | 18380 | 6548 | 9673 | 14038 |
| | 14035 | 7139 | 15190 | 5426 | 19562 | 18437 | 17501 | 644 | 2919 | 7071 | 7261 | 14062 |
| | 13482 | 15191 | 11743 | 19472 | 19437 | 6920 | 13727 | 15618 | 15631 | 19891 | 11927 | 10932 |
| | 8010 | 16223 | 14499 | 6723 | 19485 | 6581 | 14854 | 14856 | 7405 | 12499 | 14495 | 885 |
| | 6550 | 15800 | 14507 | 17436 | 16225 | 11331 | 3216 | 8486 | 4438 | 7918 | 5382 | 661 |
| | 9656 | 5184 | 1208 | 3516 | 15538 | 15408 | 11613 | 11439 | 5451 | 15131 | 18608 | 4901 |
| | 4791 | 17602 | 8576 | 6930 | 9997 | 16304 | 16968 | | | | | |
| 284: | 14546 | 4993 | 1029 | 7514 | 2917 | 10152 | 11335 | 9594 | 14726 | 17937 | 6935 | 14151 |
| | 10273 | 5997 | 7000 | 10002 | 6010 | 16908 | 7529 | 2137 | 5389 | 15290 | 8071 | 6027 |
| | 4413 | 15840 | 17540 | 6072 | 10477 | 13780 | 16667 | 4735 | 851 | 17780 | 8426 | 4344 |
| | 3194 | 6508 | 4023 | 12288 | 16472 | 15236 | 18423 | 2712 | 6253 | 7180 | 8745 | 16575 |
| | 12645 | 11798 | 15025 | 14872 | 12821 | 12055 | 5069 | 8763 | 5400 | 5829 | 7669 | 2817 |
| | 5344 | 1590 | 8606 | 18818 | 16682 | 18975 | 16411 | 12120 | 1632 | 2145 | 10107 | 3618 |
| | 17320 | 7159 | 19374 | 8892 | 12001 | 19521 | 2499 | 7464 | 11752 | 2395 | 19468 | 2094 |
| | 17945 | 13685 | 3703 | 7073 | 8473 | 15278 | 11750 | 6376 | 722 | 1788 | 12276 | 2177 |
| | 3659 | 2253 | 13161 | 10545 | 826 | 3249 | 6401 | 10373 | 5991 | 4410 | 9993 | 9994 |
| | 4785 | 9814 | 10962 | 18365 | 854 | 5075 | 4178 | 13328 | 18181 | 19525 | 14890 | 1603 |
| | 6161 | 1186 | 310 | 587 | 2986 | 3592 | 12649 | 3080 | 15617 | 11601 | 13501 | 13181 |
| | 6206 | 12788 | 7897 | 2732 | 11732 | 7914 | 4586 | 18225 | 17758 | 4002 | 14369 | 2043 |
| | 9570 | 3991 | 19823 | 19209 | 11521 | 18784 | 14970 | 6131 | 8658 | 15987 | 11465 | 8315 |
| | 19681 | 17975 | 1559 | 5862 | 3880 | 11271 | 2108 | 14500 | 11285 | 16316 | 19436 | 10432 |
| | 7652 | 11110 | 19523 | 2843 | 17746 | 1118 | 7774 | 19578 | 18424 | 4835 | 14580 | 15727 |
| | 5582 | 2332 | 2821 | 17034 | 16853 | 10210 | 12320 | 9478 | 7636 | 16940 | 5379 | 13944 |
| | 8103 | 651 | 3131 | 7232 | 11772 | 19236 | 15809 | 4006 | 529 | 19806 | 7702 | 4689 |
| | 17509 | 5782 | 10158 | 6488 | 7040 | 13260 | 10093 | 686 | 10592 | 15289 | 19347 | 9038 |
| | 13009 | 13925 | 7052 | 14143 | 8739 | 14688 | 12107 | 15485 | 11400 | 6474 | 3104 | 3107 |
| | 14423 | 1690 | 5872 | 1941 | 9668 | 3685 | 11900 | 10682 | 15943 | 14081 | 8352 | 10943 |
| | 8232 | 18499 | 14024 | 18737 | 9701 | 5604 | 13245 | 3263 | 5326 | 14254 | 14253 | 14255 |
| | 14251 | 19565 | 4990 | 2198 | 4887 | 16593 | 4192 | 623 | 16711 | 18391 | 10980 | 7532 |
| | 10316 | 16098 | 911 | 19278 | 8228 | 17323 | 16757 | 2097 | 18771 | 1562 | 8768 | 11770 |

TABLE 2-continued

| SEQ ID NO: | homolog SEQ ID NOs | | | | | | | | | | |
|---|---|---|---|---|---|---|---|---|---|---|---|
| | 13930 | 13210 | 9302 | 4394 | 18666 | 1679 | 19230 | 14127 | 8256 | 3565 | 3486 | 8305 |
| | 17338 | 12200 | 14095 | 16106 | 16554 | 5101 | 9627 | 11323 | 13709 | 19928 | 15448 | 7178 |
| | 6851 | 9856 | 17693 | 5450 | 14758 | 6440 | 4840 | 16948 | 10481 | 18098 | 12809 | 9820 |
| | 8612 | 5560 | 2328 | 16487 | 4316 | 9793 | 9587 | 6024 | 4610 | 3518 | 14472 | 8379 |
| | 17788 | 16283 | 940 | 18073 | 12073 | 12239 | 12641 | 1517 | 4520 | 4253 | 19655 | 19157 |
| | 7457 | 14257 | 13738 | 9744 | 6631 | 11117 | 7100 | 10958 | 1663 | 19658 | 830 | 850 |
| | 981 | 19109 | 1871 | 7127 | 18552 | 12232 | 3002 | 16895 | 13330 | 7142 | 5045 | 8449 |
| | 15114 | 15111 | 19687 | 19859 | 2450 | 5262 | 5468 | 1622 | 15404 | 10115 | 3091 | 1432 |
| | 7857 | 9421 | 10367 | 16178 | 16767 | 18032 | 14517 | 10922 | 4845 | 5596 | 17422 | 17656 |
| | 14974 | 16264 | 17181 | 461 | 10535 | 13155 | 18603 | 4629 | 7200 | 12897 | 12379 | 19551 |
| | 3158 | 16835 | 2030 | 2535 | 10521 | 8602 | 5328 | 6340 | 5196 | 12908 | 4510 | 6303 |
| | 5493 | 710 | 15944 | 18673 | 17709 | 16365 | 17701 | 3274 | 14621 | 2173 | 3229 | 12063 |
| | 8399 | 9226 | 19709 | 3984 | 17274 | 5355 | 11541 | 16698 | 15860 | 19429 | 17598 | 1573 |
| | 5354 | 3074 | 10753 | 6512 | 4856 | 14767 | 3042 | 14876 | 3811 | 856 | 14273 | 14271 |
| | 2338 | 13640 | 5456 | 5459 | 8719 | 10281 | 6810 | 7883 | 15726 | 15508 | 17683 | 3047 |
| | 16285 | 12882 | 13574 | 3723 | 18442 | 11447 | 14287 | 18277 | 8323 | 8320 | 19125 | 8734 |
| | 18846 | 8429 | 8735 | 6351 | 18016 | 7745 | 18581 | 16456 | 13515 | 4296 | 16800 | 3915 |
| | 7965 | 11716 | 12382 | 5285 | 552 | 18741 | 19308 | 12228 | 713 | 1275 | 3193 | 601 |
| | 4292 | 18067 | 7027 | 15113 | | | | | | | | |
| 285: | 14398 | 1558 | 18339 | 13431 | 13428 | 4182 | 16260 | 10619 | 6127 | 12005 | 7704 | 5064 |
| | 13072 | 4395 | 9032 | 19907 | 9588 | 478 | 12782 | 9917 | 13100 | 5202 | 10562 | 2044 |
| | 4452 | 10775 | 3543 | 14840 | 14071 | 14020 | 10406 | 14218 | 1797 | 16955 | 3879 | 10312 |
| | 12432 | 14824 | 7082 | 14554 | 15744 | 1508 | 15866 | 16232 | 6797 | 7077 | 5816 | 3596 |
| | 3597 | 3311 | 15022 | 881 | 2638 | 906 | 212 | 12037 | 12039 | 3458 | 9042 | 8812 |
| | 3217 | 9466 | 2270 | 18102 | 610 | 2431 | 16650 | 14418 | 2251 | 1244 | 4235 | 6826 |
| | 16651 | 14435 | 13004 | 7852 | 18349 | 9553 | 9262 | 4340 | 9235 | 15603 | 1413 | 17223 |
| | 8296 | 10538 | 16071 | 16048 | 2120 | 19847 | 11239 | 10420 | 18968 | 12345 | 2995 | 2159 |
| | 2549 | 3987 | 7551 | 19585 | 5685 | 4861 | 16862 | 8677 | 13466 | 11435 | 11230 | 6015 |
| | 6649 | 8097 | 16025 | 9440 | 1353 | 16249 | 16151 | 9398 | 15930 | 11226 | 2870 | 12373 |
| | 15043 | 11765 | 10145 | 11071 | 9537 | 9095 | 5496 | 2350 | 11756 | 7967 | 13362 | 2624 |
| | 7924 | 6715 | 15074 | 17068 | 9275 | 10177 | 11007 | 14857 | 8951 | 12182 | 11643 | 13590 |
| | 1740 | 7684 | 910 | 929 | 9093 | 10018 | 13344 | 16978 | 6305 | 11378 | 17544 | 11969 |
| | 1393 | 15937 | 11803 | 16631 | 13126 | 14108 | 18524 | 9644 | 8425 | 8421 | 8420 | 10755 |
| | 16696 | 15994 | 10757 | 1143 | 3549 | 5868 | 5126 | 7506 | 19032 | 12669 | 12547 | 4707 |
| | 4710 | 4708 | 4732 | 4736 | 4733 | 8772 | 4730 | 4711 | 3385 | 1831 | 2528 | 2304 |
| | 13223 | 15197 | 15098 | 11673 | 4386 | 11884 | 2336 | 9633 | 9118 | 14693 | 2399 | 12725 |
| | 14548 | 11011 | 18359 | 14692 | 5652 | 5434 | 9755 | 9513 | 2681 | 4364 | 19777 | 13525 |
| | 12903 | 6859 | 4326 | 6088 | 11611 | 3068 | 3578 | 13940 | 8582 | 14440 | 19618 | 9826 |
| | 13275 | 18012 | 9371 | 10057 | 5985 | 18222 | 15021 | 11502 | 14888 | 14001 | 1279 | 17431 |
| | 18172 | 7826 | 14232 | 8317 | 10294 | 7425 | 15565 | 5531 | 17742 | 5564 | 18144 | 14389 |
| | 13857 | 7113 | 16444 | 7400 | 10835 | 13461 | 4722 | 2115 | 13951 | 19022 | 5256 | 18254 |
| | 7276 | 16719 | 1045 | 2920 | 3279 | 19766 | 684 | 19811 | 1237 | 15371 | 10076 | 8004 |
| | 18712 | 2781 | 4940 | 11219 | 2673 | 19836 | 18985 | 14312 | 15772 | 3933 | 6426 | 7906 |
| | 15599 | 11860 | 1907 | 18897 | 14263 | 16522 | 4672 | 13737 | 574 | 16112 | 15415 | 11543 |
| | 3433 | 7746 | 4115 | 9525 | 5392 | 9445 | 2252 | 14696 | 17114 | 1400 | 9349 | 4881 |
| | 14484 | 18930 | 2533 | 10428 | 7616 | 18415 | 10497 | 12585 | 10236 | 4874 | 19793 | 4633 |
| | 12544 | 1995 | 17255 | 6130 | 10439 | 8504 | 7487 | 15261 | 6768 | 12863 | 3628 | 15985 |
| | 17752 | 5019 | 2036 | 2840 | 18127 | 12020 | 9264 | 14875 | 7498 | 1448 | 1059 | 9636 |
| | 2644 | 15865 | 6207 | 9893 | 3161 | 10031 | 16927 | 2065 | 7894 | 2171 | 4174 | 1254 |
| | 18701 | 10035 | 19271 | 1389 | 12810 | 4747 | 12671 | 19586 | 10698 | 5651 | 9018 | 1931 |
| | 4286 | 7712 | 3519 | 12527 | 13943 | 6181 | 5039 | 13948 | 16797 | 16826 | 18966 | 5145 |
| | 17610 | 6304 | 8895 | 7744 | 9280 | 9284 | 10647 | 16558 | | | | |
| 286: | 9313 | 1653 | 17351 | 14049 | 14657 | 1383 | 1015 | 18068 | 4392 | 10779 | 16383 | 9920 |
| | 487 | 9934 | 2830 | 3247 | 2351 | 18430 | 10228 | 17404 | 17658 | 5336 | 5337 | 17655 |
| | 1350 | 17686 | 17699 | 17685 | 5353 | 17632 | 5339 | 17682 | 1645 | 1642 | 1640 | 1620 |
| | 1616 | 8916 | 8212 | 9895 | 2832 | 2783 | 4293 | 6486 | 10048 | 4251 | 5819 | 5822 |
| | 5393 | 7543 | 8453 | 7971 | 5457 | 12283 | 11526 | 4620 | 4594 | 4593 | 12447 | 12446 |
| | 12443 | 12421 | 12418 | 12419 | 4579 | 6639 | 4625 | 4624 | 4598 | 8851 | 4628 | 4580 |
| | 4631 | 14489 | 13819 | 14308 | 18593 | 5807 | 15337 | 2081 | 12213 | 5581 | 14765 | 7934 |
| | 18948 | 16079 | 6446 | 10336 | 6213 | 8673 | 10129 | 12010 | 19004 | 19003 | 13184 | 10392 |
| | 11721 | 7649 | 9054 | 15693 | 14867 | 1784 | 7482 | 9674 | 1270 | 19176 | 1199 | |
| | 8500 | 19667 | 4212 | 4448 | 3986 | 12515 | 15430 | 7679 | 18854 | 16043 | 4242 | 10959 |
| | 13366 | 2878 | 11272 | 5100 | 3297 | 7169 | 19051 | 3475 | 13999 | 17136 | 17946 | 7102 |
| | 9260 | 9177 | 5942 | 18576 | 8622 | 9353 | 18500 | 14477 | 16377 | 4784 | 16796 | 16425 |
| | 17653 | 13145 | 16135 | 7307 | 4655 | 9544 | 12992 | 17516 | 2232 | 1408 | 2230 | 1599 |
| | 11103 | 9661 | 8918 | 17531 | 7259 | 10941 | 16332 | 19728 | 2216 | 11076 | 2670 | 18069 |
| | 18160 | 18744 | 1206 | 2891 | 5478 | 5142 | 4382 | 2683 | 19169 | 7606 | 11398 | 12629 |
| | 18745 | 3786 | 17936 | 5887 | 3425 | 5214 | 8401 | 14931 | 18934 | 15251 | 6533 | 4671 |
| | 6531 | 17015 | 1412 | 5092 | 8805 | 5545 | 6049 | 12372 | 578 | 17463 | 10263 | 1161 |
| | 2814 | 5758 | 10686 | 7449 | 1330 | 10508 | 15984 | 8027 | 1288 | 5176 | 19668 | 1710 |
| | 19355 | 3454 | 13918 | 14445 | 2162 | 14905 | 2727 | 17196 | 7122 | 9749 | 10816 | 13053 |
| | 15837 | 11705 | 1700 | 2315 | 17710 | 12014 | 19134 | 14514 | 14744 | 2761 | 1547 | 12385 |
| | 7818 | 16211 | 18823 | 9872 | 2759 | 2806 | 12795 | 9882 | 6415 | 1151 | 49287 | 8821 |
| | 10229 | 14451 | 7419 | 9477 | 11295 | 15793 | 15660 | 11783 | 701 | 2955 | 17659 | 2504 |
| | 17348 | 16342 | 15186 | 6406 | 8247 | 5380 | 13891 | 1315 | 1256 | 19915 | 1724 | 2012 |
| | 14065 | 10299 | 8282 | 616 | 13375 | 9102 | 16056 | 11991 | 9014 | 9223 | 19193 | 5659 |
| | 12275 | 17960 | 6092 | 13451 | 8592 | 8527 | 7016 | 15734 | 1394 | 3654 | 2224 | 9086 |
| | 6674 | 15201 | 5282 | 3178 | 18367 | 19531 | 17843 | 8903 | 4152 | 2519 | 4236 | 14485 |

TABLE 2-continued

| SEQ ID NO: | homolog SEQ ID NOs | | | | | | | | | | |
|---|---|---|---|---|---|---|---|---|---|---|---|
| | 8563 | 18395 | 2904 | 12192 | 17438 | 7558 | 8708 | 17132 | 14463 | 2926 | 3606 | 14880 |
| | 4126 | 13192 | 11148 | 18831 | 19343 | 3854 | 3197 | 1662 | 15209 | 1164 | 6993 | 19768 |
| | 5846 | 5825 | 13392 | 3964 | 18837 | 3676 | 6815 | 1563 | 14197 | 4983 | 16851 | 1080 |
| | 10309 | 13336 | 6679 | 6681 | 19226 | 1139 | 18217 | 6677 | 11476 | 10458 | 11376 | 11534 |
| | 15281 | 15284 | 4323 | 17519 | 4170 | 18686 | 3737 | 12407 | 9314 | 18763 | 18235 | 2522 |
| | 424 | 12163 | 6909 | 13949 | 13705 | 2221 | 17613 | 6620 | 10223 | 18017 | 9192 | 4434 |
| | 7858 | 4011 | 19099 | 15849 | 2703 | 7837 | 16579 | 10683 | 5630 | 13463 | 4008 | 5853 |
| | 15102 | 13390 | 15974 | 3534 | 9370 | 7120 | 13281 | 10677 | 6277 | 7442 | 19758 | 3296 |
| | 12002 | 5857 | 6669 | 12717 | 15152 | 973 | 15151 | 5971 | 2689 | 2692 | 14737 | 15184 |
| | 19235 | 11966 | 9246 | 1051 | 16723 | 7949 | 2967 | 13928 | 1691 | 17376 | 8438 | 6021 |
| | 5801 | 5705 | 16980 | 13383 | 18063 | 14100 | 12568 | 5238 | 12085 | 17418 | 17386 | 7929 |
| | 19078 | 16133 | 15135 | 4577 | 8414 | 19149 | 3621 | 10044 | 6007 | 16987 | 3208 | 3567 |
| | 14540 | 9431 | 6837 | 9742 | 14981 | 18407 | 10889 | 5572 | 15933 | 2966 | 14048 | 10199 |
| | 19043 | 8146 | 11747 | 2107 | 1220 | 19179 | 13356 | 3167 | 14446 | 7973 | 13997 | 10221 |
| | 14201 | 10975 | 11488 | 8663 | 6381 | 2578 | 2575 | 14911 | 6552 | 16339 | 768 | 1468 |
| | 18066 | 12089 | 17874 | 13394 | 9319 | 919 | 12747 | 7881 | 17584 | 17587 | 6226 | 19910 |
| | 7627 | 18249 | 9111 | 10610 | 1083 | 6509 | 17564 | 5851 | 15935 | 14750 | 1415 | 7919 |
| | 8561 | 13034 | 1757 | 7298 | 10482 | 17985 | 2674 | 18011 | 18159 | 6510 | 8905 | 4745 |
| | 13968 | 5850 | 6365 | 18717 | 6735 | 7063 | 6097 | 7741 | 6692 | 16850 | 9791 | 1250 |
| | 1976 | | | | | | | | | | | |
| 287: | 14033 | 3069 | 10887 | 17423 | 15804 | 10725 | 1039 | 8823 | 13656 | 1864 | 18512 | 3164 |
| | 11788 | 9149 | 8808 | 5438 | 15880 | 3992 | 800 | 12872 | 18261 | 8766 | 14438 | 3187 |
| | 10085 | 4070 | 901 | 13535 | 2677 | 8285 | 10764 | 19705 | 18563 | 18309 | 4608 | 19842 |
| | 15814 | 13706 | 2652 | 1108 | 2600 | 11436 | 8221 | 18056 | 9465 | 14769 | 5688 | 5397 |
| | 3900 | 1598 | 6393 | 5004 | 17760 | 15162 | 12125 | 12647 | 7151 | 11629 | 14327 | 14070 |
| | 16315 | 15318 | 15939 | 1024 | 17173 | 7378 | 11794 | 17214 | 14034 | 2307 | 3146 | 11136 |
| | 745 | 14629 | 1219 | 8349 | 9131 | 14106 | 2574 | 6164 | 13786 | 12212 | 288 | 9930 |
| | 5003 | 15379 | 17113 | 11587 | 10350 | 16113 | 1863 | 10534 | 16794 | 10418 | 3427 | 14528 |
| | 9660 | 19113 | 14120 | 18931 | 693 | 10649 | 15876 | 620 | 11764 | 4473 | 14614 | 15160 |
| | 2527 | 7562 | 15931 | 15942 | 9412 | 10452 | 1278 | 9417 | 14663 | 6750 | 3059 | 18739 |
| | 5729 | 11588 | 8690 | 1571 | 1240 | 12230 | 10197 | 3943 | 9396 | 19704 | 5587 | 3849 |
| | 6395 | 2512 | 1364 | 4248 | 9916 | 17140 | 19660 | 9460 | 2383 | 2545 | 10421 | 10451 |
| | 7528 | 17188 | 5982 | 10710 | 4743 | 17869 | 13867 | 15895 | 18341 | 13127 | 9124 | 11340 |
| | 15482 | 4846 | 15991 | 3001 | 8402 | 17663 | 13283 | 11123 | 13596 | 1151 | 10214 | 18536 |
| | 11869 | 2959 | 17628 | 2207 | 1422 | 5187 | 12698 | 16068 | 18921 | 3969 | 18923 | 15856 |
| | 13136 | 15313 | 11878 | 7997 | 15604 | 14266 | 18654 | 16893 | 14982 | 19298 | 8644 | 8268 |
| | 18840 | 18022 | 3726 | 3772 | 13530 | 12761 | 10851 | 9602 | 19087 | 12685 | 5286 | 4627 |
| | 16074 | 10376 | 1178 | 17450 | 2560 | 825 | 10966 | 6542 | 5902 | 17622 | 13520 | 16539 |
| | 494 | 18321 | 9756 | 4078 | 13338 | 11983 | 15481 | 17256 | 1850 | 10700 | 6895 | 19331 |
| | 5603 | 16542 | 8629 | 14464 | 8541 | 11955 | 15582 | 1615 | 9393 | 11799 | 9705 | 10217 |
| | 3894 | 5124 | 17122 | 10037 | 19916 | 3503 | 17417 | 13729 | 5423 | 16076 | 1843 | 12859 |
| | 17649 | 1593 | 15088 | 11536 | 19105 | 6404 | 17208 | 9567 | 4208 | 3180 | 3864 | 9156 |
| | 12512 | 15134 | 8390 | 16883 | 10879 | 8150 | 9719 | 12593 | 14926 | 14282 | 17273 | 6293 |
| | 6538 | 13207 | 13438 | 1179 | 13854 | 1534 | 12605 | 12235 | 11858 | 6290 | 13936 | 15363 |
| | 13652 | 15361 | 19700 | 3899 | 1614 | 9390 | 19686 | 12223 | 19528 | 1763 | 6129 | 2975 |
| | 18334 | 4649 | 2415 | 18042 | 5063 | 4001 | 2807 | 5550 | 868 | 2976 | 14624 | 3321 |
| | 10604 | 2149 | 11085 | 14039 | 5615 | 8502 | 14424 | 9369 | 14136 | 4541 | 3019 | 11951 |
| | 18036 | 14808 | 13308 | 6822 | 19066 | 12540 | 9754 | 11217 | 12299 | 6562 | 19219 |
| | 2211 | 1980 | 409 | 1970 | 8961 | 14118 | 1424 | 14183 | 13802 | 3223 | 12957 | 11050 |
| | 12155 | 17192 | 14643 | 15307 | 6911 | 12324 | 7373 | 11544 | 13247 | 17437 | 12217 | 11827 |
| | 14360 | 17578 | 12753 | 6662 | 19268 | 1665 | 7212 | 10672 | 7843 | 1289 | 5216 | 4585 |
| | 19139 | 7937 | 16633 | 5644 | 16320 | 11433 | 9472 | 12965 | 12360 | 3202 | 11429 | 11427 |
| | 19689 | 1587 | 773 | 8864 | 14046 | 5266 | 9201 | 17227 | 10510 | 7291 | 10904 | 10655 |
| | 4965 | 17040 | 2183 | 16534 | 15799 | 9967 | 13632 | 6850 | 19691 | 8788 | 16409 | 4673 |
| | 17193 | 14098 | 11916 | 2451 | 4834 | 18460 | 18183 | 14691 | 19318 | 1489 | 12987 | 16441 |
| | 17707 | 16821 | 18525 | 6452 | 5795 | 10306 | 808 | 5051 | 9434 | 4528 | 13359 | 1168 |
| | 13904 | 3700 | 15002 | 12152 | 6475 | 2944 | 15440 | 18551 | 1414 | 4231 | 14124 | 8358 |
| | 6492 | 16565 | 17743 | 5954 | 16843 | 954 | 5541 | 5859 | 18096 | 12827 | 15357 | 11338 |
| | 14884 | 7974 | 10246 | 5834 | 3697 | 450 | 16197 | 8091 | 11058 | 8780 | 10822 | 12036 |
| | 3632 | 1407 | 632 | 5735 | 2700 | 8621 | 4284 | 18605 | 5544 | 3482 | 7892 | 18630 |
| | 6701 | 13975 | 18530 | 11623 | 10209 | 10341 | 12178 | 19162 | 4832 | 13434 | 19639 | 7936 |
| | 1306 | 11386 | 4376 | 19409 | 7887 | 13961 | 19229 | 11753 | 10931 | 1751 | 18762 | 698 |
| | 7891 | 10920 | 8887 | 5093 | 14119 | 434 | 10475 | 8949 | 9491 | 15868 | 17642 | 9386 |
| | 8713 | 17515 | 11664 | 12640 | 4630 | 9414 | 7285 | 9296 | 14419 | 9418 | 14870 | 5136 |
| | 2943 | 8767 | 9080 | 9232 | 9233 | 9981 | 8666 | 11032 | 6927 | 1544 | 17476 | 16917 |
| | 19548 | 12188 | 2244 | 15586 | 11795 | 14909 | 4751 | 13962 | 9106 | 429 | 18945 | 4616 |
| | 5199 | 10178 | 18224 | 7863 | | | | | | | | |
| 288: | 14033 | 3069 | 10887 | 17423 | 15804 | 10725 | 1039 | 8823 | 287 | 9557 | 13656 | 1864 |
| | 18512 | 3164 | 11788 | 9149 | 8808 | 5438 | 15880 | 3992 | 800 | 12872 | 18261 | 8766 |
| | 14438 | 3187 | 10085 | 4070 | 901 | 13535 | 2677 | 8285 | 10764 | 19705 | 18563 | 18309 |
| | 4608 | 19842 | 15814 | 13706 | 2652 | 1108 | 2600 | 11436 | 8221 | 18056 | 9465 | 14769 |
| | 5688 | 5397 | 3900 | 1598 | 6393 | 5004 | 17760 | 15162 | 12125 | 12647 | 7151 | 11629 |
| | 14327 | 14070 | 16315 | 15318 | 15939 | 1024 | 17173 | 7378 | 11794 | 17214 | 14034 | 2307 |
| | 3146 | 11136 | 745 | 14629 | 1219 | 8349 | 9131 | 14106 | 2574 | 6164 | 13786 | 12212 |
| | 5003 | 15379 | 17113 | 11587 | 10350 | 16113 | 1863 | 10534 | 16794 | 10418 | 3427 | 14528 |
| | 9660 | 19113 | 14120 | 18931 | 693 | 10649 | 15876 | 620 | 11764 | 4473 | 14614 | 15160 |
| | 2527 | 7562 | 9412 | 15931 | 15942 | 10452 | 1278 | 9417 | 14663 | 6750 | 3059 | 18739 |
| | 5729 | 11588 | 8690 | 1571 | 1240 | 12230 | 10197 | 3943 | 9396 | 19704 | 5587 | 3849 |

TABLE 2-continued

| SEQ ID NO: | homolog SEQ ID NOs | | | | | | | | | | |
|---|---|---|---|---|---|---|---|---|---|---|---|
| | 6395 | 2512 | 1364 | 4248 | 9916 | 17140 | 19660 | 5811 | 9460 | 2383 | 2545 | 10421 |
| | 10451 | 7528 | 17188 | 5982 | 10710 | 4743 | 17869 | 13867 | 15895 | 18341 | 13127 | 9124 |
| | 11340 | 15482 | 4846 | 15991 | 3001 | 8402 | 17663 | 13283 | 11123 | 13596 | 1151 | 10214 |
| | 18536 | 11869 | 2959 | 17628 | 2207 | 1422 | 5187 | 12698 | 16068 | 18923 | 3969 | 18921 |
| | 15856 | 13136 | 15313 | 11878 | 7997 | 15604 | 14266 | 18654 | 16893 | 14982 | 19298 | 8644 |
| | 8268 | 18840 | 18022 | 3726 | 3772 | 13530 | 12761 | 10851 | 9602 | 19087 | 12685 | 5286 |
| | 4627 | 16074 | 10376 | 1178 | 17450 | 2560 | 825 | 10966 | 6542 | 5902 | 17622 | 13520 |
| | 16539 | 494 | 18321 | 9756 | 4078 | 13338 | 11983 | 15481 | 17256 | 1850 | 10700 | 6895 |
| | 19331 | 5603 | 16542 | 8629 | 14464 | 8541 | 11955 | 15582 | 1615 | 9393 | 11799 | 9705 |
| | 10217 | 3894 | 5124 | 17122 | 10037 | 19916 | 3503 | 17417 | 13729 | 5423 | 16076 | 1843 |
| | 12859 | 17649 | 1593 | 15088 | 11536 | 19105 | 6404 | 17208 | 9567 | 4208 | 3180 | 3864 |
| | 9156 | 12512 | 15134 | 8390 | 16883 | 10879 | 8150 | 9719 | 12593 | 14926 | 14282 | 17273 |
| | 6293 | 6538 | 13207 | 13438 | 1179 | 13854 | 1534 | 12605 | 12235 | 11858 | 6290 | 13936 |
| | 15363 | 15361 | 13652 | 19700 | 3899 | 1614 | 9390 | 19686 | 12223 | 19528 | 1763 | 2975 |
| | 6129 | 14424 | 9369 | 868 | 4001 | 2807 | 5550 | 18042 | 4649 | 2415 | 5063 | 14136 |
| | 18334 | 4541 | 2976 | 3321 | 2149 | 14624 | 10604 | 14865 | 4260 | 2050 | 11085 | 14039 |
| | 5615 | 11951 | 13308 | 18036 | 12540 | 14808 | 6822 | 19066 | 15323 | 9754 | 11217 | 6562 |
| | 19219 | 2211 | 1980 | 409 | 1970 | 1424 | 14183 | 3223 | 14118 | 17192 | 13802 | 12957 |
| | 12155 | 11050 | 12753 | 8961 | 6911 | 12324 | 7373 | 14643 | 15307 | 11544 | 6662 | 13247 |
| | 17578 | 14360 | 17437 | 1289 | 5216 | 7937 | 4585 | 19139 | 16633 | 5644 | 16320 | 11433 |
| | 9472 | 12965 | 12360 | 3202 | 11429 | 11427 | 19689 | 1587 | 773 | 8864 | 14046 | 5266 |
| | 9201 | 10510 | 17227 | 16534 | 7291 | 9967 | 10904 | 10655 | 19691 | 8788 | 16409 | 4673 |
| | 14098 | 2451 | 17193 | 11916 | 14691 | 4834 | 18460 | 12987 | 18183 | 2944 | 1489 | 19318 |
| | 17707 | 10306 | 5795 | 6452 | 13359 | 16821 | 18525 | 16441 | 808 | 5051 | 4528 | 9434 |
| | 1168 | 13904 | 954 | 5541 | 5859 | 17743 | 14884 | 5954 | 16843 | 18096 | 12827 | 15357 |
| | 6492 | 16565 | 11338 | 19639 | 5834 | 10246 | 3697 | 7974 | 4376 | 19409 | 11058 | 16197 |
| | 8091 | 1751 | 18762 | 450 | 1407 | 3632 | 8780 | 2700 | 8621 | 12036 | 18605 | 5735 |
| | 632 | 10822 | 5544 | 6701 | 7892 | 10341 | 13975 | 4284 | 3482 | 5093 | 14119 | 434 |
| | 10475 | 8949 | 9491 | 15868 | 17642 | 9386 | 8713 | 17515 | 11664 | 12640 | 4630 | 9414 |
| | 7285 | 9296 | 14419 | 9418 | 14870 | 5136 | 2943 | 8767 | 9080 | 9232 | 9233 | 9981 |
| | 8666 | 11032 | 6927 | 1544 | 16917 | 19548 | 12188 | 2244 | 19768 | 11795 | 14909 | 4751 |
| | 13962 | 9106 | 429 | 18945 | 4616 | 5199 | 10178 | 18224 | 7863 | | | |
| 289: | 5523 | 4313 | 17448 | 17841 | 12777 | 10355 | 19605 | 19897 | 13150 | 13788 | 8075 | 5624 |
| | 13087 | 8533 | 15156 | 16282 | 4418 | 5362 | 17314 | 16470 | 9691 | 6830 | 3539 | 8947 |
| | 11303 | 15847 | 12513 | 12958 | 12763 | 11550 | 1760 | 7062 | 5192 | 9953 | 3474 | 3481 |
| | 8116 | 13424 | 12304 | 5690 | 13692 | 18678 | 12740 | 18407 | 12452 | 4939 | 13248 | 3994 |
| | 5264 | 3961 | 4726 | 4657 | 19545 | 17062 | 16253 | 1040 | 7214 | 5231 | 11985 | 5953 |
| | 3077 | 10399 | 11073 | 3556 | 17461 | 15325 | 9938 | 4761 | 10626 | 12944 | 12889 | 11220 |
| | 6105 | 15005 | 17775 | 7340 | 16006 | 1428 | 19624 | 11919 | 12601 | 642 | 3843 | 3912 |
| | 4096 | 12974 | 13254 | 2664 | 16161 | 8861 | 13261 | 13575 | 9768 | 14949 | 19126 | 4880 |
| | 5824 | 9299 | 14874 | 5687 | 2782 | 17505 | 17726 | 6275 | 3175 | 13677 | 4398 | 4025 |
| | 5376 | 4677 | 18843 | 7388 | 15255 | 14128 | 2596 | 1938 | 14569 | 13062 | 4742 | 13091 |
| | 16870 | 9122 | 11112 | 12762 | 3052 | 11166 | 2182 | 15922 | 13893 | 6314 | 10549 | 17230 |
| | 10781 | 6932 | 11582 | 16011 | 6946 | 9000 | 6251 | 9407 | 11924 | 9877 | 6838 | 15556 |
| | 15794 | 11808 | 19431 | 2295 | 1090 | 12514 | 7454 | 18403 | 2529 | 18862 | 19419 | 12173 |
| | 3773 | 11501 | 1975 | 14174 | 16124 | 8277 | 11572 | 2186 | 4994 | 16607 | 12215 | 7089 |
| | 1851 | 16812 | 1689 | 3238 | 11697 | 1993 | 14319 | 8424 | 1113 | 3997 | 2880 | 18417 |
| | 15224 | 9191 | 8757 | 16205 | 13252 | 3135 | 18125 | 1294 | 2016 | 407 | 744 | 18246 |
| | 19479 | 15883 | 18721 | 4036 | 14388 | 15680 | 19029 | 5232 | 12705 | 8217 | 16267 | 8222 |
| | 11264 | 961 | 12449 | 16916 | 13761 | 3615 | 7172 | 14831 | 14301 | 16476 | 14882 | 7390 |
| | 14607 | 14441 | 5660 | 11599 | 11359 | 4092 | 17343 | 13568 | 581 | 5071 | 859 | 5934 |
| | 10571 | 12380 | 8016 | 725 | 9697 | 6714 | 8705 | 17074 | 1644 | 11944 | 12826 | 11957 |
| | 4502 | 5499 | 5549 | 14898 | 1200 | 7101 | 18165 | 6291 | 6133 | 13712 | 11143 | 13419 |
| | 3259 | 14157 | 11554 | 16748 | 6359 | 2357 | 941 | 11901 | 18451 | 1984 | 931 | 4926 |
| | 6943 | 18727 | 6551 | 17793 | 4278 | 4905 | 3893 | 11593 | 10509 | 15596 | 4274 | 3302 |
| | 3510 | 8231 | 18704 | 13258 | 4695 | 1347 | 8641 | 4776 | 16869 | 9696 | 16749 | 12938 |
| | 4466 | 5831 | 2176 | 13023 | 7184 | 5489 | 8886 | 12920 | 6529 | 871 | 15574 | 8579 |
| | 17493 | 7527 | 18633 | 2515 | 3708 | 13536 | 7991 | 3379 | 16897 | | | |
| 290: | 13013 | 2572 | 15390 | 1939 | 14078 | 15522 | 9968 | 9379 | 18412 | 18308 | 9944 | 6870 |
| | 12684 | 3058 | 2845 | 13741 | 4261 | 19592 | 4701 | 17626 | 13030 | 8728 | 11077 | 4091 |
| | 4089 | 17112 | 14261 | 13039 | 2448 | 19588 | 19632 | 10171 | 3875 | 16215 | 6248 | 6904 |
| | 17027 | 14757 | 14672 | 18336 | 6783 | 16361 | 13415 | 7175 | 19494 | 2544 | 3982 | 12302 |
| | 12865 | 16091 | 6469 | 16191 | 15776 | 6721 | 2879 | 4779 | 2699 | 14780 | 16535 | 10778 |
| | 10809 | 10295 | 3281 | 8912 | 10017 | 11633 | 16868 | 2259 | 19421 | 16353 | 2746 | 14045 |
| | 11766 | 14772 | 5191 | 8574 | 17749 | 1617 | 17592 | 15384 | | | | |
| 291: | 17667 | 17054 | 19440 | 15213 | 7334 | 2141 | 3727 | 9845 | 11081 | 9526 | 12337 | 15918 |
| | 15597 | 3255 | 10276 | 970 | 16639 | 19309 | 2222 | 15291 | 19583 | 14945 | 7813 | 9966 |
| | 1286 | 1910 | 10491 | 19293 | 16030 | 19104 | 463 | 11758 | 9810 | 14676 | 9957 | 4241 |
| | 14669 | | | | | | | | | | | |
| 292: | 9221 | 9220 | 6193 | 3253 | 14842 | 13721 | 4160 | 4741 | 7322 | 10303 | 16057 | 13497 |
| | 13494 | 13514 | 3142 | 3155 | 3203 | 3201 | 3204 | 3231 | 3227 | 3230 | 3228 | 5987 |
| | 3206 | 17127 | 17830 | 17527 | 19410 | 19413 | 12404 | 13866 | 13360 | 13864 | 13860 | 1092 |
| | 18317 | 16638 | 3344 | 11672 | 1048 | 5311 | 11768 | 18957 | 9486 | 5520 | 4119 | 3271 |
| | 14470 | 11906 | 13464 | 5650 | 8589 | 1858 | 2994 | 2964 | 2947 | 2923 | 14662 | 12783 |
| | 5730 | 10701 | 3718 | 10132 | 8593 | 12855 | 6873 | 15376 | 15374 | 19023 | 14646 | 14645 |
| | 9650 | 10687 | 844 | 17322 | 17326 | 6887 | 4652 | 3798 | 14561 | 15275 | 12003 | 17738 |

TABLE 2-continued

| SEQ ID NO: | homolog SEQ ID NOs | | | | | | | | | | |
|---|---|---|---|---|---|---|---|---|---|---|---|
| | 3837 | 3822 | 3819 | 3846 | 15647 | 8778 | 10880 | 17001 | 8637 | 3841 | 8776 | 18718 |
| | 14843 | 3863 | 3817 | 13443 | 13421 | 13442 | 13498 | 3923 | 13787 | 3280 | 3276 | 18190 |
| | 4216 | 12478 | 8586 | 7030 | 8614 | | | | | | | |
| 293: | 13730 | 7076 | 16121 | 2661 | 2089 | 15753 | 13834 | 1549 | 18755 | 5880 | 14792 | 946 |
| | 10952 | 15392 | 19376 | 15572 | 11083 | 1945 | 12301 | | | | | |
| 294: | 19341 | 4724 | 19896 | 3258 | 5111 | 599 | 6431 | 13589 | 6942 | 6192 | 6252 | 13509 |
| | 19882 | 4075 | 1265 | 10657 | 10589 | 5296 | 15003 | 18223 | 18248 | 2327 | 1261 | 9965 |
| | 4027 | 15223 | 16926 | 14122 | 18287 | 13182 | 19642 | 13929 | 3304 | 730 | 11185 | 4607 |
| | 2628 | 9008 | 18151 | 2691 | 11457 | 19048 | 6876 | 6857 | 15174 | 15158 | 17254 | 6991 |
| | 11670 | 4110 | 4109 | 12772 | 10184 | 4872 | 12819 | 12694 | 6264 | 7048 | 9607 | 9648 |
| | 12614 | 8990 | 7650 | 19393 | 5863 | 3904 | 10368 | 7157 | 16438 | 13128 | 17560 | 7535 |
| | 1575 | 10105 | 10134 | 568 | 13578 | 4304 | 9818 | 7538 | 9257 | 18048 | 15120 | 18444 |
| | 17647 | 18149 | 3239 | 2052 | 591 | 16792 | 10643 | 9825 | 9839 | 18609 | 3056 | 3720 |
| | 12370 | 9361 | 1519 | 17206 | 2733 | 2404 | 2274 | 10638 | 1810 | 1681 | 794 | 5509 |
| | 8149 | 6109 | 16956 | 4055 | 9906 | 3806 | 4482 | 3406 | 8669 | 11941 | 8434 | |
| | 17353 | 1718 | 16055 | 16094 | 11109 | 13291 | 14317 | 16938 | 8688 | 12395 | 11729 | 19065 |
| | 14012 | 4384 | 7554 | 19069 | 18471 | 16995 | 10788 | 16414 | 3527 | 4972 | 4041 | 7910 |
| | 6178 | 2598 | 12998 | 9686 | 12367 | 8259 | 9712 | 9092 | 15589 | 17494 | 13102 | 3555 |
| | 4223 | 2428 | 5186 | 13868 | 17026 | 19357 | 3670 | 16415 | 4465 | 5164 | 14396 | 8679 |
| | 11667 | 4509 | 11014 | 4526 | 10211 | 3983 | 11652 | 13984 | 11918 | 3989 | 1532 | 19637 |
| | 1516 | 8361 | 9956 | 2740 | 19492 | 19752 | 7125 | 504 | 18859 | 1252 | 13539 | 6656 |
| | 17606 | 8695 | 18363 | 828 | 4343 | 4885 | 16387 | 12180 | 16021 | 6095 | 15293 | 7951 |
| | 15342 | 16946 | 16808 | 5255 | 15684 | 11760 | 19481 | 5992 | 13140 | 3529 | 12315 | 13875 |
| | 7700 | 1035 | 5477 | 5476 | 17832 | 8331 | 8176 | 7166 | 12559 | 4721 | 7461 | 1735 |
| | 1862 | 4162 | 19901 | 18566 | 16648 | 17875 | 1044 | 17901 | 16027 | 3656 | 5177 | 4493 |
| | 8389 | 7751 | 16700 | 19251 | 7033 | 8539 | 8515 | 6547 | 17753 | 6527 | 7218 | 4305 |
| | 18907 | 2441 | 16894 | 8368 | 15641 | 7365 | 8148 | 5873 | 7736 | 9634 | 9685 | |
| | 9688 | 5086 | 9147 | 19697 | 6980 | 13974 | 14084 | 14057 | 14234 | 16981 | 7596 | 2200 |
| | 9879 | 6560 | 7032 | 4346 | 9104 | 12902 | 9061 | 16803 | 18628 | 5254 | 6524 | 19495 |
| | 6553 | 1235 | 13979 | 4589 | 5122 | 8755 | 5028 | 18168 | 8279 | 14683 | 17291 | 3546 |
| | 19846 | 17369 | 19927 | 12627 | 14146 | 16105 | 17234 | 15988 | 10866 | 12145 | 8926 | 6958 |
| | 8927 | 4271 | 16119 | 10894 | 10871 | 14052 | 4521 | 4546 | 19411 | 17524 | 542 | 18878 |
| | 6595 | 2294 | 11153 | 9855 | 9127 | 6844 | 8065 | 9659 | 15206 | 10237 | 10286 | 5228 |
| | 7708 | 16193 | 16173 | 1816 | 2487 | 7234 | 18474 | 15871 | 18498 | 18386 | 9860 | 16437 |
| | 13117 | 11881 | 10754 | 18738 | 9129 | 5234 | 17737 | 539 | 13246 | 11876 | 5966 | 6301 |
| | 18615 | 2022 | 1249 | 15906 | 6134 | 1486 | 1737 | 17536 | 16641 | 16126 | 2117 | 18070 |
| | 1727 | 19256 | 772 | 771 | 16084 | 13449 | 415 | 1588 | 4731 | 11912 | 13036 | 12904 |
| | 10167 | 10170 | 10181 | 11796 | 7931 | 4436 | 19552 | 15340 | 9069 | 6065 | 9576 | 14476 |
| | 4033 | 6144 | 6355 | 9580 | 11373 | 3845 | 10555 | 6026 | 1538 | 14252 | 11149 | 12524 |
| | 19249 | 7977 | 8112 | 14058 | 7344 | 7310 | 12622 | 12584 | 4642 | 6874 | 16745 | 440 |
| | 1628 | 829 | 15558 | 18297 | 1682 | 2486 | 4188 | 5990 | 15852 | 3101 | 17511 | 647 |
| | 6316 | 8897 | 18910 | 1311 | 5918 | 17076 | 9692 | 4085 | 13054 | 13063 | 16969 | 6300 |
| 295: | 10020 | 1439 | 9915 | 16163 | 18062 | 10972 | 18887 | 18356 | 4431 | 1884 | 10727 | 13800 |
| | 12798 | 2858 | 7343 | 14738 | 2791 | 14434 | 9539 | 17180 | 8662 | 5767 | 8275 | 2125 |
| | 6101 | 2121 | 7866 | 9540 | 2780 | 5578 | 19289 | 18868 | 12356 | 8526 | 2380 | 13296 |
| | 3693 | 16875 | 2379 | 13074 | 19810 | 949 | 14344 | 1531 | 16649 | 14889 | 14044 | 4090 |
| | 3535 | 14795 | 14076 | 11583 | 15037 | 3570 | 4564 | 3572 | 16352 | 16416 | 1362 | 5033 |
| | 6120 | 979 | 439 | 15995 | 19886 | 17585 | 14283 | 1830 | 6945 | 9194 | 11025 | 1647 |
| | 6731 | 8953 | 4154 | 14591 | 490 | 17151 | 13499 | 11392 | 12621 | 8859 | 12715 | 16405 |
| | 19405 | 18614 | 9282 | 12579 | 6899 | 1876 | 7114 | 15543 | 19677 | 5323 | 11508 | 12990 |
| | 19006 | 18475 | 3862 | 7010 | 19748 | 1860 | 15260 | 4534 | | | | |
| 296: | 4540 | 6354 | 1755 | 1754 | 17371 | 3891 | 9752 | 4896 | 3390 | 13183 | 12597 | 8675 |
| | 19057 | 6229 | 4548 | 17590 | 5708 | 4363 | 6198 | 17103 | 9094 | 2389 | 11801 | 14837 |
| | 6762 | | | | | | | | | | | |
| 297: | 4370 | 7533 | 2597 | 5919 | 4081 | 1338 | 1069 | 10498 | 19778 | 13926 | 7098 | 7281 |
| | 7968 | 12746 | 5461 | 13420 | 11565 | 11748 | 7477 | 1523 | 7224 | 17897 | 18082 | 14625 |
| | 17717 | 1367 | 15055 | 3466 | 18152 | 3922 | 5925 | 14810 | 16421 | 9929 | 17561 | 14752 |
| | 18760 | 19598 | 12786 | 11882 | 9247 | 5551 | 4562 | 3594 | 11415 | 17495 | 11692 | 12861 |
| | 16921 | 838 | 16714 | 10602 | 15187 | 4256 | 6989 | 12555 | 10731 | 13076 | 7618 | 12876 |
| | 10208 | 869 | 12690 | 7839 | 12981 | 17982 | 15557 | 6454 | 5181 | 4327 | 12171 | 8233 |
| | 18590 | 17657 | | | | | | | | | | |
| 298: | 16642 | 4906 | 6546 | 8807 | 15527 | 1974 | 3476 | 14666 | 13472 | 17605 | 12833 | 9706 |
| | 9679 | 4373 | 19761 | 15703 | 11680 | 18191 | 19790 | 19596 | 6939 | 14155 | 3044 | 7880 |
| | 10088 | 3490 | | | | | | | | | | |
| 299: | 13175 | 3648 | 1095 | 19091 | 6471 | 18453 | 11391 | 11863 | 12390 | 14399 | 8543 | 2686 |
| | 18964 | 17580 | 17565 | | | | | | | | | |
| 300: | 15769 | 8388 | 13307 | 16886 | 9617 | 9239 | 11198 | 2854 | 892 | 2335 | 11948 | 5159 |
| | 11294 | 8727 | 8073 | 11276 | 15356 | 19272 | 11054 | | | | | |
| 301: | 10572 | 5247 | 19764 | 5097 | 11353 | 18884 | 8479 | 9341 | 11247 | 19532 | 7752 | 2918 |
| | 6108 | 14397 | 6315 | | | | | | | | | |
| 302: | 17017 | 11635 | 5436 | 17789 | 15563 | 8900 | 12793 | 3944 | 11383 | 6001 | 6054 | 7021 |
| | 17088 | 19664 | 6262 | 2642 | 18990 | 4151 | 14818 | 7272 | 8345 | 5258 | 16301 | 1266 |
| | 4095 | 18986 | 14878 | 10156 | | | | | | | | |
| 303: | 9378 | 2246 | 16919 | 2665 | 10325 | 6537 | 6515 | 8525 | 17336 | 2540 | | |
| 304: | 3039 | 5198 | 11864 | 16540 | 18772 | 6379 | 16878 | 17787 | 1436 | 12983 | 13229 | 16103 |
| | 16127 | 8943 | 12794 | 16102 | 16100 | 4759 | 19321 | 8190 | 2913 | 15179 | 3181 | 5096 |
| | 12048 | 6045 | 692 | 3816 | 5920 | 473 | 489 | 14828 | 10454 | 1781 | 15219 | 3647 |
| | 12472 | 10767 | 4582 | 2698 | 3361 | 17036 | 3796 | 8573 | 19690 | 16677 | 8338 | 13554 |

TABLE 2-continued

| SEQ ID NO: | homolog SEQ ID NOs | | | | | | | | | | |
|---|---|---|---|---|---|---|---|---|---|---|---|
| | 16002 | 17464 | 6225 | 3244 | 7491 | 16139 | 13938 | 11138 | 14770 | 18781 | 12979 | 6776 |
| | 12028 | 7778 | 6586 | | | | | | | | |
| 305: | 6411 | 7134 | 8906 | 16488 | 13440 | 2289 | 8244 | 2283 | 7468 | 6684 | 10347 | 4285 |
| | 18467 | 13646 | 6223 | 12937 | 4443 | 18455 | 1856 | 14107 | 6321 | 2537 | 3970 | 3246 |
| | 12156 | 16596 | 16256 | 12890 | 15409 | 19151 | 4718 | 5175 | 11879 | 18126 | 18711 | 9204 |
| | 13563 | 9579 | 16836 | | | | | | | | |
| 306: | 12951 | 10398 | 11346 | 19186 | 15452 | 7802 | 7096 | 13491 | 13681 | 11482 | 14807 | 3733 |
| | 17000 | 671 | 17496 | 8110 | 12773 | 17405 | 2034 | 7911 | 17108 | 17121 | 17123 | 10527 |
| | 13104 | 9923 | 15163 | 15161 | 15672 | 1133 | 7107 | 15159 | 16049 | 2789 | 5414 | 19524 |
| | 9684 | | | | | | | | | | |
| 307: | 17075 | 12342 | 704 | 19539 | 6820 | 19480 | 17050 | 17008 | 19402 | 15902 | 18440 | 5435 |
| | 2820 | 13268 | 13272 | 6889 | 3099 | 441 | 18043 | 8140 | 7516 | 17639 | 18575 | 12426 |
| | 10811 | 14604 | 7842 | 4222 | 5559 | 17265 | 12910 | 16743 | 603 | 5928 | 7036 | |
| 308: | 9770 | 17349 | 9595 | 3084 | 14563 | 12042 | 12040 | 1361 | 7692 | 7690 | 7693 | 11111 |
| | 13156 | 9807 | 11464 | 16693 | 16672 | 16674 | 16694 | 16675 | 11027 | 16798 | 4507 | 7680 |
| | 7462 | 15210 | 11446 | 7522 | 12111 | 10983 | 13675 | 15116 | 10650 | 17747 | 18142 | 6554 |
| | 18344 | 14846 | 3610 | 1916 | 1918 | 1920 | 10514 | 10515 | 5814 | 16298 | 16963 | 8419 |
| | 5633 | 10896 | 11971 | 11972 | 11360 | 9381 | 15416 | 8935 | 9451 | 16130 | 7252 | 12038 |
| | 12592 | 11897 | 11899 | 9157 | 12294 | 15591 | 3634 | 3640 | 6918 | 1028 | 1025 | 1010 |
| | 7954 | 6924 | 6937 | 3533 | 5048 | 13534 | 13474 | 10893 | 902 | 10939 | 9585 | 2197 |
| | 2948 | 10393 | 11720 | 14453 | 7240 | 11026 | 11092 | 11088 | 13756 | 13185 | 13798 | 13762 |
| | 13187 | 13799 | 16822 | 9450 | 14147 | 11126 | 10984 | 11917 | 14454 | 6394 | 8064 | 8050 |
| | 1033 | 4682 | 5085 | 13556 | 3724 | 3725 | 3721 | 3722 | 3710 | 18855 | 16128 | 4243 |
| | 13813 | 13676 | 13159 | 17397 | 9345 | 13367 | 5940 | 18157 | 464 | 11157 | 3264 | 3704 |
| | 3705 | 16760 | 646 | 11952 | 7153 | 3598 | 8442 | 9161 | 5867 | 7339 | 1404 | 15165 |
| | 12587 | 12670 | 19102 | 11078 | 3824 | 18746 | 9973 | 5144 | 1144 | 7739 | 4130 | 12607 |
| | 1009 | 1004 | 1006 | 11992 | 1285 | 16777 | 7909 | 4484 | 8987 | 406 | 3215 | 13397 |
| | 1047 | 5188 | 16783 | 5519 | 18583 | 11625 | 11004 | 11056 | 11059 | 6050 | 3963 | 13604 |
| | 8117 | 14971 | 18716 | 17730 | 12013 | 7877 | 17204 | 5195 | 19070 | 4915 | 13843 | 19554 |
| | 4417 | 15788 | 11190 | 1693 | 2846 | 16330 | 11950 | 7243 | 10375 | 3691 | 3684 | 3687 |
| | 17915 | 16005 | 1671 | 19540 | 10499 | 10225 | 15761 | 1933 | 15767 | 2505 | 8246 | 16343 |
| | 19493 | 18295 | 12056 | 10278 | 16556 | 16134 | 13206 | 13209 | 16090 | 16088 | 16110 | 9103 |
| | 10581 | 9834 | 3635 | 13203 | 4829 | 5828 | 1395 | 2655 | 597 | 19923 | 5896 | 16913 |
| | 5772 | 1466 | 3658 | 3683 | 821 | 19840 | 795 | 820 | 15202 | 10661 | 15913 | 19756 |
| | 19772 | 405 | 19504 | 5314 | 3672 | 6313 | 9762 | 9767 | 14249 | 2904 | 2899 | 2900 |
| | 8635 | 18813 | 7724 | 8042 | 16951 | 14555 | 9160 | 2926 | 14241 | 2897 | 2907 | 6915 |
| | 6922 | 6897 | 9718 | 18623 | 16845 | 656 | 654 | 659 | 16108 | 18227 | 12270 | 12018 |
| | 10063 | 10061 | 13077 | 8431 | 11119 | 11118 | 16150 | 16966 | 13427 | 3374 | 18426 | 7386 |
| | 11478 | 3612 | 3613 | 3636 | 6900 | 6903 | 16373 | 19217 | 6757 | 19030 | 10360 | 13103 |
| | 6818 | 14125 | 6759 | 13921 | 13923 | 1196 | 13924 | 16656 | 1658 | 8471 | 1659 |
| | 11962 | 14022 | 10872 | 13157 | 16640 | 7948 | 18681 | 18699 | 9529 | 8931 | 12442 | 1512 |
| | 3143 | 16501 | 19154 | 6032 | 6908 | 18549 | 9542 | 12945 | 3916 | 18656 | 12708 | 15592 |
| | 14240 | 9740 | 9737 | 14661 | 1110 | 13204 | 886 | 14017 | 9925 | 2939 | 15031 | 19131 |
| | 1242 | 483 | 2701 | 9085 | 19779 | 2445 | 3183 | 8143 | 14002 | 9189 | 19747 | 2742 |
| | 4298 | 18369 | 5914 | 14761 | 2103 | 10374 | 8783 | 8779 | 8777 | 17066 | 2087 | 8596 |
| | 4717 | 10877 | 14774 | 8813 | 8334 | 16562 | 10853 | 8024 | 16960 | 13916 | 13919 | 15016 |
| | 15751 | 12115 | 10855 | 2038 | 746 | 14851 | 19743 | 15226 | 16549 | 2267 | 6875 | 7927 |
| | 1005 | 9649 | 9959 | 7485 | 19025 | 14411 | 14374 | 9783 | 13960 | 2711 | 9164 | 3716 |
| | 2547 | 17424 | 18941 | 14075 | 13323 | 5543 | 14815 | 2165 | 1756 | 13839 | 16367 | 15644 |
| | 11187 | 13216 | 6388 | 12024 | 17755 | 13911 | 9905 | 17809 | 19499 | 10196 | 18637 | 7216 |
| | 7392 | 11656 | 13835 | 19161 | 16251 | 11503 | 6720 | 2060 | 15709 | 5305 | 7634 | 17852 |
| | 18207 | 16818 | 3165 | 3167 | 12327 | 9373 | 14446 | 11406 | 9769 | 2446 | 11776 | 15103 |
| | 15104 | 9805 | 5938 | 19634 | 3749 | 1241 | 11031 | 13445 | 16440 | 11033 | 3821 | 17474 |
| | 17796 | 16654 | 11605 | 11600 | 17919 | 4230 | 11602 | 17229 | 15737 | 7785 | 3844 | 3847 |
| | 519 | 688 | 4144 | 11023 | 1132 | 10390 | 15833 | 11665 | 4077 | 12918 | 16563 | 15661 |
| | 7525 | 9509 | 17053 | 887 | 778 | 9741 | 9759 | 13398 | 9612 | 8193 | 17328 | 1726 |
| | 10300 | 10279 | 9459 | 4992 | 8844 | 9571 | 11468 | 16657 | 10900 | 10059 | 4404 | 16431 |
| | 11209 | 1678 | 3452 | 10909 | 10062 | 4426 | 1897 | 4429 | 8284 | 16799 | 18573 | 16149 |
| | 16964 | 6742 | 6744 | 5361 | 16614 | 5359 | 12651 | 15347 | 15877 | 15350 | 15344 | 4440 |
| | 3577 | 3488 | 4442 | 10910 | 10911 | 14004 | 10912 | 10807 | 15901 | 13213 | 4453 | 4455 |
| | 4477 | 4149 | 10914 | 4145 | 4506 | 4504 | 4500 | 4481 | 577 | 17702 | 16492 | 16427 |
| | 16446 | 11291 | 16449 | 16422 | 11428 | 16623 | 11430 | 19757 | 14384 | 11120 | 19257 | 11484 |
| | 6191 | 11608 | 846 | 12045 | 12044 | 14753 | 16772 | 3629 | 13129 | 8555 | 3650 | 3653 |
| | 10024 | 12068 | 12069 | 1079 | 9792 | 9323 | 9336 | 9318 | 12730 | 11003 | 10356 | 10985 |
| | 6919 | 18233 | 18757 | 9875 | 9790 | 9802 | 11466 | 5912 | 9363 | 883 | 11049 | 11994 |
| | 14457 | 3872 | 11895 | 9736 | 10974 | 19097 | 11659 | 19098 | 11658 | 9788 | | |
| 309: | 16801 | 13132 | 15648 | 16447 | 8652 | 17833 | 5712 | 8074 | 10690 | 3442 | 8077 | 16017 |
| | 4336 | 4334 | 18570 | 13315 | 10785 | 16462 | 16900 | 17538 | 1921 | 19152 | 17383 | 12486 |
| | 10936 | 16527 | 2668 | 17086 | 13286 | 16325 | 15106 | 13376 | 6034 | 10789 | 18519 | 10507 |
| | 14473 | 19441 | 13022 | 10831 | 1501 | 10537 | 763 | 17615 | 18865 | 8762 | 11975 | 17249 |
| | 1355 | 1352 | 1731 | 3928 | 897 | 5821 | 9053 | 17271 | 7633 | 3483 | 11371 | 720 |
| | 6786 | 10425 | 4104 | 19770 | 14043 | 16580 | 16413 | 15086 | 13278 | 2632 | 19416 | 11567 |
| | 16915 | 397 | 7115 | 6155 | 10323 | 4935 | 10287 | 7095 | 9624 | 14788 | 15196 | 8456 |
| | 15783 | 6496 | 1418 | 747 | 8160 | 15292 | 7226 | 422 | 8460 | 777 | 12388 | 7677 |
| | 4483 | 18613 | 12189 | 5109 | 11791 | 10558 | 6465 | 10804 | 9227 | 17539 | 7309 | 3145 |
| | 8845 | 16327 | 2894 | 1639 | 629 | 7456 | 18787 | 8517 | 4205 | 13792 | 7154 | 8540 |
| | 19386 | 12121 | 8153 | 18037 | 14847 | 2324 | 11604 | 5469 | 9801 | 18468 | 17366 | 14140 |
| | 12739 | 8760 | 7404 | 15266 | 14677 | 8556 | 8459 | 8628 | 6999 | 13739 | 10675 | 6389 |

TABLE 2-continued

| SEQ ID NO: | homolog SEQ ID NOs | | | | | | | | | | |
|---|---|---|---|---|---|---|---|---|---|---|---|
| | 19049 | 14756 | 908 | 978 | 13391 | 15622 | 2116 | 3418 | 6687 | 7203 | 11089 | 7349 |
| | 10890 | 12729 | 12757 | 12691 | 8258 | 15154 | 5394 | 2810 | 6594 | 13059 | 13162 | 13166 |
| | 13276 | 13782 | 13550 | 9631 | 11740 | 13230 | 18487 | 12114 | 13130 | 765 | 19329 | 16985 |
| | 16984 | 5165 | 16244 | 3083 | 4150 | 10606 | 8313 | 3214 | 11734 | 4026 | 14277 | 12261 |
| | 15383 | 15691 | 14747 | 10250 | 7726 | 5530 | 9870 | 13909 | 4204 | 5398 | 7793 | 3405 |
| | 7816 | 1214 | 655 | 5288 | 9771 | 18267 | 18824 | 18445 | 5386 | 6029 | 17183 | 14760 |
| | 17340 | 14748 | 14228 | 707 | 15468 | 7547 | 7657 | 4329 | 6352 | 16661 | 19814 | 2314 |
| | 3041 | 8145 | 7582 | 19453 | 4067 | 11236 | 9815 | 11632 | 10505 | 5399 | 5401 | 5701 |
| | 3262 | 7403 | 12127 | 7921 | 3166 | 6436 | 1351 | 6654 | 13970 | 6833 | 12197 | 8822 |
| | 8554 | 1854 | 17475 | 5955 | 3220 | 10389 | 18522 | 18779 | 11151 | 13163 | 16644 | 6673 |
| | 19122 | 8310 | 11845 | 11773 | 14281 | 8380 | 9076 | 16982 | 13329 | 19679 | 12412 | 10783 |
| | 16471 | 12667 | 4679 | 11260 | 17650 | 666 | 16258 | 15997 | 18585 | 8921 | 10213 | 7197 |
| | 5699 | 9843 | 6432 | 2595 | 1776 | 740 | 11551 | 15041 | 10033 | 14055 | 10738 | 16517 |
| | 16515 | 13985 | 6821 | 4687 | 3337 | 14627 | 7093 | 14433 | 13024 | 16428 | 7275 | 3380 |
| | 4043 | 18350 | 608 | 14968 | 2172 | 16860 | 13317 | 8029 | 18848 | 11693 | 11576 | 15045 |
| | 11780 | 19931 | 1062 | 11038 | 10639 | 11224 | 11221 | 2227 | 3034 | 6350 | 5148 | 7749 |
| | 12030 | 8913 | 7568 | 3467 | 5635 | 3053 | 4469 | 12468 | 7698 | 10930 | 8896 | 10567 |
| | 5095 | 10895 | 11854 | 16996 | 7668 | 15453 | 7431 | 7583 | 8611 | 5945 | 3403 | 2901 |
| | 7239 | 8207 | 19926 | 4267 | 5634 | 2493 | 15967 | 18640 | 17304 | 14193 | 13803 | 13885 |
| | 12365 | 19133 | 15544 | 17454 | 12090 | 5312 | 11677 | 14113 | 8439 | 6438 | 1093 | 1935 |
| | 8879 | 6523 | 2410 | 4492 | 1778 | 17725 | 1981 | 17098 | 9203 | 11167 | 16434 | 12877 |
| | 12668 | 8547 | 1722 | 11460 | 9512 | 9552 | 5897 | 11717 | 12745 | 12744 | 4809 | 4793 |
| | 17479 | 11627 | 8724 | 14508 | 4543 | 10264 | 4971 | 8893 | 12051 | 5043 | 4355 | 1461 |
| | 19129 | 13714 | 13778 | 4337 | 1055 | 12988 | 17873 | 9876 | 17972 | 770 | 14159 | 4321 |
| | 9397 | 9625 | 4982 | 12453 | 12399 | 15388 | 13950 | 19243 | 9355 | 1752 | 1060 | 16605 |
| | 8940 | 17507 | 5292 | 4698 | 6678 | 1898 | 8775 | 4290 | 2447 | 16769 | 3911 | 11807 |
| | 5120 | 6985 | 4114 | 3219 | 17056 | 14361 | 17019 | 4749 | 8281 | 1577 | 17419 | 16965 |
| | 17327 | 5163 | 19684 | 6013 | 18109 | 15816 | 18702 | 17013 | 15234 | 16355 | 14223 | 9490 |
| | 1545 | 18506 | 18978 | 18616 | 9311 | 10823 | 8457 | 8366 | 18318 | 6280 | 1223 | 3810 |
| | 19685 | 10902 | 7638 | 4578 | 7075 | 3196 | 14114 | 9172 | 3199 | 14132 | 12017 | 11925 |
| | 1300 | 1299 | 18838 | 3719 | 12015 | 11644 | 5046 | 3195 | 19721 | 18624 | 15377 | 19934 |
| | 6278 | 1999 | 1378 | 12351 | 5552 | 13478 | 7204 | 16346 | 1190 | 12660 | 10133 | 10832 |
| | 11577 | 11662 | 11896 | 13158 | 19477 | 7317 | 4352 | 1153 | 5239 | 13031 | 8108 | 17846 |
| | 9200 | 7760 | 2474 | 1105 | 8336 | 10576 | 16823 | 13973 | 16952 | 16876 | 12397 | 479 |
| | 1881 | 1602 | 6077 | 2802 | 12398 | 4605 | 2551 | 8786 | 2140 | 2855 | 2834 | 9841 |
| | 17023 | 18871 | 17373 | 17344 | 16728 | 10808 | 18676 | 16746 | 8129 | 2385 | 8180 | 3562 |
| | 5933 | 4787 | 2996 | 10676 | 15651 | 12169 | 19544 | 7801 | 7900 | 2278 | 855 | 7521 |
| | 18383 | 2546 | 1234 | 12032 | 19919 | 3652 | 721 | 8963 | 1814 | 10032 | 8605 | 10275 |
| | 18902 | 12424 | 12526 | | | | | | | | | |
| 310: | 4993 | 14546 | 1029 | 7514 | 2917 | 10152 | 11335 | 9594 | 14726 | 1405 | 17937 | 6935 |
| | 14151 | 10273 | 685 | 5997 | 7222 | 14658 | 11749 | 10121 | 7000 | 10002 | 6010 | 16908 |
| | 7529 | 2137 | 5389 | 15290 | 8071 | 6027 | 4413 | 15840 | 17540 | 6072 | 5406 | 10477 |
| | 13780 | 15060 | 14826 | 18210 | 10116 | 10120 | 10142 | 16667 | 851 | 4735 | 17780 | 8426 |
| | 10161 | 10163 | 18631 | 4975 | 4344 | 3194 | 6508 | 3557 | 11735 | 16259 | 4023 | 12288 |
| | 16472 | 15236 | 18423 | 2712 | 6253 | 7180 | 8745 | 16575 | 12645 | 11798 | 15025 | 14872 |
| | 12821 | 12055 | 5069 | 8763 | 5400 | 5829 | 7705 | 7669 | 2817 | 5344 | 1590 | 8606 |
| | 18818 | 5065 | 13075 | 16682 | 18975 | 16411 | 12120 | 1632 | 2145 | 10107 | 6360 | 3618 |
| | 17320 | 18641 | 7159 | 19374 | 8892 | 1683 | 10110 | 12001 | 19521 | 2499 | 7464 | 11752 |
| | 11792 | 2395 | 3322 | 19468 | 1246 | 2094 | 17945 | 13685 | 3703 | 7073 | 8473 | 15278 |
| | 11750 | 6376 | 722 | 8952 | 1788 | 12276 | 2177 | 8655 | 3659 | 2253 | 15358 | 9315 |
| | 2534 | 8070 | 15012 | 13161 | 10545 | 826 | 3249 | 6401 | 10373 | 13341 | 5991 | 4410 |
| | 9993 | 9994 | 4785 | 3349 | 11306 | 9814 | 13902 | 10962 | 18365 | 854 | 5075 | 13311 |
| | 4178 | 13328 | 18181 | 19894 | 19525 | 14890 | 1603 | 6161 | 14478 | 9243 | 587 | 2986 |
| | 3592 | 12649 | 3080 | 15617 | 11601 | 13501 | 13181 | 6206 | 12788 | 7897 | 11732 | 2732 |
| | 7914 | 3063 | 8862 | 19937 | 4586 | 2634 | 18225 | 17758 | 1058 | 4002 | 4561 | 14369 |
| | 2043 | 9570 | 3991 | 19823 | 19209 | 11521 | 18784 | 14970 | 6473 | 6131 | 8658 | 7280 |
| | 15987 | 11465 | 8315 | 15256 | 19681 | 16402 | 17975 | 1559 | 5862 | 3880 | 11271 | 16235 |
| | 13872 | 2108 | 14500 | 11285 | 16316 | 19436 | 10432 | 7652 | 11110 | 16345 | 19523 | 2843 |
| | 17746 | 1118 | 7774 | 19578 | 18424 | 4835 | 14580 | 15727 | 5582 | 2332 | 15462 | 2821 |
| | 17034 | 16853 | 10210 | 605 | 14264 | 12320 | 9478 | 13425 | 7636 | 16940 | 15239 | 5379 |
| | 13944 | 8103 | 651 | 15792 | 12912 | 15640 | 3131 | 7232 | 11772 | 19236 | 15809 | 4006 |
| | 529 | 19806 | 7702 | 4689 | 17509 | 3421 | 19306 | 5782 | 5183 | 10158 | 6488 | 7040 |
| | 13260 | 10093 | 13627 | 8732 | 686 | 10592 | 15289 | 19347 | 9038 | 13009 | 13925 | 7052 |
| | 14143 | 12780 | 12107 | 8739 | 14688 | 11400 | 7874 | 6474 | 3104 | 3107 | 14423 | 1690 |
| | 5872 | 1941 | 9668 | 3685 | 11900 | 10682 | 15943 | 14081 | 19665 | 8352 | 10943 | 8232 |
| | 4088 | 18499 | 14024 | 14211 | 18737 | 9701 | 5604 | 13245 | 3263 | 5326 | 14254 | 14253 |
| | 14255 | 14251 | 19565 | 4990 | 2198 | 4887 | 7549 | 16593 | 10140 | 4192 | 623 | 1967 |
| | 10165 | 10137 | 16711 | 3289 | 18400 | 18391 | 18244 | 10980 | 7532 | 10316 | 16098 | 911 |
| | 19278 | 11727 | 8228 | 17323 | 16757 | 8819 | 2097 | 7207 | 18771 | 1562 | 7815 | 9992 |
| | 16477 | 8768 | 11770 | 13930 | 10114 | 10138 | 10097 | 10099 | 13210 | 9302 | 4394 | 5658 |
| | 18666 | 1679 | 11104 | 1773 | 19230 | 14524 | 6799 | 14127 | 8979 | 14095 | 16554 | 5101 |
| | 8256 | 3565 | 16106 | 3486 | 17338 | 8305 | 12200 | 9627 | 7178 | 11323 | 13709 | 19928 |
| | 6851 | 15448 | 5450 | 14758 | 6440 | 16948 | 9856 | 17693 | 10481 | 18098 | 12809 | |
| | 9820 | 8612 | 5560 | 2328 | 16487 | 4312 | 4316 | 9793 | 17788 | 16283 | 4610 | 8379 |
| | 6024 | 3518 | 14472 | 940 | 18073 | 4253 | 1517 | 12073 | 19157 | 19655 | 12239 | 12641 |
| | 4520 | 7457 | 14257 | 13738 | 6631 | 9744 | 7100 | 10958 | 1663 | 19658 | 19657 | 850 |
| | 830 | 981 | 19109 | 1871 | 7127 | 18552 | 12232 | 3002 | 16895 | 13330 | 7142 | 5045 |
| | 8449 | 15114 | 15111 | 19687 | 19859 | 2450 | 5262 | 5468 | 1622 | 15404 | 3091 | 1432 |

TABLE 2-continued

| SEQ ID NO: | homolog SEQ ID NOs | | | | | | | | | | |
|---|---|---|---|---|---|---|---|---|---|---|---|
| | 7857 | 10115 | 9421 | 16767 | 16178 | 10367 | 18032 | 14517 | 10922 | 5596 | 4845 | 17422 |
| | 17656 | 15742 | 14974 | 16264 | 17181 | 461 | 10535 | 7200 | 13155 | 18603 | 12379 | 4629 |
| | 12897 | 19551 | 3158 | 16835 | 2030 | 2535 | 10521 | 5328 | 8602 | 6303 | 12908 | 6340 |
| | 16365 | 17709 | 15944 | 18673 | 710 | 17701 | 14621 | 2173 | 12063 | 3274 | 3229 | 8399 |
| | 3984 | 9226 | 19429 | 19709 | 17274 | 5355 | 16698 | 11541 | 15860 | 3074 | 17598 | 1573 |
| | 5354 | 6512 | 10753 | 4856 | 3042 | 14767 | 3811 | 14876 | 856 | 14273 | 14271 | 2338 |
| | 13640 | 5456 | 5459 | 8719 | 10281 | 6810 | 7883 | 15726 | 15508 | 17683 | 3047 | 16285 |
| | 12882 | 13574 | 3723 | 18442 | 11447 | 18277 | 8323 | 8320 | 19125 | 8734 | 18846 | 8429 |
| | 8735 | 6351 | 18016 | 7745 | 18581 | 16456 | 13515 | 4296 | 16800 | 3915 | 7965 | 11716 |
| | 9558 | 12382 | 5285 | 893 | 552 | 10143 | 18741 | 19308 | 284 | 3200 | 12228 | 1654 |
| | 713 | 1275 | 3193 | 1053 | 601 | 4292 | 7027 | 15113 | 11082 | 1186 | | |
| 311: | 13531 | 15014 | 19184 | 4117 | 8168 | 10792 | 10850 | 19284 | 5526 | 10160 | 888 | 19833 |
| | 19024 | 13115 | 9575 | 3212 | 14092 | 11196 | 16286 | 14686 | 5558 | 17090 | 17081 | 16907 |
| | 15798 | 5743 | 12604 | 593 | 8040 | 15926 | 19225 | 11909 | 5613 | 8553 | 2850 | 19417 |
| | 15940 | 5913 | 17199 | 13547 | 15258 | 14739 | 402 | 14718 | 10577 | 2249 | 2275 | 7788 |
| | 11681 | 6460 | 1636 | 8604 | 12864 | 2293 | 8498 | 7265 | 8520 | 7952 | 12354 | 16688 |
| | 12128 | 1747 | 6881 | 10130 | 17339 | 3222 | 18097 | 865 | 18477 | 16994 | 5237 | 19366 |
| | 395 | 5648 | 7676 | 8241 | 14849 | 16511 | 1950 | 3133 | 15141 | 12703 | 6805 | 4165 |
| | 17466 | 13619 | 14951 | 10472 | 5901 | 7341 | 11090 | 7199 | 6418 | 19254 | 13897 | 13967 |
| | 6098 | 8683 | 6978 | 11297 | 10739 | 18490 | 11417 | 13326 | 15170 | 8985 | 4283 | 10620 |
| | 10050 | 2430 | 5975 | 15405 | 7764 | 12075 | 11938 | 5271 | 18351 | 2785 | 12328 | 14687 |
| | 15954 | 10173 | 10759 | 17131 | 7683 | 6392 | 9694 | 19508 | 11227 | 14431 | 10991 | 10955 |
| | 5333 | 17596 | 14716 | 12198 | 17690 | 13772 | 11828 | 9888 | 1787 | 3935 | 15629 | 403 |
| | 11568 | 12658 | 9592 | 16152 | 16381 | 18209 | 19448 | 16752 | 14848 | 2937 | 5447 | 7889 |
| | 8469 | 9447 | 13876 | 12634 | 18731 | 15627 | 12984 | 10207 | 3116 | 8826 | 6318 | 8934 |
| | 3762 | 3827 | 1708 | 7049 | 9274 | 12720 | 9444 | 9420 | 7354 | 14664 | 6570 | 4045 |
| | 1225 | 17512 | 4782 | 7308 | 1264 | 7406 | 3352 | 15122 | 18219 | 1822 | 2876 | 14134 |
| | 2291 | 3261 | 16739 | 2348 | 11942 | 11875 | 9500 | 6270 | 9871 | 6173 | 5722 | 16368 |
| | 13322 | 16507 | 13154 | 9751 | 11960 | 1438 | 3048 | 4276 | 19604 | 2680 | 11597 | 11557 |
| | 8211 | 1536 | 11015 | 10386 | 6448 | 17614 | 15609 | 11101 | 10314 | 7156 | 6322 | 4619 |
| | 11816 | 14775 | 1023 | 3639 | 18377 | 18621 | 18433 | 10468 | 17302 | 1949 | 17435 | 9669 |
| | 4544 | 1990 | 7409 | 11278 | 9214 | 16595 | 11711 | 18807 | 4491 | 14566 | 15498 | 15400 |
| | 17691 | 19615 | 14984 | 2401 | 18622 | 13403 | 8647 | 3919 | 733 | 12287 | 9690 | 2714 |
| | 4040 | 7221 | 18345 | 19682 | 16469 | 10317 | 16625 | 3496 | 2388 | 12510 | 10301 | 19547 |
| | 15032 | 8347 | 1998 | 2048 | 14532 | 10402 | 4795 | 13067 | 6630 | 12135 | 4047 | 7346 |
| | 15387 | 1896 | 11660 | 3389 | 19879 | 2061 | 6988 | 19738 | 13900 | 4474 | 2621 | 17457 |
| | 11124 | 8595 | 8920 | 19461 | 11829 | 16912 | 9638 | 10219 | 14338 | 4225 | 12172 | 9374 |
| | 10078 | 11281 | 3024 | 15023 | 11963 | 14871 | 13655 | 10963 | 11216 | 16949 | 17195 | 6722 |
| | 17870 | 4862 | 12097 | 5511 | 1927 | 6433 | 11365 | 12620 | 12118 | 8817 | 4187 | 18833 |
| | 16333 | 4734 | 2143 | 19881 | 4183 | 19538 | 447 | 7211 | 18329 | 5917 | 9943 | 14372 |
| | 8806 | 16953 | | | | | | | | | | |
| 312: | 9795 | 6261 | 5149 | 5170 | 5168 | 12820 | 7573 | 12233 | 9643 | 9693 | 2068 | 11819 |
| | 18352 | 16729 | 2793 | 17847 | 7225 | 12946 | 8557 | 1832 | 444 | 10898 | 1956 | 4691 |
| | 7777 | 13647 | 19902 | 13284 | 13061 | 12536 | 5153 | 5151 | 16950 | 2990 | 2989 | 2988 |
| | 3487 | 2993 | 9433 | 3848 | 1198 | 1195 | 12880 | 1340 | 18680 | 17799 | 7617 | 13361 |
| | 9528 | 3585 | 6230 | 9821 | 3940 | 6243 | 18903 | 7878 | 9794 | 11915 | 6414 | 8130 |
| | 3463 | 15900 | 17558 | 2602 | | | | | | | | |
| 313: | 19107 | 3731 | 10544 | 1365 | 315 | 15072 | 9222 | 995 | 13810 | 10579 | 12184 | 1169 |
| | 10820 | 8682 | 17063 | 17115 | 11426 | 7610 | 8335 | 6680 | 19590 | 669 | 12808 | 2095 |
| | 3210 | 7981 | 8975 | 13797 | 19673 | 10108 | 12140 | 14891 | 4849 | 9589 | 10013 | 11489 |
| | 5848 | 8508 | 16961 | 14635 | 3335 | 5341 | 9626 | 18112 | 14644 | 12785 | 9168 | 9484 |
| | 8109 | 9837 | 3294 | 15636 | 3494 | 2017 | 19052 | 19769 | 16972 | 7811 | 19903 | 14579 |
| | 7377 | 4121 | 7557 | 13806 | 6626 | 9547 | 10641 | 12326 | 19729 | 7235 | 1411 | 3644 |
| | 10154 | 10157 | 2648 | 7794 | 10100 | 12628 | 15633 | 12168 | 7589 | 15853 | 4368 | 19745 |
| | 14933 | 10255 | 1291 | 17736 | 2414 | 7188 | 16138 | 9089 | 9415 | 11728 | 12818 | 6609 |
| | 8114 | 10065 | 12609 | 4638 | 16498 | 2517 | 12709 | 17410 | 17048 | 15136 | 16713 | 18469 |
| | 19832 | 12689 | 1479 | 15584 | 12811 | 17562 | 13267 | 13892 | 10949 | 9327 | 472 | 5713 |
| | 11273 | 9716 | 15698 | 5082 | 17282 | 1612 | 7565 | 10794 | 11434 | 8216 | 10240 | 6588 |
| | 15316 | 15700 | 6461 | 7231 | 10826 | 9945 | 1966 | 767 | 9017 | 8428 | 9216 | 1791 |
| | 12429 | 5223 | 4910 | 19009 | 13274 | 12648 | 16308 | 10486 | 4798 | 9611 | 5747 | 13303 |
| | 1346 | 2839 | 10642 | 10405 | 4049 | 4046 | 969 | 5871 | 13542 | 17764 | 7597 | 9272 |
| | 18722 | 14315 | 13433 | 12396 | 17102 | 19120 | 3267 | 2911 | 2934 | 2480 | 15593 | 1566 |
| | 15118 | 17099 | 13495 | 18798 | 16391 | 13630 | 12936 | 4072 | 17390 | 11981 | 12247 | 14556 |
| | 14559 | 12268 | 14558 | 14560 | 14577 | 12267 | 14576 | 12226 | 9387 | 332 | 2109 | 7841 |
| | 18828 | 9615 | 9388 | 17887 | 3007 | 11137 | 19936 | 14986 | 3553 | 4554 | 11929 | 16099 |
| | 5440 | 845 | 18184 | 2805 | 4097 | 18866 | 12066 | 14917 | 16033 | 3934 | 3003 | 1594 |
| | 10929 | 12343 | 16214 | 17420 | 5606 | 4643 | 10415 | 6601 | 15702 | 10449 | 19711 | 13552 |
| | 1507 | 19835 | 1698 | 9321 | 11696 | 2863 | 14802 | 17698 | 1498 | 17572 | 14405 | 13598 |
| | 12043 | 2262 | 567 | 1583 | 2618 | 3734 | 18793 | 19614 | 14449 | 16036 | 8175 | 19636 |
| | 13279 | 17286 | 5486 | 17542 | 9087 | 15980 | 2290 | 4878 | 11904 | 428 | 10747 | 9550 |
| | 13537 | 3804 | 8971 | 5843 | 3250 | 1514 | 18175 | 14056 | 11021 | 12535 | 9436 | 8113 |
| | 10697 | 15175 | 7725 | 13365 | 5679 | 15598 | 19442 | 16718 | 6306 | 9803 | 17134 | 10762 |
| | 2355 | 13282 | 9344 | 18414 | 962 | 10707 | 13732 | 15247 | 14944 | 8665 | 3901 | |
| | 12556 | 13238 | 3850 | 16213 | 15720 | 5407 | 7133 | 17222 | 15571 | 4342 | 952 | 16118 |
| | 708 | 14879 | 2997 | 19403 | 14894 | 498 | 14617 | 11730 | 18476 | 3794 | 6451 | 3609 |
| | 16585 | 3917 | 3066 | 11348 | 16371 | 13698 | 6380 | 5627 | 5614 | 3881 | 18493 | 6416 |
| | 12573 | 15178 | 7043 | 8200 | 17880 | 11947 | 15915 | 7621 | 7041 | 8209 | 18926 | 10681 |
| | 14294 | 3702 | 8567 | 18263 | 9236 | 1978 | 3932 | 19800 | 9976 | 13414 | 8046 | 11624 |

TABLE 2-continued

| SEQ ID NO: | homolog SEQ ID NOs | | | | | | | | | | |
|---|---|---|---|---|---|---|---|---|---|---|---|
| | 1429 | 3768 | 17319 | 17779 | 7609 | 16512 | 630 | 3171 | 7227 | 3551 | 9996 | 16499 |
| | 8855 | 13654 | 9117 | 3812 | 16292 | 19434 | 10320 | 5172 | 1982 | 3126 | 14582 | 9645 |
| | 1807 | 19478 | 7519 | 12941 | 17861 | 14481 | 4909 | 1899 | 3459 | 1922 | 19333 | 4083 |
| | 1541 | 12260 | 11304 | 16432 | 3209 | 9163 | 2838 | 17263 | 2745 | 9173 | 17072 | 5826 |
| | 7351 | 9534 | 19739 | 19536 | 7374 | 17185 | 14542 | 17759 | 5670 | 4857 | 6297 | 13448 |
| | 7546 | 11655 | 18214 | 11988 | 3497 | 12119 | 18421 | 2238 | 9138 | 8088 | 14015 | 6428 |
| | 10563 | 6419 | 14637 | 4955 | 9470 | 1521 | 11999 | 10694 | 314 | 18961 | 1819 | 15545 |
| | 10660 | 10122 | 4646 | 13358 | 18428 | 15805 | 12921 | 13439 | 13112 | 10688 | 18791 | 3218 |
| | 10153 | 5875 | 15881 | 14320 | 2938 | 13237 | 12193 | 16805 | 2072 | 13687 | 15276 | 12110 |
| | 9603 | 12516 | 3748 | 11719 | 18595 | 2719 | 7437 | 2981 | 5840 | 16220 | 2127 | 19699 |
| | 11867 | 10298 | 3040 | 4738 | 17635 | 17582 | 9714 | 2444 | 8326 | 10594 | 16463 | 11355 |
| | 16573 | 18034 | 10940 | 2168 | 14219 | 13085 | 7255 | 8220 | 15653 | 19511 | 18649 | 7840 |
| | 8684 | 2272 | 9676 | 5395 | 14310 | 13304 | 17528 | 4645 | 2741 | 19834 | 12291 | 3607 |
| | 4917 | 15188 | 1038 | 15537 | 16448 | 8891 | 10556 | 10553 | 13996 | 16085 | 16717 | 16720 |
| | 16629 | 3416 | 6712 | 18027 | 18028 | 18046 | 18045 | 18018 | 2046 | 2280 | 11438 | 7044 |
| | 432 | 17329 | 10580 | 2438 | 10575 | 2435 | 12466 | 13227 | 13331 | 3373 | 4354 | 1137 |
| | 14182 | 14180 | 17288 | 17285 | 17287 | 17309 | 18279 | 17281 | 5134 | 13133 | 13134 | 7591 |
| | 7579 | 7578 | 7590 | 7622 | 7593 | 7619 | 8710 | 11257 | 10155 | 17393 | 5497 | 7611 |
| | 7613 | 3368 | 3371 | 3345 | 3347 | 11146 | 3346 | 15875 | 3327 | 11270 | 617 | 12175 |
| | 15844 | 16942 | 6398 | 16524 | 14919 | 6019 | 6427 | 4568 | 13742 | 8545 | 8646 | 17237 |
| | 10441 | 15117 | 18131 | 812 | 16684 | 7548 | 4903 | 4891 | 11339 | 14205 | 916 | 13861 |
| | 4237 | 5869 | 14326 | 7059 | 9757 | 15666 | 8359 | 2239 | 6482 | 16408 | 10426 | 1600 |
| | 4339 | 9125 | 15701 | 10147 | 6375 | 17364 | 694 | 11598 | 14712 | 1946 | 16250 | 7313 |
| | 3680 | 8784 | 12459 | 4338 | 15013 | 3889 | 4760 | 2323 | 2136 | 16586 | 3470 | 11223 |
| | 13993 | 8676 | 4320 | 6154 | 958 | 7689 | 4997 | 6877 | 12357 | 17840 | 14977 | 10169 |
| | 1152 | 12474 | 11366 | 1049 | 7296 | 3453 | 823 | 1007 | 2433 | 5629 | 7080 | 8534 |
| | 2047 | 12554 | 18572 | 15080 | 13812 | 14010 | 15955 | 19762 | 16570 | 11714 | 12363 | 13476 |
| | 11640 | 13481 | 6845 | 19136 | 3340 | 15749 | 8548 | 16230 | 2819 | 2803 | 2874 | 2851 |
| | 2798 | 2774 | 2772 | 2847 | 2769 | 2801 | 11161 | 14362 | 3590 | 279 | 19320 | 14355 |
| | 13633 | 12071 | 4122 | 10856 | 1712 | 8501 | 2235 | 2242 | 2243 | 2245 | 18869 | 17430 |
| | 17096 | 16063 | 16061 | 4419 | 4399 | 7499 | 7500 | 7479 | 7507 | 7501 | 7478 | 2530 |
| | 9228 | 852 | 5988 | 15329 | 19925 | 15542 | 16445 | 15520 | 16918 | 16920 | 16451 | 14285 |
| | 15560 | 16922 | 3473 | 2729 | 2751 | 2748 | 2730 | 1449 | 6008 | 10997 | | |
| 314: | 19107 | 3731 | 10544 | 1365 | 3521 | 18558 | 315 | 15072 | 9222 | 995 | 13810 | 10579 |
| | 12184 | 1169 | 10820 | 8682 | 17063 | 17115 | 11426 | 7610 | 8335 | 6680 | 19590 | 669 |
| | 12808 | 2095 | 3210 | 7981 | 8975 | 13797 | 19673 | 10108 | 12140 | 14891 | 4849 | 9589 |
| | 10013 | 11489 | 5848 | 8508 | 16961 | 14635 | 3335 | 5341 | 9626 | 18112 | 14644 | 12785 |
| | 9168 | 9484 | 8109 | 9837 | 3294 | 15636 | 3494 | 2017 | 19052 | 19769 | 16972 | 7811 |
| | 19903 | 14579 | 7377 | 4121 | 7557 | 13806 | 6626 | 9547 | 7168 | 10641 | 12326 | 19729 |
| | 7235 | 1411 | 3644 | 10157 | 10154 | 2648 | 7794 | 10100 | 12628 | 15633 | 12168 | 7589 |
| | 15853 | 4368 | 19745 | 14933 | 10255 | 1291 | 17736 | 2414 | 7188 | 16138 | 9089 | 9415 |
| | 11728 | 12818 | 6609 | 8114 | 10065 | 12609 | 4638 | 16498 | 2517 | 12709 | 17410 | 17048 |
| | 15136 | 16713 | 18469 | 19832 | 12689 | 1479 | 15584 | 12811 | 17562 | 13267 | 13892 | 10949 |
| | 9327 | 472 | 5713 | 11273 | 9716 | 15698 | 5082 | 17282 | 1612 | 7565 | 10794 |
| | 11434 | 8216 | 10240 | 6588 | 15316 | 15700 | 6461 | 7231 | 10826 | 17284 | 9945 | 1966 |
| | 767 | 9017 | 8428 | 9216 | 1791 | 12429 | 5223 | 4910 | 19009 | 13274 | 12648 | 16308 |
| | 4798 | 9611 | 5747 | 13303 | 2839 | 10405 | 4049 | 4046 | 969 | 5871 | 13542 | 17764 |
| | 7597 | 9272 | 18722 | 14315 | 13433 | 12396 | 17102 | 19120 | 3267 | 2911 | 2934 | 2480 |
| | 15593 | 16755 | 1566 | 15118 | 17099 | 13495 | 18798 | 16391 | 13630 | 12936 | 4072 | 17390 |
| | 11981 | 14556 | 12247 | 14559 | 12268 | 14560 | 14577 | 14558 | 12267 | 14576 | 12226 | 9387 |
| | 332 | 2109 | 7841 | 18828 | 9615 | 17887 | 9388 | 3007 | 16099 | 12066 | 845 | 18184 |
| | 4097 | 18866 | 11137 | 19936 | 14986 | 3553 | 4554 | 11929 | 5440 | 2805 | 16033 | 3934 |
| | 3003 | 1594 | 10929 | 12343 | 16214 | 17420 | 5606 | 4643 | 10415 | 14917 | 6601 | 15702 |
| | 10449 | 19711 | 13552 | 1507 | 19835 | 1698 | 9321 | 11696 | 2863 | 14802 | 17698 | 1498 |
| | 17572 | 14405 | 13598 | 12043 | 2262 | 567 | 1583 | 2618 | 3734 | 18793 | 19614 | 14449 |
| | 16036 | 8175 | 19636 | 13279 | 17286 | 5486 | 17542 | 9087 | 15980 | 2290 | 4878 | 11904 |
| | 428 | 10747 | 9550 | 13537 | 3804 | 8971 | 5843 | 3250 | 1514 | 18175 | 14056 | 11021 |
| | 12535 | 9436 | 8113 | 10697 | 15175 | 7725 | 13365 | 5679 | 15598 | 19442 | 16718 | 6306 |
| | 9803 | 17134 | 10762 | 2355 | 13282 | 9344 | 18414 | 962 | 10707 | 3609 | 13732 | 15247 |
| | 16140 | 14944 | 8665 | 3901 | 12556 | 13238 | 3850 | 16213 | 15720 | 5407 | 7133 | 17222 |
| | 15571 | 4342 | 952 | 16118 | 708 | 14879 | 19403 | 2997 | 14894 | 498 | 14617 | 11730 |
| | 18476 | 3794 | 6451 | 16585 | 3917 | 3066 | 16371 | 13698 | 6380 | 5627 | 5614 | 3881 |
| | 18493 | 6416 | 12573 | 15178 | 11348 | 7043 | 8200 | 17880 | 11947 | 15915 | 7621 | 7041 |
| | 8209 | 18926 | 10681 | 14294 | 3702 | 8567 | 18263 | 9236 | 1978 | 3932 | 19800 | 9976 |
| | 13414 | 8046 | 11624 | 1429 | 3768 | 17319 | 17779 | 7609 | 16512 | 630 | 3171 | 7227 |
| | 3551 | 9996 | 16499 | 8855 | 13654 | 9117 | 3812 | 16292 | 19434 | 10320 | 5172 | 1982 |
| | 3126 | 14582 | 9645 | 1807 | 19478 | 7519 | 12941 | 17861 | 14481 | 4909 | 1899 | 3459 |
| | 1922 | 19333 | 4083 | 1541 | 12260 | 11304 | 16432 | 3209 | 9163 | 2838 | 17263 | 2745 |
| | 9173 | 17072 | 5826 | 7351 | 9534 | 19739 | 19536 | 7374 | 17185 | 14542 | 17759 | 5670 |
| | 4857 | 6297 | 13448 | 7546 | 11655 | 18214 | 11988 | 3497 | 12119 | 18421 | 2238 | 9138 |
| | 8088 | 14015 | 6428 | 10563 | 6419 | 14637 | 4955 | 9470 | 6734 | 1521 | 11999 | 10694 |
| | 1819 | 15545 | 10660 | 10122 | 4646 | 13358 | 12921 | 18428 | 15805 | 10688 | 13439 | 13112 |
| | 10153 | 5875 | 3218 | 18791 | 2938 | 12193 | 15881 | 16805 | 14320 | 13237 | 2072 | 13687 |
| | 15276 | 12110 | 9603 | 12516 | 3748 | 11719 | 18595 | 2719 | 7437 | 2981 | 5840 | 16220 |
| | 19699 | 10298 | 2127 | 3040 | 11867 | 4738 | 17635 | 17582 | 9714 | 2444 | 10594 | 8326 |
| | 16463 | 11355 | 16573 | 10940 | 2168 | 14219 | 13085 | 7255 | 18034 | 15653 | 19511 | 18649 |
| | 7840 | 8220 | 2272 | 9676 | 5395 | 14310 | 8684 | 4645 | 2741 | 19834 | 12291 | 4917 |
| | 15188 | 3607 | 13304 | 1038 | 15537 | 16448 | 8891 | 10556 | 10553 | 13996 | 16085 | 16717 |

TABLE 2-continued

| SEQ ID NO: | homolog SEQ ID NOs | | | | | | | | | | |
|---|---|---|---|---|---|---|---|---|---|---|---|
| | 16720 | 16629 | 3416 | 6712 | 18028 | 18027 | 18046 | 18045 | 18018 | 2046 | 2280 | 11438 |
| | 7044 | 432 | 17329 | 10580 | 2438 | 10575 | 2435 | 12466 | 13227 | 13331 | 3373 | 4354 |
| | 1137 | 14182 | 14180 | 17288 | 17285 | 17287 | 17309 | 18279 | 17281 | 5134 | 13133 | 13134 |
| | 7591 | 7579 | 7578 | 7590 | 7622 | 7593 | 7619 | 8710 | 11257 | 10155 | 17393 | 5497 |
| | 7611 | 7613 | 3368 | 3371 | 3345 | 3347 | 11146 | 3346 | 3327 | 11270 | 15875 | 617 |
| | 12175 | 15844 | 16942 | 6398 | 16524 | 14919 | 6019 | 6427 | 4568 | 13742 | 8545 | 17237 |
| | 8646 | 812 | 10441 | 15117 | 16684 | 7548 | 11339 | 18131 | 4903 | 4891 | 14205 | 916 |
| | 13861 | 14326 | 4760 | 4997 | 7059 | 9757 | 15666 | 8359 | 2239 | 6482 | 16408 | 10426 |
| | 1600 | 4339 | 9125 | 15701 | 10147 | 6375 | 17364 | 694 | 5869 | 11598 | 14712 | 1946 |
| | 16250 | 7313 | 4800 | 3680 | 8784 | 12459 | 4338 | 15013 | 3889 | 2323 | 2136 | 16586 |
| | 3470 | 11223 | 13993 | 8676 | 4320 | 6154 | 958 | 7689 | 6877 | 12357 | 17840 | 14977 |
| | 10169 | 1152 | 12474 | 11366 | 1049 | 7296 | 3453 | 16153 | 10586 | 1007 | 2433 | 5629 |
| | 7080 | 8534 | 2047 | 12554 | 18572 | 15080 | 13812 | 14010 | 15955 | 823 | 19762 | 16570 |
| | 11714 | 12363 | 13476 | 13481 | 6845 | 19136 | 3340 | 15749 | 8548 | 16230 | 2803 | 2874 |
| | 2819 | 2798 | 2851 | 2774 | 2772 | 2847 | 2769 | 2801 | 11161 | 14362 | 3590 | 279 |
| | 19320 | 14355 | 13633 | 12071 | 1712 | 8501 | 2235 | 2242 | 2245 | 2243 | 18869 | 17430 |
| | 17096 | 16063 | 16061 | 4419 | 4399 | 7500 | 7499 | 7479 | 7507 | 7501 | 7478 | 2530 |
| | 9228 | 852 | 5988 | 15329 | 19925 | 15542 | 15520 | 16445 | 16918 | 14285 | 16922 | 15560 |
| | 3473 | 2729 | 2751 | 2748 | 2730 | 1449 | 313 | 6008 | 10997 | 18961 | | |
| 315: | 2185 | 11361 | 5661 | 8686 | 17264 | 8328 | 8330 | 7550 | 10232 | 18956 | 1696 | 5922 |
| | 16632 | 14340 | 10579 | 4523 | 1169 | 11996 | 8012 | 4522 | 16791 | 8335 | 10038 | 5066 |
| | 4969 | 4634 | 17213 | 14401 | 7284 | 2099 | 15619 | 17243 | 6718 | 8030 | 14321 | 1903 |
| | 15554 | 15028 | 12204 | 3060 | 19178 | 11653 | 9316 | 17858 | 18132 | 18589 | 9667 |
| | 17297 | 5418 | 17508 | 15450 | 6147 | 5012 | 18588 | 18020 | 862 | 4920 | 15050 | 16525 |
| | 3064 | 2884 | 5607 | 12297 | 11396 | 18052 | 2912 | 17060 | 1697 | 17604 | 18870 | 8264 |
| | 17736 | 1732 | 5968 | 5593 | 15864 | 18761 | 4044 | 5088 | 17149 | 10593 | 5242 | 4527 |
| | 13682 | 8054 | 16503 | 1962 | 19380 | 1623 | 10664 | 4597 | 15319 | 3478 | 16945 | 18584 |
| | 3108 | 12724 | 15546 | 15764 | 15754 | 18354 | 18416 | 4890 | 19678 | 19130 | 15532 | 5213 |
| | 11374 | 9753 | 14702 | 15217 | 17235 | 15921 | 5855 | 18752 | 1904 | 15721 | 18203 | 18156 |
| | 18864 | 8700 | 7560 | 16924 | 636 | 6811 | 16379 | 19046 | 11063 | 10405 | 4049 | 4046 |
| | 969 | 14929 | 16207 | 7597 | 9272 | 15425 | 17368 | 11052 | 14975 | 6574 | 9560 | 10349 |
| | 3830 | 8250 | 2911 | 2934 | 2015 | 18785 | 8645 | 8196 | 7713 | 11586 | 14490 | 18301 |
| | 18792 | 15378 | 7699 | 18803 | 19816 | 16104 | 14468 | 17390 | 11981 | 14556 | 12247 | 14559 |
| | 12268 | 14560 | 14577 | 14558 | 12267 | 14576 | 15277 | 12222 | 16710 | 12224 | 12226 | 9387 |
| | 332 | 17612 | 2109 | 7841 | 18828 | 11556 | 1969 | 9578 | 7424 | 5369 | 245 | 18873 |
| | 16602 | 11137 | 19936 | 14986 | 3553 | 4554 | 11929 | 5440 | 2805 | 12674 | 16033 | 3934 |
| | 3003 | 1594 | 10929 | 12343 | 16214 | 17420 | 5606 | 4643 | 10415 | 14917 | 6601 | 15702 |
| | 10449 | 19711 | 13552 | 2863 | 1507 | 19835 | 1698 | 9321 | 11696 | 14802 | 17698 | 1498 |
| | 17572 | 14405 | 13598 | 12043 | 2262 | 567 | 1583 | 2618 | 3734 | 18793 | 19614 | 14449 |
| | 16036 | 8175 | 19636 | 13279 | 17286 | 5486 | 17542 | 9087 | 15980 | 2290 | 4878 | 11904 |
| | 428 | 10747 | 9550 | 13537 | 3804 | 8971 | 5843 | 3250 | 1514 | 18175 | 14056 | 11021 |
| | 12535 | 9436 | 8113 | 10697 | 15175 | 7725 | 13365 | 5679 | 15598 | 19442 | 16718 | 6306 |
| | 9803 | 17134 | 10762 | 2355 | 13282 | 9344 | 18414 | 962 | 10707 | 13732 | 15247 | 16140 |
| | 14944 | 8665 | 3901 | 12556 | 13238 | 3850 | 16213 | 15720 | 5407 | 7133 | 17222 | 15571 |
| | 4342 | 952 | 16118 | 708 | 14879 | 19403 | 2997 | 14894 | 13269 | 498 | 14617 | 11730 |
| | 18476 | 3794 | 6451 | 4601 | 7256 | 19396 | 2011 | 16585 | 3917 | 3066 | 16371 | 13698 |
| | 6380 | 5627 | 5614 | 3881 | 18493 | 6416 | 12573 | 15178 | 8209 | 11348 | 7043 | 8200 |
| | 17880 | 11947 | 15915 | 7621 | 7041 | 18926 | 10681 | 14294 | 3702 | 8567 | 18263 | 9236 |
| | 1978 | 3932 | 19800 | 9976 | 13414 | 8046 | 11624 | 1429 | 3768 | 17319 | 17779 | 7609 |
| | 16512 | 630 | 3171 | 7227 | 3551 | 9996 | 16499 | 8855 | 13654 | 9117 | 3812 | 16292 |
| | 19434 | 10320 | 5172 | 1982 | 3126 | 14582 | 9645 | 1807 | 19478 | 7519 | 12941 | 17861 |
| | 14481 | 4909 | 1899 | 3459 | 1922 | 19333 | 4083 | 1541 | 11695 | 12260 | 11304 | 16432 |
| | 6090 | 18117 | 19599 | 18305 | 3209 | 9163 | 2838 | 17263 | 2745 | 9173 | 17072 | 5826 |
| | 7351 | 9534 | 19739 | 19536 | 7374 | 17185 | 14542 | 17759 | 5670 | 4857 | 6297 | 13448 |
| | 7546 | 11655 | 18214 | 11988 | 3497 | 12119 | 18421 | 2238 | 15982 | 9138 | 8088 | 14015 |
| | 6428 | 10563 | 6419 | 14637 | 4955 | 15467 | 9470 | 1521 | 11999 | 10694 | 314 | 1765 |
| | 1819 | 4359 | 18984 | 14947 | 13368 | 6080 | 8594 | 12041 | 17552 | 5525 | 3665 | 12817 |
| | 1783 | 2890 | 18428 | 15805 | 9454 | 10688 | 13439 | 13112 | 10153 | 5875 | 3218 | 18791 |
| | 2938 | 12193 | 15881 | 16805 | 18770 | 14320 | 13237 | 2072 | 10668 | 13687 | 15276 | 12110 |
| | 9603 | 12516 | 3748 | 11719 | 18595 | 2719 | 7437 | 2981 | 5840 | 16220 | 19699 | 10298 |
| | 2127 | 3040 | 11867 | 4738 | 17635 | 17582 | 2444 | 9714 | 10594 | 8326 | 16463 | 16175 |
| | 11355 | 16573 | 10940 | 2168 | 14219 | 13085 | 7255 | 18034 | 15653 | 19511 | 18649 | 7840 |
| | 8220 | 2272 | 9676 | 5395 | 14310 | 8684 | 4645 | 2741 | 19834 | 12291 | 1038 | 15537 |
| | 16448 | 8891 | 10556 | 10553 | 13996 | 16085 | 8752 | 6235 | 10378 | 16031 | 9773 | 9748 |
| | 8634 | 1983 | 5010 | 16717 | 16720 | 16629 | 3416 | 6712 | 18028 | 18027 | 18046 | 18045 |
| | 2247 | 17307 | 5751 | 13958 | 2046 | 2280 | 11815 | 11438 | 7044 | 432 | 17329 | 10580 |
| | 2438 | 10575 | 2435 | 12466 | 13227 | 13331 | 3373 | 4354 | 1137 | 14182 | 14180 | 1685 |
| | 6522 | 17288 | 17285 | 17287 | 17309 | 18279 | 17281 | 5134 | 13133 | 13134 | 7591 | 7579 |
| | 7578 | 7590 | 7622 | 7593 | 7619 | 11257 | 10136 | 10155 | 17393 | 5497 | 7611 |
| | 7613 | 3368 | 3371 | 3345 | 3347 | 11146 | 3346 | 3342 | 14996 | 9789 | 7217 | 2775 |
| | 6179 | 6205 | 617 | 5167 | 7673 | 18690 | 12874 | 2313 | 15844 | 16942 | 6398 | 16524 |
| | 14919 | 6019 | 6427 | 13742 | 5524 | 12408 | 15818 | 13998 | 17952 | 15058 | 2676 | 443 |
| | 16567 | 8545 | 9337 | 11440 | 6373 | 12996 | 16653 | 18303 | 8646 | 8910 | 18008 | 14978 |
| | 10441 | 2409 | 16827 | 2374 | 16684 | 7548 | 18131 | 4903 | 4891 | 11339 | 14205 | 916 |
| | 13861 | 14326 | 7296 | 2136 | 7059 | 9757 | 15666 | 8359 | 2239 | 6482 | 1101 | 8053 |
| | 8470 | 8156 | 10487 | 1094 | 11152 | 5629 | 7080 | 6211 | 8534 | 2047 | 12554 | 18572 |
| | 15080 | 13812 | 14010 | 15955 | 9662 | 19762 | 16570 | 11714 | 2862 | 11347 | 12363 | 2885 |
| | 13476 | 19136 | 3340 | 13481 | 6845 | 8548 | 16230 | 15749 | 18141 | 2803 | 2874 | 2819 |

TABLE 2-continued

| SEQ ID NO: | homolog SEQ ID NOs | | | | | | | | | | |
|---|---|---|---|---|---|---|---|---|---|---|---|
| | 2798 | 2851 | 2774 | 2772 | 2847 | 2769 | 2801 | 11161 | 14362 | 6202 | 8537 | 8518 |
| | 7037 | 8133 | 6764 | 827 | 279 | 4941 | 1712 | 818 | 19365 | 8356 | 7588 | 3017 |
| | 2235 | 2242 | 2245 | 2243 | 18869 | 6400 | 5637 | 915 | 8416 | 12444 | 510 | 12026 |
| | 11634 | 16063 | 16061 | 4419 | 4399 | 7500 | 7499 | 7479 | 7507 | 7501 | 7478 | 2530 |
| | 9859 | 1460 | 18194 | 11314 | 2685 | 4226 | 15542 | 19925 | 15520 | 16922 | 15560 | 5221 |
| | 8058 | 14961 | 984 | 19513 | 2729 | 2751 | 2748 | 2730 | 8932 | 313 | 12905 | 6008 |
| | 4112 | 8720 | | | | | | | | | | |
| 316: | 5462 | 8702 | 15896 | 14144 | 15464 | 19725 | 9380 | 4042 | 545 | 16095 | 1526 | 8816 |
| | 16014 | 8322 | 3022 | 1553 | 2635 | 18516 | 10285 | 6421 | 5546 | 6489 | 8482 | 8478 |
| | 5585 | 16227 | 2190 | 10760 | 1465 | 2255 | 11395 | 7990 | 14793 | 10172 | 16192 | 7992 |
| | 12560 | 3462 | 14906 | 12272 | 16970 | 2134 | 2867 | 2758 | 7489 | 6672 | 10233 | 12166 |
| | 15802 | 1638 | 918 | 18996 | 2473 | 4032 | 8620 | 3162 | 3756 | 12149 | 13374 | 1308 |
| | 1307 | 11769 | 13333 | 10034 | 11874 | 12574 | 4659 | 9026 | 13327 | 2753 | 14426 | 2429 |
| | 11931 | 6246 | 16533 | 2250 | 3513 | 4318 | 4974 | 3869 | 15232 | 3820 | 4665 | 16608 |
| | 13406 | 16766 | 3671 | 4310 | 8986 | 18992 | 8995 | 19933 | 19932 | 8988 | 7545 | 3888 |
| | 1293 | 17163 | 11580 | 4168 | 4167 | 16335 | 4007 | 13342 | 13297 | 2864 | 13882 | 15220 |
| | 6521 | 15457 | 12531 | 12431 | 4213 | 7363 | 7483 | 7328 | 2936 | 8542 | 8532 | 1997 |
| | 2463 | 1996 | 7728 | 9652 | 15509 | 7851 | 12529 | 2192 | 8974 | 9761 | 13146 | 8836 |
| | 9376 | 9401 | 2717 | 11802 | 11806 | 2558 | 2553 | 18119 | 3929 | 423 | 19081 | 8210 |
| | 9326 | 5275 | 14503 | 3110 | 14226 | 5291 | 5571 | 4513 | 5138 | 6994 | 5137 | 17365 |
| | 1785 | 5345 | 11683 | 6635 | 7064 | 18861 | 13492 | 12133 | 805 | 10146 | 9632 | 15755 |
| | 16143 | 8100 | 13038 | 16967 | 19575 | 19594 | 3996 | 16196 | 1721 | 16725 | 14719 | 12580 |
| | 11240 | 5778 | 618 | 8966 | 8955 | 19713 | 9948 | 3468 | 7625 | 7884 | 16898 | 1191 |
| | 18670 | 7152 | 18629 | 2566 | 12157 | 3148 | 14714 | 9023 | 16483 | 14008 | 17781 | 13594 |
| | 7412 | 4148 | 15789 | 2191 | 19158 | 8063 | 16731 | 853 | 6697 | 3043 | 4675 | 3548 |
| | 5951 | 5342 | 3186 | 6258 | 12561 | 3976 | 16231 | 7192 | 3154 | 16854 | 9100 | 11130 |
| | 3448 | 9146 | 12098 | 14067 | 15841 | 18357 | 879 | 3661 | 7236 | 1239 | 14934 | 1964 |
| | 8301 | 13913 | 18880 | 2792 | 2960 | 8392 | 12600 | 19792 | 13251 | 1556 | 8938 | 11739 |
| | 11738 | 17186 | 14126 | 8704 | 6167 | 15076 | 7923 | 10995 | 8699 | 4137 | 19459 | 2768 |
| | 11490 | 2285 | 468 | 3256 | 3962 | 3526 | 6749 | 785 | 4270 | 18693 | 14414 | 12394 |
| | 15009 | 15406 | 7292 | 12653 | 1253 | 9468 | 10332 | 19444 | 7625 | 16015 | 5343 | 16491 |
| | 5692 | 14537 | 13107 | 10267 | 5745 | 11145 | 6063 | 13844 | 12413 | 7513 | 1555 | 19155 |
| | 8411 | 14705 | 6809 | 12611 | 16041 | 16179 | 16590 | 16403 | 14059 | 5845 | 15694 | 17067 |
| | 9812 | 2968 | 9811 | 11761 | 5358 | 7512 | 10371 | 10369 | 6536 | 5488 | 6872 | 5893 |
| | 5937 | 18324 | 3446 | 15225 | 17313 | 18360 | 16566 | 17334 | 12104 | 16784 | 4519 | 11690 |
| | 1160 | 2536 | 14367 | 18839 | 10104 | 11824 | 2933 | 10654 | 19865 | 12293 | 12274 | 12271 |
| | 7670 | 10692 | 7530 | 2086 | 7632 | 7453 | 5948 | 6608 | 10756 | 17250 | 3010 | 4463 |
| | 3520 | 2896 | 3517 | 10296 | 1847 | 11132 | 11288 | 6317 | 16569 | 19515 | 4801 | 16530 |
| | 3438 | 12214 | 12211 | 3078 | 7475 | 6795 | 4591 | 15447 | | | | |
| 317: | 2231 | 3383 | 14866 | 16544 | 7418 | 9107 | 4315 | 9446 | 19269 | | | |
| 318: | 4830 | 2716 | 9062 | 17385 | 658 | 13025 | 18942 | 1913 | 7312 | 19788 | 1716 | 3538 |
| | 4143 | 17321 | 815 | 18938 | 9848 | 2344 | 5906 | 7890 | 446 | 6885 | 11380 | 759 |
| | 13452 | 4140 | 13032 | 458 | 17467 | 1500 | 8433 | 6737 | 15173 | 681 | 2424 | 16493 |
| 320: | 1136 | 7051 | 5444 | 7050 | 15227 | 18825 | 10186 | 7331 | 7329 | 11868 | 7003 | 6249 |
| | 4750 | 4038 | 15916 | 19050 | 15491 | 14585 | 17723 | 15235 | 17636 | 18713 | 18024 | 13564 |
| | 3655 | 7523 | 2416 | | | | | | | | | |
| 321: | 15725 | 14852 | 5781 | 6187 | 9364 | 6675 | 12873 | 12050 | 2178 | 18054 | 18447 | 870 |
| | 12686 | 19055 | 13293 | 6047 | 3502 | 15480 | 6688 | 6643 | 16132 | 12103 | 18489 | 19742 |
| | 17678 | 2836 | 12364 | 8309 | 14776 | 7846 | 17350 | 17117 | 11028 | 7278 | 1841 | |
| 322: | 19529 | 18972 | 10678 | 6073 | 19135 | 18539 | 10466 | 12487 | 17080 | 14595 | 7367 | 8165 |
| | 4913 | 16318 | 11781 | | | | | | | | | |
| 323: | 9079 | 9955 | 19786 | 2490 | 2106 | 6931 | 4177 | 11411 | 14494 | 401 | 16768 | 10346 |
| 324: | 11512 | 8262 | 6323 | 11449 | 12376 | 15280 | 6345 | 6342 | 6758 | 18459 | 5739 | 3469 |
| | 6326 | 6372 | 4249 | 12966 | 5720 | 5704 | 5725 | 5724 | 5756 | 5810 | 5785 | 5764 |
| | 5783 | 5788 | 5723 | 5727 | 11451 | 8412 | 19543 | 15504 | 16837 | 1442 | 3587 | 7395 |
| | 11317 | 13364 | 750 | 15231 | 7715 | 3807 | 7915 | 8643 | 10574 | 16564 | 2736 | 16086 |
| | 7850 | 13459 | 10318 | 9779 | 731 | 10396 | 10077 | 6470 | 798 | 7137 | 6756 | 6754 |
| | 14009 | 17356 | 13319 | 2236 | 18981 | 17018 | 6664 | 803 | 19647 | 1274 | 15145 | 18856 |
| | 9265 | 1809 | 1806 | 1811 | 9896 | 17998 | 8581 | 15642 | 5684 | 17295 | 7254 | 7960 |
| | 5636 | 8730 | 9734 | 9831 | 19625 | 7753 | 8179 | 7998 | 5300 | 6623 | 12543 | 16137 |
| | 18696 | 5777 | 1167 | 4524 | 1077 | 11970 | 3765 | 4567 | 14316 | 9593 | 16226 | 5513 |
| | 12102 | 3788 | 19164 | 15971 | 3631 | 12022 | 13285 | 9219 | 5808 | 2023 | 12867 | 12139 |
| | 14800 | 9148 | 9151 | 5703 | 19445 | 3505 | 1417 | 9937 | 12900 | 5835 | 8793 | 17627 |
| | 9980 | 10119 | 15928 | 3285 | 12749 | 534 | 19027 | 7116 | 10086 | 3784 | 18420 | 9372 |
| | 3809 | 16983 | 19749 | 4147 | 2561 | 14685 | 19010 | 6508 | 15932 | 1043 | 8298 | 15444 |
| | 13412 | 8608 | 15947 | 13976 | 8067 | 3584 | 19918 | 10353 | 11595 | 11284 | 14370 | 8853 |
| | 4973 | 8385 | 5589 | 1798 | 1207 | 509 | 7947 | 11095 | 15540 | 3437 | 7615 | 7612 |
| | 10821 | 10244 | 18075 | 7438 | 19651 | 8598 | 9205 | 7814 | 14515 | 14553 | 7875 | 9013 |
| | 4551 | 17654 | 6535 | 4686 | 15510 | 9928 | 14939 | 9130 | 13820 | 10857 | 11701 | 13734 |
| | 9606 | 633 | 7757 | 10685 | 964 | 7436 | 502 | 18371 | 10090 | 18370 | 5553 | 15365 |
| | 16452 | 3436 | 13450 | 1356 | 18559 | 15301 | 2361 | 18638 | 10471 | 17333 | 9747 | 13715 |
| | 12322 | 6368 | 6349 | 6775 | 6779 | 6773 | 6777 | 7269 | 6774 | 7262 | 6328 | 17232 |
| | 17226 | 17209 | 17212 | 17211 | 5741 | 6348 | 6476 | 6344 | 4157 | 7574 | 8332 |
| | 6766 | 5759 | 5760 | 12701 | 2721 | 10839 | 17534 | 8451 | 14104 | 12537 | 13141 | 14902 |
| | 14903 | 4314 | 14916 | 4309 | 13007 | 10518 | 3401 | 7876 | 1104 | 8383 | 14730 | 14720 |
| | 12059 | 1106 | 6982 | 1031 | 15090 | 15093 | 6907 | 17634 | 8009 | 484 | 7723 | 1281 |
| | 5926 | 776 | 6614 | 7009 | 15697 | 12348 | 13028 | 2330 | 12655 | 15081 | 6495 | 13560 |
| | 18571 | 14791 | 19199 | 6442 | 7955 | 9241 | 7078 | 6798 | 10503 | 15218 | 8382 | 19172 |

TABLE 2-continued

| SEQ ID NO: | homolog SEQ ID NOs | | | | | | | | | | |
|---|---|---|---|---|---|---|---|---|---|---|---|
| | 938 | 11115 | 6504 | 5016 | 5836 | 18241 | 7022 | 17216 | 3591 | 6384 | 2085 | 8286 |
| | 9708 | 14861 | 18111 | 4952 | 13581 | 14185 | 2853 | 14506 | 14516 | 6690 | 10730 | 1934 |
| | 2612 | 10612 | 11767 | 14612 | 3998 | 3009 | 16097 | 19296 | 15380 | 18005 | 12479 | 8182 |
| | 4663 | 14202 | 1064 | 1476 | 5622 | 11833 | 13437 | 12832 | 3282 | 17447 | 4447 | 5740 |
| | 1103 | 6324 | 5794 | 13746 | 19613 | 13540 | 3119 | | | | | |
| 325: | 16615 | 14754 | 4057 | 8715 | 5965 | 14877 | 1866 | 8104 | 17176 | 4366 | 14518 | 9167 |
| | 9065 | 10806 | 584 | 14195 | 17198 | 8201 | 4762 | 17268 | 2697 | 6174 | 2254 | 8981 |
| | 13193 | 12420 | 6622 | 8325 | 5839 | 16464 | 6347 | 11709 | 18411 | 6294 | 10583 | |
| 326: | 11367 | 14736 | 13964 | 6308 | 3036 | 11437 | 10175 | 5974 | 9622 | 2625 | 2363 | 10917 |
| | 11431 | 9207 | 5827 | 1582 | 5507 | | | | | | | |
| 327: | 10691 | 6846 | 18734 | 10944 | 7446 | 14465 | 1433 | 5628 | 16454 | 18586 | 10494 | 17172 |
| | 7904 | 9524 | 7196 | 17084 | 9159 | 445 | 5749 | | | | | |
| 328: | 1385 | 15829 | 19449 | 11943 | 5936 | 18464 | 6928 | 7520 | 1074 | 12457 | 797 | 5586 |
| | 11159 | 6704 | 13511 | 5517 | 4980 | 15756 | 19404 | 11162 | 11144 | 11682 | 8750 | 6782 |
| | 14571 | 796 | 7484 | 18881 | 2581 | 19645 | 16081 | 10523 | 17997 | 6738 | 18661 | 512 |
| | 13506 | 959 | 14965 | 17458 | 6459 | 1020 | 16188 | 3545 | 7761 | 17240 | 19190 | 3663 |
| | 4263 | 17715 | 14220 | | | | | | | | | |
| 329: | 8714 | 3717 | 5566 | 10565 | 1859 | 668 | 9746 | 12025 | 1427 | 7417 | 530 | 14121 |
| | 7988 | 11832 | 3990 | 15583 | 10329 | 7800 | 2906 | 9120 | 14177 | 14111 | 16467 | 2762 |
| | 4786 | 19733 | 3949 | 3152 | 8034 | 16589 | 3235 | 4766 | 6719 | 8060 | 10844 | 12009 |
| | 12714 | 15999 | 13202 | 19675 | 9263 | 15341 | 11412 | 11538 | 1175 | 13971 | 9989 | 3509 |
| | 7314 | 9081 | 5349 | 6882 | 4703 | 8235 | 2796 | 5908 | 10247 | 12378 | 16419 | 16844 |
| | 12799 | 14375 | 5098 | 6430 | 9862 | 12923 | 12774 | 18038 | 9506 | 4345 | 14983 | 1075 |
| | 17160 | 6513 | 3472 | 1454 | 13829 | 6880 | 6497 | 17891 | 11910 | 6204 | 10379 | 14721 |
| | 14990 | 10513 | 5022 | 5978 | 10881 | 5325 | 4900 | 11308 | 9150 | 18664 | 5881 | 12552 |
| | 6583 | 6062 | 13051 | 8792 | 15886 | 882 | 6896 | 2502 | 9724 | 4391 | 16217 | 12349 |
| | 5780 | 2148 | 13289 | 1827 | 6149 | 7304 | 5083 | 12091 | 2946 | 7643 | 17480 | 13408 |
| | 14394 | 7079 | 11009 | 5514 | 9020 | 19826 | 17411 | 8276 | 9974 | 16420 | 12687 | 6975 |
| | 522 | 5006 | 10709 | 7584 | 18456 | 15757 | 4215 | 10986 | 2166 | 5442 | 6286 | 9293 |
| | 9482 | 944 | 7759 | 18574 | 18169 | 6499 | 4685 | 7873 | 8584 | 17543 | 9884 | 7382 |
| | 7352 | 7061 | 17128 | 14603 | 3906 | 11674 | 10746 | 1503 | 13826 | 14262 | 12721 | 17380 |
| | 11192 | 13270 | 15052 | 9833 | 12894 | 19206 | 19502 | 19182 | 12719 | 6650 | 17024 | 11885 |
| | 12688 | 5510 | 1496 | 14710 | 18472 | 12216 | 4163 | 6189 | 13422 | 1597 | 8924 | 12843 |
| | 10721 | 10028 | 1759 | 14239 | 14549 | 4604 | 10040 | 7920 | 1403 | 10667 | 14918 | 7430 |
| | 13189 | 11618 | 14583 | 3524 | 4966 | 17459 | 839 | 13522 | 3834 | 6998 | 2999 | 6865 |
| | 7167 | 13043 | 1901 | 11888 | 1209 | 6472 | 14813 | 788 | 3885 | 3956 | 7158 | 18767 |
| | 16576 | 15007 | 18092 | 16591 | 6954 | 6172 | 3857 | 2555 | 2459 | 2669 | 18256 | 10830 |
| | 6666 | 8480 | 11442 | 12577 | 9271 | 14060 | 9245 | 14655 | 15710 | 17030 | 7711 | 7709 |
| | 3351 | 6487 | 4533 | 2082 | 17184 | 8698 | 14994 | 13896 | 7835 | 8142 | 814 | 14855 |
| | 3617 | 935 | 10433 | 15296 | 18619 | 17848 | 3434 | 4185 | 18019 | 521 | 13339 | 14025 |
| | 5754 | 12949 | 10467 | 9496 | 5158 | 19096 | 2135 | 576 | 993 | 12906 | 11309 | 11504 |
| | 5691 | 9623 | 12589 | 3192 | 8950 | 6480 | 10293 | 11074 | 16003 | 19115 | 966 | 1849 |
| | 14063 | 14904 | 657 | 1848 | 16007 | 14717 | 4142 | 16489 | 12381 | 2754 | 8869 | 14112 |
| | 8121 | 19313 | 10861 | 19088 | 3712 | 6558 | 7559 | 10653 | 9717 | 16715 | 18087 | 10084 |
| | 17845 | 19383 | 16584 | 14634 | 8560 | 18766 | 7631 | 18659 | 1540 | 9731 | 6883 | 17687 |
| | 15181 | 15549 | 6519 | 11663 | 486 | 13767 | 15635 | 13224 | 15907 | 5070 | 10188 | 9295 |
| | 9297 | 19656 | 13831 | 9250 | 18896 | 6462 | 10456 | 4816 | 6498 | 11564 | 14166 | 10726 |
| | 13462 | 2420 | 6005 | 5935 | 11870 | 8991 | 1892 | 3542 | 12006 | 14673 | 1339 | 15348 |
| | 11771 | 7607 | 19801 | 18944 | 7773 | 6641 | 18882 | 7567 | 18085 | 12565 | | |
| 330: | 904 | 12835 | 3861 | 1482 | 5979 | 9709 | 13954 | 6123 | 6143 | 16986 | 17855 | 18668 |
| | 1909 | 5240 | 12004 | 9616 | 16459 | 11407 | 4107 | 15822 | 4812 | 9206 | 13190 | 986 |
| | 738 | 8516 | 7209 | 9218 | 9155 | 15166 | 1046 | 9972 | 9234 | 14160 | 10926 | 9007 |
| | 12402 | 13404 | 14565 | 1314 | | | | | | | | |
| 331: | 14505 | 19187 | 14237 | 2004 | 13667 | 15330 | 8712 | 2983 | 10833 | 6141 | 8832 | 10908 |
| | 14924 | 5518 | 1621 | 10016 | 549 | 17499 | 11318 | 10215 | 16348 | 19205 | 15747 | 5139 |
| | 1782 | 19628 | 11628 | 15831 | 15263 | 14491 | 13634 | 7647 | 10268 | 16730 | 6410 | 1484 |
| | 1366 | 16382 | 14778 | 1874 | | | | | | | | |
| 332: | 625 | 19038 | 18542 | 16881 | 3521 | 18558 | 315 | 11296 | 10579 | 14173 | 1169 | 11180 |
| | 14471 | 696 | 8335 | 11062 | 1469 | 7394 | 18110 | 7821 | 19076 | 5860 | 4906 | 11277 |
| | 2138 | 9025 | 2195 | 14684 | 8109 | 11176 | 9010 | 14713 | 5710 | 3301 | 16679 | 1176 |
| | 8811 | 8290 | 4792 | 18465 | 8807 | 17003 | 8983 | 9258 | 15527 | 15529 | 14912 | 17091 |
| | 17736 | 13621 | 7248 | 8229 | 8007 | 10799 | 19406 | 11113 | 13933 | 9338 | 9443 | 15873 |
| | 16790 | 5467 | 4303 | 11067 | 15230 | 15245 | 17641 | 9012 | 19616 | 6000 | 14666 | 2725 |
| | 14734 | 17332 | 12078 | 13496 | 13912 | 13472 | 10405 | 4049 | 4046 | 969 | 16147 | 12289 |
| | 7597 | 9272 | 835 | 17757 | 15353 | 2123 | 17605 | 2911 | 2934 | 13460 | 10176 | 18009 |
| | 1003 | 13239 | 12374 | 3372 | 17390 | 11981 | 14556 | 12247 | 14559 | 12268 | 14560 | 14577 |
| | 14558 | 12267 | 14576 | 12226 | 9387 | 2109 | 7841 | 18828 | 11137 | 19936 | 14986 | 3553 |
| | 4554 | 11929 | 5440 | 2805 | 16033 | 3934 | 3003 | 1594 | 10929 | 12343 | 16214 | 17420 |
| | 5606 | 4643 | 10415 | 14917 | 6601 | 15702 | 10449 | 19711 | 13552 | 1507 | 19835 | 1698 |
| | 9321 | 11696 | 2863 | 14802 | 17698 | 1498 | 17572 | 14405 | 13598 | 12043 | 2262 | 567 |
| | 1583 | 2618 | 3734 | 18793 | 19614 | 14449 | 16036 | 8175 | 19636 | 13279 | 17286 | 5486 |
| | 17542 | 9087 | 15980 | 2290 | 4878 | 11904 | 428 | 10747 | 9550 | 13537 | 3804 | 8971 |
| | 5843 | 3250 | 1514 | 10411 | 13008 | 5960 | 18175 | 14056 | 11021 | 12535 | 9436 | 8113 |
| | 10697 | 15175 | 7725 | 16718 | 13365 | 5679 | 15598 | 19442 | 6306 | 9803 | 17134 | 10762 |
| | 2355 | 13282 | 9344 | 18414 | 962 | 10707 | 13732 | 15247 | 16140 | 14944 | 8665 | 3901 |
| | 12556 | 13238 | 3850 | 16213 | 15720 | 5407 | 7133 | 17222 | 15571 | 4342 | 952 | 16118 |
| | 708 | 14879 | 298 | 7886 | 19403 | 2997 | 14894 | 498 | 14617 | 11730 | 18476 | 3794 |
| | 6451 | 16585 | 3917 | 3066 | 16371 | 13698 | 6380 | 5627 | 5614 | 3881 | 18493 | 6416 |

TABLE 2-continued

| SEQ ID NO: | homolog SEQ ID NOs | | | | | | | | | |
|---|---|---|---|---|---|---|---|---|---|---|
| | 12573 | 15178 | 11348 | 7043 | 8200 | 17880 | 11947 | 15915 | 7621 | 7041 | 8209 | 18926 |
| | 10681 | 10164 | 14294 | 3702 | 8567 | 18263 | 9236 | 1978 | 3932 | 19800 | 9976 | 13414 |
| | 8046 | 11624 | 1429 | 3768 | 17319 | 17779 | 7609 | 16512 | 630 | 3171 | 7227 | 3551 |
| | 9996 | 16499 | 19516 | 8855 | 13654 | 9117 | 3812 | 16292 | 19434 | 10320 | 5172 | 1982 |
| | 3126 | 14582 | 9645 | 1807 | 19478 | 2739 | 7519 | 5561 | 12941 | 2436 | 17861 | 14481 |
| | 4909 | 1899 | 3459 | 15199 | 19324 | 1922 | 19333 | 4083 | 1541 | 12260 | 11304 | 16432 |
| | 8512 | 4387 | 10025 | 6653 | 9022 | 6289 | 7641 | 9339 | 2859 | 11610 | 9145 | 8381 |
| | 8830 | 8028 | 17745 | 3541 | 482 | 2045 | 8753 | 3209 | 9163 | 2838 | 17263 | 2745 |
| | 9173 | 17072 | 5826 | 7351 | 9534 | 19739 | 19536 | 7374 | 17185 | 14542 | 17759 | 5670 |
| | 4857 | 6297 | 13448 | 7546 | 11655 | 18214 | 11988 | 3497 | 12119 | 18421 | 2238 | 9138 |
| | 8088 | 14015 | 6428 | 10563 | 6419 | 14637 | 4955 | 9470 | 6734 | 18494 | 1521 | 11999 |
| | 10694 | 19034 | 6803 | 18967 | 314 | 1819 | 14284 | 18428 | 15805 | 9706 | 10688 | 13439 |
| | 13112 | 10153 | 5875 | 3218 | 18791 | 2938 | 12193 | 15881 | 16805 | 14320 | 13237 | 2072 |
| | 12833 | 13687 | 15276 | 12110 | 9603 | 12516 | 3748 | 11719 | 10927 | 18595 | 13468 | 2719 |
| | 7437 | 2981 | 5840 | 16220 | 19699 | 10298 | 2127 | 3040 | 11867 | 4738 | 17635 | 17582 |
| | 9714 | 2444 | 10594 | 8326 | 16463 | 2150 | 4184 | 2007 | 11355 | 16573 | 10940 | 9501 |
| | 2168 | 14219 | 13085 | 7255 | 18034 | 15653 | 19511 | 18649 | 7840 | 8220 | 2272 | 4799 |
| | 9676 | 5395 | 14310 | 16236 | 8684 | 4645 | 2741 | 19834 | 12291 | 4917 | 15188 | 3607 |
| | 13304 | 10053 | 19863 | 17528 | 10883 | 622 | 943 | 12590 | 14403 | 18836 | 9723 | 10918 |
| | 19559 | 18677 | 1038 | 15537 | 16448 | 8891 | 10556 | 10553 | 922 | 3334 | 13996 | 16085 |
| | 16717 | 16720 | 16629 | 13354 | 3416 | 6712 | 18027 | 18028 | 18046 | 18045 | 15020 | 9679 |
| | 4373 | 2046 | 2280 | 16254 | 15252 | 11438 | 7044 | 432 | 17329 | 10580 | 2438 | 10575 |
| | 2435 | 14080 | 12466 | 13227 | 13331 | 3373 | 4354 | 1137 | 9112 | 9115 | 8626 | 9114 |
| | 14182 | 14180 | 17288 | 17285 | 17287 | 17309 | 18279 | 17281 | 19761 | 5134 | 13133 | 13134 |
| | 7591 | 7579 | 7578 | 7590 | 7622 | 7593 | 7619 | 8710 | 11257 | 10155 | 17393 | 5497 |
| | 7611 | 7613 | 3368 | 3371 | 3345 | 3347 | 11146 | 3346 | 19018 | 18562 | 4131 | 617 |
| | 15703 | 18059 | 11680 | 15149 | 6854 | 10204 | 14371 | 15844 | 16942 | 6398 | 16524 | 14919 |
| | 6019 | 6427 | 4568 | 2096 | 17412 | 15137 | 6371 | 442 | 13742 | 19059 | 13740 | 18548 |
| | 8545 | 8646 | 10441 | 19790 | 9654 | 2971 | 11164 | 12791 | 16684 | 7548 | 18131 | 4903 |
| | 4891 | 11339 | 14205 | 916 | 13861 | 14326 | 7296 | 7059 | 9757 | 15666 | 8359 | 2239 |
| | 6482 | 16408 | 10426 | 1600 | 4339 | 9125 | 15701 | 10147 | 6375 | 17364 | 694 | 5869 |
| | 11598 | 14712 | 1946 | 16250 | 7313 | 3680 | 8784 | 12459 | 4338 | 15013 | 3889 | 4760 |
| | 2323 | 2136 | 16586 | 3470 | 11223 | 13993 | 8676 | 4320 | 6154 | 958 | 7689 | 4997 |
| | 6877 | 12357 | 17840 | 14977 | 10169 | 1152 | 12474 | 11366 | 1049 | 3453 | 16153 | 10586 |
| | 7466 | 18725 | 19446 | 12713 | 6237 | 2331 | 1068 | 5956 | 14116 | 4295 | 5532 | 19458 |
| | 9119 | 2957 | 3739 | 1926 | 5245 | 13988 | 1520 | 18033 | 19042 | 18302 | 17337 | 4538 |
| | 4879 | 14267 | 1733 | 12961 | 6254 | 3681 | 7830 | 2074 | 16366 | 1543 | 11786 | 9016 |
| | 14318 | 19058 | 3564 | 8810 | 13044 | 12256 | 15026 | 4210 | 6152 | 6276 | 7015 | 19314 |
| | 14293 | 8809 | 10942 | 9006 | 4237 | 5540 | 4066 | 15205 | 2922 | 7718 | 9533 | 18546 |
| | 10937 | 14422 | 11800 | 15473 | 1522 | 19100 | 8937 | 2303 | 11886 | 7722 | 16621 | 18323 |
| | 896 | 9132 | 14097 | 11222 | 15658 | 13479 | 11450 | 7853 | 10321 | 18832 | 7922 | 19744 |
| | 6867 | 15240 | 11684 | 18174 | 1205 | 4611 | 5375 | 16992 | 2152 | 19112 | 4946 | 19596 |
| | 16620 | 19036 | 18565 | 19016 | 18568 | 18507 | 18505 | 18503 | 18502 | 5629 | 7080 | 13753 |
| | 1126 | 8534 | 2047 | 12554 | 18939 | 18572 | 15080 | 13812 | 14010 | 15955 | 6939 | 14155 |
| | 19762 | 16570 | 11714 | 12363 | 13544 | 7253 | 10903 | 17939 | 19714 | 11964 | 15759 | 1212 |
| | 3044 | 7880 | 13476 | 18635 | 9531 | 13481 | 6845 | 19136 | 3340 | 1470 | 15749 | 8548 |
| | 16230 | 16655 | 5529 | 5322 | 6804 | 2189 | 2803 | 2874 | 2819 | 2798 | 2851 | 2774 |
| | 2772 | 2847 | 2769 | 2801 | 11161 | 14362 | 279 | 18610 | 1712 | 3375 | 2235 | 2242 |
| | 2245 | 2243 | 18869 | 9808 | 16261 | 14527 | 6784 | 8618 | 13941 | 16063 | 16061 | 4419 |
| | 4399 | 7500 | 7499 | 7479 | 7507 | 7501 | 7478 | 5967 | 5140 | 7332 | 2530 | 9726 |
| | 5117 | 1829 | 3095 | 15542 | 19925 | 15520 | 16445 | 16918 | 16920 | 16451 | 15541 | 16209 |
| | 16922 | 15560 | 15559 | 11352 | 19040 | 2729 | 2751 | 2748 | 2730 | 6517 | 313 | 6884 |
| | 6008 | | | | | | | | | | | |
| 333: | 417 | 6257 | 8790 | 13789 | 16313 | 14699 | 10733 | 16574 | 8828 | 5654 | 11626 | 2210 |
| | 11562 | 3826 | 12856 | 1109 | | | | | | | | |
| 334: | 8128 | 4221 | 17278 | 17046 | 18251 | 12696 | 6743 | 3779 | 8868 | 11244 | 10704 | 12642 |
| | 6965 | 16337 | 9523 | | | | | | | | | |
| 335: | 18958 | 12883 | 14235 | 19663 | 17014 | 1182 | 2397 | 1912 | 8514 | 1875 | 540 | 4252 |
| | 8725 | 6215 | 16237 | 4063 | 729 | 2593 | 724 | 8219 | 17866 | 6912 | 6447 | 18691 |
| | 2763 | 5446 | 2066 | 15270 | 17205 | 19591 | | | | | | |
| 336: | 12057 | 12728 | 5689 | 13469 | 14260 | 4138 | 1692 | 19601 | 15628 | 9152 | 17930 | 16195 |
| | 2028 | 8172 | 17751 | 16934 | 16401 | | | | | | | |
| 337: | 3127 | 12366 | 13856 | 16497 | 1925 | 19818 | 4950 | 15674 | 5793 | 15496 | 15493 | 2188 |
| | 2206 | 5492 | 1835 | 6671 | 11106 | 1524 | 9890 | 1111 | | | | |
| 338: | 5950 | 18742 | 15397 | 6802 | 19876 | 12654 | 8206 | 17804 | 1971 | 16998 | 18602 | 18337 |
| | 4016 | 5119 | 2979 | 4844 | 10291 | 19710 | 18136 | 5748 | 10284 | 7029 | 5412 | 5278 |
| | 11920 | 1908 | 6210 | 762 | 9715 | 12314 | 6273 | 6084 | 19740 | 8804 | 15410 | 16699 |
| | 8756 | 13731 | 3128 | 3144 | 10582 | 15564 | | | | | | |
| 339: | 11402 | 410 | 12775 | 2861 | 5260 | 5387 | 19121 | 1001 | 11194 | 18533 | 19260 | 466 |
| | 4275 | 18650 | 7675 | 1919 | 4821 | 7323 | 16863 | 9487 | 12895 | 16977 | 15299 | 2339 |
| | 8707 | 2334 | 9658 | 18289 | 19688 | 13814 | 2715 | 19839 | 17620 | 11898 | 1578 | 12967 |
| | 4603 | 13211 | 930 | 19517 | 19938 | 15569 | 15063 | 8098 | 19557 | 8485 | 18333 | 16609 |
| | 14853 | 9045 | 18679 | 9143 | 17460 | 7537 | 13585 | 18153 | 18578 | 1495 | 6307 | 4430 |
| | 14054 | 6332 | 15889 | 17603 | 11064 | 948 | 2013 | 18684 | 6751 | 1586 | 17167 | 17443 |
| | 8350 | 2105 | 8487 | 9467 | 13324 | 1745 | 1746 | 5173 | 4505 | 11300 | 7665 | 13801 |
| | 6730 | 2418 | 12477 | 12495 | 19560 | 8467 | 6040 | 6166 | 5180 | 14885 | 7681 | 18736 |
| | 6363 | 10978 | | | | | | | | | | |

TABLE 2-continued

| SEQ ID NO: | homolog SEQ ID NOs | | | | | | | | | | |
|---|---|---|---|---|---|---|---|---|---|---|---|
| 340: | 6122 | 1518 | 18485 | 14501 | 10446 | 5892 | 19266 | 13779 | 16587 | 8559 | 9244 | 8689 |
| | 11841 | 16626 | 17021 | | | | | | | | |
| 341: | 10333 | 3897 | 11487 | 9936 | 11989 | 10885 | 8445 | 11048 | 9005 | 17316 | 16689 | 13965 |
| | 11249 | 5452 | 8186 | 2457 | 10098 | | | | | | |
| 342: | 3006 | 14845 | 848 | 12847 | 17916 | 1499 | 5698 | 15349 | 8481 | 2524 | 12033 | 2479 |
| | 19698 | 8954 | 6422 | 13377 | 17520 | | | | | | |
| 343: | 6892 | 17589 | 9778 | 16830 | 14586 | 3829 | 7946 | 7552 | 7372 | 2949 | 6234 | 6869 |
| | 12368 | 9735 | 13309 | 2554 | 7769 | 4764 | 8126 | 18134 | 2656 | 2408 | 9463 | 16486 |
| | 19750 | 2406 | 15386 | 7481 | 14227 | 7803 | 18842 | 18844 | 4369 | 15153 | 18161 | 19455 |
| | 3782 | 7008 | 2599 | 4449 | 1837 | 2204 | 6481 | 10484 | 18534 | 15820 | 3300 | 18577 |
| | 14013 | 8365 | 13671 | 11914 | 3706 | | | | | | |
| 344: | 4518 | 2816 | 7393 | 8749 | 3714 | 18587 | 12336 | 13565 | 834 | 14466 | 2212 | 18658 |
| | 3417 | 2925 | | | | | | | | | |
| 345: | 471 | 17836 | 1008 | 8569 | 18625 | 14950 | 11789 | 8572 | 1102 | 10998 | 17791 | |
| 346: | 16406 | 9039 | 13935 | 10414 | 14191 | 11070 | | | | | | |
| 347: | 6068 | 14653 | 2218 | 9394 | | | | | | | | |
| 348: | 8023 | 17381 | 14654 | 13733 | 18394 | 10569 | 4912 | 9979 | 1032 | 937 | 13915 | 10361 |
| | 1651 | 5040 | 10191 | 12530 | | | | | | | |
| 349: | 1648 | 10364 | 2132 | 11847 | 18514 | 11591 | 2053 | | | | | |
| 350: | 13558 | 19061 | 6182 | 985 | 13642 | 11733 | 7195 | 10366 | 10180 | 4120 | 16484 | 13042 |
| | 18195 | 12100 | 8507 | | | | | | | | |
| 353: | 4575 | 1730 | 16597 | 3415 | 11245 | 13804 | 9868 | 8538 | 15670 | 7953 | 11687 | 14656 |
| | 1891 | | | | | | | | | | |
| 354: | 19676 | 7455 | 15869 | 13573 | 16262 | 19202 | 4246 | 19397 | 2728 | 12796 | 9583 | 7861 |
| | 5152 | 12632 | 18294 | 12083 | 15810 | | | | | | |
| 355: | 2962 | 6855 | 10045 | 10561 | 12389 | 12391 | 2422 | 18108 | 12563 | 12416 | 4416 | 11255 |
| | 8450 | 16833 | 11444 | 14745 | 12519 | 14732 | 12470 | 14479 | 1758 | | |
| 356: | 8236 | 1667 | 6732 | 4010 | 6333 | 999 | 12332 | 2454 | 12092 | 2743 | 7397 | 3753 |
| | 12781 | 16704 | 6391 | 18035 | 3785 | 1321 | 8174 | 19017 | 8597 | 16697 | 12677 | 9178 |
| | 12405 | 17672 | 12838 | 19432 | 2856 | 7305 | 5899 | 5645 | 1905 | 926 | 4508 | 6831 |
| | 11594 | 13483 | 19577 | 13571 | 17403 | 19874 | | | | | |
| 357: | 18266 | 7571 | 19462 | 4882 | 3947 | 18198 | 19775 | 19771 | 19267 | 9864 | 15678 | 7599 |
| | 19000 | 3750 | 3851 | 12623 | 17165 | 17571 | 14922 | 2910 | 16737 | 8164 | 5433 | 14442 |
| | 13244 | 5939 | 1262 | 17766 | 9254 | 2064 | | | | | |
| 358: | 4219 | 1193 | 4372 | 8802 | 10387 | 9975 | 16842 | 12280 | 12281 | 12279 | 17094 | 11872 |
| | 2301 | 709 | 13862 | 19439 | 1073 | 17661 | 15857 | 5981 | 5996 | 10915 | 2469 | 18211 |
| | 13345 | 7869 | 8911 | 18950 | 8909 | 18952 | 8225 | 2963 | 8049 | 6934 | 2376 | 6638 |
| | 15632 | 8089 | 9727 | 17744 | 4332 | 3625 | 2818 | 3137 | 17921 | 3318 | 16305 | 764 |
| | 13749 | 12825 | 10113 | 546 | 11893 | 19759 | 13294 | 15366 | 11250 | 13771 | 8642 | 15051 |
| | 6891 | 15845 | 12578 | 4987 | 6516 | 18800 | 4333 | 18374 | 4360 | 14269 | 17370 | 9277 |
| | 18408 | 4808 | 4029 | 12225 | 19338 | 787 | 15279 | 9722 | 10304 | 1332 | 9721 | 3088 |
| | 11139 | 6037 | 16019 | 8571 | 5449 | 4424 | 5365 | 2467 | 3432 | 7502 | 1283 | 2362 |
| | 17765 | 12194 | 5682 | 9922 | 14289 | 9064 | 13109 | 2442 | 5695 | 13898 | 1251 | 6239 |
| | 13774 | 860 | 2056 | 6839 | 6840 | 612 | 11105 | 11286 | 2407 | 12769 | 13122 | 9044 |
| | 13743 | 3836 | 3447 | 8243 | 6953 | | | | | | |
| 359: | 12802 | 5201 | 10302 | 17468 | 16751 | 7450 | 9413 | 19290 | 5280 | 19612 | 15469 | 15474 |
| | 13637 | 6949 | 3348 | 2194 | 4865 | 3207 | 16722 | 3441 | 14427 | 7198 | 3775 | 3802 |
| | 12181 | | | | | | | | | | |
| 360: | 19570 | 9059 | 8115 | 3359 | 3370 | 16218 | 4471 | 2588 | 3190 | 1342 | 1327 | 7790 |
| | 7330 | 15451 | 1506 | 12550 | 3293 | 13170 | 13832 | 8062 | 11326 | 2156 | 5293 | 5104 |
| | 3243 | 672 | 10504 | 12238 | 7614 | 14171 | 3051 | 10249 | 4843 | 15762 | 12428 | |
| 361: | 3065 | 950 | 8348 | 12335 | 19427 | 14109 | 13455 | 16581 | 18561 | 19522 | 5471 | 7987 |
| | 13435 | 14619 | 9480 | 6424 | 5284 | 10400 | 10362 | 7024 | 1443 | 7277 | 15946 | 6856 |
| | 5638 | 955 | 2157 | 1720 | 9881 | 18969 | 15813 | 7701 | 12321 | 3920 | 8603 | 9215 |
| | 3907 | 11529 | 14014 | 6824 | 2329 | 8668 | 10607 | 9238 | 2565 | 4098 | 9193 | 16372 |
| | 18237 | 17803 | 19666 | 2639 | 7110 | 12353 | 660 | 13242 | 17052 | 10200 | 12815 | 11310 |
| | 17724 | 3805 | 1392 | 19435 | 12595 | 5074 | 10118 | 5073 | 8413 | 6434 | 8087 | 3649 |
| | 6611 | 4839 | 1944 | 2006 | 14636 | 15167 | 19849 | 3029 | 5269 | 18965 | 9850 | 11641 |
| | 4433 | 12460 | 3711 | 13980 | 19654 | 16418 | 4220 | 14462 | 14907 | 12618 | 7928 | 11377 |
| | 1861 | 16288 | 3333 | 15079 | 11178 | 5930 | 14221 | 15099 | 7106 | 13591 | 11342 | 6453 |
| | 9428 | 3138 | 4529 | 18919 | 10578 | 11967 | 3123 | 15132 | 7246 | 1399 | 19641 | 1877 |
| | 15059 | 10489 | 18120 | 12869 | 12088 | 11647 | 7054 | 2316 | 4238 | 4224 | 17713 | 13334 |
| | 18328 | 6713 | 10427 | 5017 | 1537 | 13171 | 3450 | 18694 | 3746 | 11425 | 11266 | 11206 |
| | 14036 | 8884 | 13754 | 3840 | 5694 | 12680 | 14821 | 15322 | 12298 | 15719 | 13691 | 13441 |
| | 2511 | 17203 | 3588 | 3365 | 11160 | 4803 | 13723 | 19123 | 12875 | 17986 | 9764 | 4606 |
| | 4403 | 4531 | 10348 | 11668 | 16400 | 16295 | 8960 | 3752 | 5598 | 15851 | 14513 | 7149 |
| | 15712 | 16423 | 6990 | 14475 | 12448 | 4402 | 11453 | 9183 | 3764 | 10933 | 3278 | 7656 |
| | 10372 | 17668 | 18799 | 2893 | 12854 | 5169 | 17911 | 17413 | 11409 | 13265 | 438 | 10127 |
| | 17867 | 12591 | 2654 | 6083 | 11279 | 17487 | 15623 | 19297 | 15212 | 13033 | 4207 | 10444 |
| | 16705 | 11619 | 8797 | 17292 | 14740 | 6849 | 19452 | 2484 | 14138 | 14897 | 9108 | 16156 |
| | 4383 | 5020 | 6543 | 6549 | 11168 | 3290 | 6961 | 16871 | 3270 | 15512 | 2895 | 14733 |
| | 15488 | 2322 | 14667 | 15731 | 18753 | 18312 | 12557 | 13197 | 3823 | 7435 | 13672 | 2033 |
| | 5162 | 8163 | 7655 | 6409 | 8511 | 14850 | 8899 | 15067 | | | |
| 362: | 15752 | 17695 | 9990 | 5932 | 15211 | 8418 | 6238 | 13628 | 14659 | 485 | 972 | 7628 |
| | 19124 | 17248 | 10742 | 14839 | 7306 | 6162 | 2258 | 9285 | | | |
| 363: | 15587 | 7536 | 11706 | 19935 | 8746 | 17583 | 13021 | 11251 | 695 | 6660 | 14178 | 15828 |
| | 10282 | 7088 | 4536 | 3957 | 2909 | 10712 | 8289 | 1371 | 15458 | 19277 | 18642 | 4003 |
| | 15273 | 4301 | 13644 | 7311 | 11813 | 1680 | 735 | 15095 | 1457 | 1128 | 3122 | 9711 |

TABLE 2-continued

| SEQ ID NO: | homolog SEQ ID NOs | | | | | | | | | | |
|---|---|---|---|---|---|---|---|---|---|---|---|
| | 3793 | 1155 | 18202 | 5222 | 16291 | 5429 | 8099 | 7324 | 11246 | 909 | 2980 | 6952 |
| | 4744 | 9471 | 15817 | 19001 | 6196 | 6665 | 2449 | 16000 | 14068 | 9442 | 4512 | 15890 |
| | 11197 | 18150 | 14278 | 19695 | 6747 | 10772 | 7524 | 8625 | 11005 | 5911 | 9704 | 1140 |
| | 3532 | 6565 | 12151 | 16037 | 13454 | 9169 | 3324 | 9517 | 19274 | 3692 | 4037 | 3896 |
| | 1082 | 8078 | 12333 | 17688 | 6926 | 9760 | 17178 | 8565 | 15303 | 18874 | 5274 | 3608 |
| | 11418 | 15790 | 13582 | 9809 | 13016 | 12263 | 17135 | 18105 | 2163 | 12533 | 9985 | 14786 |
| | 6012 | 15171 | 3012 | 7976 | 18090 | 4450 | 16120 | 10148 | 9586 | 1280 | 9405 | 9430 |
| | 10773 | 8152 | 17676 | 19007 | 13766 | 7476 | 16279 | 18231 | 12787 | 12805 | 1089 | 16681 |
| | 3955 | 2488 | 673 | 12058 | 8888 | 7696 | 12741 | 2767 | 7629 | | | |
| 364: | 18935 | 11480 | 10102 | 2128 | 611 | 16123 | 4822 | 16369 | 3396 | 5943 | 18617 | 12251 |
| | 9404 | 19062 | 5185 | 6458 | 17236 | 4412 | 6457 | 4432 | 11891 | 4444 | 17731 | 5068 |
| | 13351 | 18269 | 1188 | 18262 | 18243 | 18264 | 18245 | 15524 | 18268 | 7045 | 10216 | 15254 |
| | 15585 | 9962 | 6016 | 6018 | 5983 | 10695 | 4247 | 11334 | 2233 | 11399 | 14429 | 17303 |
| | 18326 | 5114 | 4325 | 13602 | 3559 | 12081 | 18081 | 5579 | 15294 | 19095 | 8364 | 12907 |
| | 14773 | 15870 | 10476 | 3925 | 8957 | 18029 | 8308 | 2927 | 19174 | 3169 | 6014 | 4048 |
| | 6676 | 17157 | 11935 | 4361 | 4103 | 7348 | 3589 | 16742 | 2320 | 8945 | 12971 | 1753 |
| | 2476 | 9137 | 14089 | 16990 | 18646 | 2973 | 10662 | 10632 | 13827 | 11754 | 1568 | 5396 |
| | 13363 | 13991 | 6017 | 6232 | 13824 | 9366 | 1808 | 7556 | 18911 | 16773 | 9136 | 4823 |
| | 14910 | 396 | 19794 | 17197 | 7423 | 9283 | 517 | 4437 | 17158 | 6128 | 6636 | 12989 |
| | 7092 | 2462 | 14623 | 6769 | 11837 | 19463 | 3305 | 13186 | 5079 | 2059 | 2342 | 5833 |
| | 5569 | 1515 | 5189 | 675 | 4488 | 17733 | 8803 | 17720 | 1127 | 7371 | 13624 | 3909 |
| | 4748 | 1217 | 8255 | 9253 | 16038 | 5961 | 6590 | 16131 | 19015 | 11099 | 19890 | 2161 |
| | 12546 | 10713 | 925 | 11622 | 813 | 16009 | 13081 | 15471 | 17703 | 8306 | 13620 | 1120 |
| | 7320 | 18557 | 7452 | 7470 | 13172 | 15551 | 3325 | 1780 | 2126 | 16004 | 10743 | 14145 |
| | 11018 | 15477 | 18982 | 10765 | 13029 | 15065 | 4084 | 8672 | 12316 | 10611 | 3273 | 11834 |
| | 6279 | 6327 | 17101 | 19914 | 19661 | 12771 | 7385 | 9866 | 8494 | 1768 | 15903 | 6534 |
| | 13088 | 18689 | 5562 | 9170 | 7829 | 3895 | 17666 | 16326 | 15100 | 13815 | 9286 | 8993 |
| | 6944 | 16914 | 7289 | 8901 | 17669 | 12277 | 14660 | 16867 | 11040 | 1316 | 3645 | 2585 |
| | 2770 | 4895 | 1589 | 399 | 6220 | 18600 | 18397 | 917 | 5160 | 14743 | 19767 | 11532 |
| | 1354 | 13972 | 3182 | 2310 | 15434 | 2040 | 5147 | 8430 | 14935 | 13335 | 16362 | 10812 |
| | 11006 | 12064 | 11533 | 16872 | 18830 | 15354 | 1960 | 11327 | 15506 | 19294 | 14823 | 1796 |
| | 7366 | 15566 | 5646 | 12469 | 10813 | 15208 | 13430 | 17355 | 4773 | 1940 | 14330 | 14354 |
| | 12329 | 4797 | 2889 | 595 | 9772 | 14913 | 17811 | 14573 | 7131 | 12710 | 6929 | 13194 |
| | 15743 | 17161 | 14900 | 19555 | 4173 | 17031 | 5984 | 7342 | 16617 | 8400 | 3525 | 3512 |
| | 3611 | 3679 | 3669 | 3674 | 10419 | 9782 | 9140 | 17719 | 6888 | 2353 | 8032 | 12136 |
| | 15475 | 934 | 10480 | 19362 | 17217 | 16756 | 19071 | 18554 | 12338 | 17276 | 2282 | 13612 |
| | 1421 | 5210 | 19246 | 14938 | 4414 | 10326 | 861 | 19438 | 16936 | 5565 | 10516 | 7011 |
| 365: | 13631 | 2299 | 17761 | 900 | 706 | 18107 | 11275 | 3061 | 17510 | 586 | 1894 | 15867 |
| | 13092 | 19868 | 17581 | 6902 | 13125 | 3191 | 17566 | 7355 | 11590 | 2877 | 15662 | 10745 |
| | 10009 | 17671 | 18076 | 2217 | 2055 | 11552 | 10714 | 19648 | 16707 | 9924 | 9503 | 19883 |
| | 12972 | 8648 | 6287 | 14196 | 10126 | 7645 | 11125 | 1084 | 2706 | 1420 | 1739 | 11228 |
| | 2641 | 9918 | 13470 | 15676 | 15827 | 15328 | 968 | 809 | 8295 | 15038 | 16125 | 2326 |
| | 13641 | 2592 | 15180 | 7187 | 19519 | 8254 | 7001 | 15948 | 419 | 12496 | 7126 | 5605 |
| | 18193 | 15842 | 6741 | 17608 | 8770 | 10875 | 17317 | 16846 | 9813 | 6726 | 15155 | 11019 |
| | 16116 | 16028 | 16531 | 1857 | 17795 | 11282 | 12582 | 8230 | 14029 | 9438 | 10288 | 9360 |
| | 9453 | 5792 | 14648 | 3353 | 782 | 13500 | 19798 | 3960 | 2396 | 13841 | 6828 | 19659 |
| | 4186 | 5277 | 570 | 7389 | 8319 | 1775 | 5548 | 697 | 6933 | 4532 | 9927 | 7345 |
| | 5347 | 17289 | 12608 | 7808 | 2718 | 9932 | 14265 | 15975 | 13060 | 14443 | 6331 | 18432 |
| | 13873 | 12306 | 4371 | 15241 | 12122 | 15732 | 5458 | 13523 | 8923 | 17770 | 1063 | 17401 |
| | 17362 | 14436 | 7068 | 13174 | 12734 | 11814 | 1336 | 10705 | 3094 | 7480 | 832 | 4811 |
| | 15561 | 12242 | 19576 | 792 | 9707 | 13586 | 7094 | 13475 | 8199 | 5714 | 15555 | 18801 |
| | 1992 | 5212 | 10193 | 18728 | 19345 | 15911 | 1076 | 1019 | 2978 | 11483 | 2478 | 14400 |
| | 8170 | 1943 | 17567 | 15417 | 5317 | 11195 | 14991 | 18347 | 7672 | 19335 | 19822 | 11797 |
| | 13910 | 8435 | 16903 | 15659 | 6408 | 13305 | 6028 | 491 | 12784 | 19379 | 8454 | 3118 |
| | 1686 | 10876 | 13040 | 17491 | 11393 | 2077 | 3299 | 874 | 13487 | 11838 | 9664 | 10552 |
| | 2610 | 8066 | 13005 | 12361 | 6853 | 3757 | 2887 | 15577 | 10529 | 14247 | 16087 | 18789 |
| | 15976 | 16374 | 10771 | 4277 | 14521 | 12901 | 18215 | 11495 | 3853 | 4255 | 1629 | 12007 |
| | 2466 | 9883 | 11432 | 13572 | 8080 | 5273 | 3638 | 18449 | 18786 | 16514 | 12076 | 1511 |
| | 6812 | 17300 | 5015 | 8838 | 9304 | 10185 | 7905 | 11345 | 15952 | 766 | 13089 | 2956 |
| | 613 | 8059 | 1979 | 12501 | 8535 | 16930 | 3363 | 10502 | 9217 | 16331 | 12258 | 3097 |
| | 9416 | 10257 | 11596 | 2590 | 11883 | 5567 | 18847 | 4461 | 15605 | 10990 | 10192 | 17106 |
| | 6082 | 15250 | 19258 | 19683 | 6624 | 17570 | 5102 | 9195 | 8650 | 11158 | | |
| 366: | 7895 | 6135 | 5404 | 5150 | 6602 | 19424 | 2002 | 11648 | 2102 | 11953 | 8198 | 18899 |
| | 10410 | 16171 | 8925 | 5672 | 16257 | 7833 | 4196 | 7416 | 8915 | 14363 | 1706 | 15695 |
| | 9308 | 7164 | 13079 | | | | | | | | | |
| 367: | 17228 | 9424 | 6076 | 17145 | 3914 | 10656 | 6091 | 14671 | 7138 | 1890 | 732 | 16240 |
| | 11984 | 11978 | 17029 | 18186 | 17451 | 1323 | 5667 | 18155 | 19103 | 8458 | 10719 | 1530 |
| | 1664 | 4884 | 11793 | 11316 | 1027 | 569 | 6663 | 18298 | 6906 | 1989 | 11679 | 8546 |
| | 17917 | 7183 | 4074 | 5267 | 8898 | 17813 | | | | | | |
| 368: | 10139 | 8837 | 7747 | 7598 | 13605 | 1318 | 9532 | 7490 | 2370 | 12273 | 4264 | 14618 |
| | 8627 | 10651 | 13584 | 18749 | 7057 | 7233 | 408 | 12207 | 5515 | 14163 | 1226 | 1228 |
| | 5775 | 5424 | 18314 | 18275 | 10203 | 8674 | 1800 | 2693 | 19005 | 8477 | 14053 | 9051 |
| | 10777 | 4549 | 6597 | 9738 | 7370 | 13649 | 5856 | 10149 | 13783 | 12613 | 17815 | 11337 |
| | 9362 | 13027 | 15862 | 4287 | 18724 | 8169 | 1419 | 6285 | 15077 | 2147 | 2905 | 14574 |
| | 1177 | 13510 | 9181 | 7135 | 7290 | 2520 | 6455 | 4618 | 7286 | 7288 | 2679 | 551 |
| | 9787 | 11002 | 1701 | 8930 | 8928 | 8942 | 1097 | 13702 | 15267 | 12778 | 15439 | 18947 |
| | 17593 | 12250 | 12347 | 19108 | 15478 | 7855 | 9687 | 17776 | 17774 | 12927 | 17808 | 3508 |
| | 7592 | 10782 | 2475 | 17662 | 17990 | 268 | 18627 | 12803 | 4005 | 6216 | 13658 | 8061 |

TABLE 2-continued

| SEQ ID NO: | homolog SEQ ID NOs | | | | | | | | | | |
|---|---|---|---|---|---|---|---|---|---|---|---|
| | 16885 | 5642 | 8881 | 8964 | 10019 | 2902 | 8544 | 10703 | 1548 | 4925 | 12994 | 10443 |
| | 7766 | 13011 | 12993 | 13010 | 17357 | 15189 | 1888 | 18221 | 17786 | 9563 | 9562 | 2386 |
| | 5156 | 3903 | 547 | 18001 | 12480 | 13049 | 8197 | 2495 | 17171 | 18977 | 12208 | 19466 |
| | 8339 | 10488 | 4385 | 19012 | 16077 | 8291 | 17408 | 5878 | 19014 | 8302 | 16024 | 16026 |
| | 16018 | 16022 | 4841 | 9827 | 9828 | 9829 | 8403 | 9847 | 9830 | 9842 | 4690 | 2646 |
| | 13874 | 9849 | 14131 | 17831 | 9865 | 8405 | 9851 | 9844 | 7012 | 8406 | 4019 | 499 |
| | 9951 | 11218 | 13124 | 538 | 13569 | | | | | | | |
| 369: | 6354 | 13600 | 13597 | 13402 | 8495 | 11462 | 4678 | 17651 | 2271 | 18508 | 9403 | 8227 |
| | 19337 | 18039 | 11414 | 13507 | 8796 | 16388 | 13135 | 10409 | 13151 | 13116 | 13153 | 14811 |
| | 13648 | 16385 | 17968 | 17992 | 18014 | 17987 | 17989 | 17964 | 17984 | 17963 | 18015 | 17961 |
| | 17934 | 17931 | 18010 | 17966 | 17884 | 17850 | 17851 | 17885 | 17905 | 17839 | 17878 | 17900 |
| | 17881 | 17854 | 17903 | 17360 | 12858 | 19170 | 13662 | 7781 | 19569 | 19153 | 13650 | 13595 |
| | 5154 | 17820 | 2688 | 17837 | 17834 | 17821 | 2707 | 2705 | 17822 | 17363 | 3754 | 3771 |
| | 3775 | 3751 | 3778 | 3747 | 17028 | | | | | | | |
| 370: | 13195 | 17260 | 15550 | 15298 | 16070 | 13528 | 18906 | 6667 | 3884 | 19731 | 16485 | 15332 |
| | 11024 | 4720 | 7335 | 10724 | 9903 | 16073 | 9800 | 2005 | 2226 | 17918 | 14439 | 11382 |
| | 1930 | 15821 | 6790 | 3307 | 2184 | 3678 | 6020 | 2483 | 16932 | 11759 | 18061 | 8407 |
| | 17553 | 9683 | 10479 | 3498 | 7938 | 11193 | 10141 | 10064 | 5340 | 13160 | 1065 | 1050 |
| | 1066 | 8697 | 5057 | 1948 | 19456 | 10401 | 4381 | 5626 | 3147 | 4807 | 15513 | 12411 |
| | 1085 | 17692 | 15803 | 9678 | 13378 | 594 | 3808 | 6353 | 1729 | 12195 | 14567 | 9675 |
| | 19783 | 10272 | 1789 | 7097 | 4737 | 17591 | 9334 | 11855 | 9329 | 14859 | 6302 | 14086 |
| | 8083 | 15671 | 12954 | 13947 | 17819 | 5460 | 14531 | 15105 | 16035 | 18528 | 15990 | 19316 |
| | 10591 | 3086 | 18057 | 7458 | 4476 | 12898 | 14681 | 5385 | 6706 | 12606 | 19781 | 4024 |
| | 18079 | 12117 | 14093 | 15233 | 18591 | 7496 | 19829 | 4740 | 7646 | 6599 | 7671 | 19185 |
| | 12054 | 10751 | 9600 | 19620 | 8234 | 8875 | 8090 | 5475 | 9292 | 16255 | 13529 | 6245 |
| | 17823 | 2300 | 18651 | 19369 | 988 | 5505 | 16473 | 15879 | 14117 | 9448 | 8299 | 7128 |
| | 1260 | 12844 | 6801 | 11913 | 12153 | 3878 | 16199 | 3426 | 6628 | 5890 | 3275 | 9071 |
| | 19553 | 19622 | 5677 | 2987 | 5813 | 8587 | 5410 | 7917 | 10123 | 11678 | 19390 | 5338 |
| | 10026 | 16740 | 6793 | 1954 | 9499 | 1886 | 18780 | 8529 | 17665 | 18483 | 19399 | 13823 |
| | 10599 | 10014 | 11713 | 13942 | 16536 | 6829 | 13457 | 12144 | 4468 | 15992 | 10473 | 13518 |
| | 2219 | 10524 | 420 | 421 | 14605 | 14570 | 6724 | 1269 | 15608 | 11671 | 5125 | 6124 |
| | 12849 | 7013 | 12911 | 427 | 17957 | 7104 | 18943 | 14199 | 10798 | 14689 | 13399 | 9608 |
| | 5287 | 17769 | 9135 | 11977 | 16390 | 8020 | 11559 | 16849 | 475 | 16412 | 9947 | 18271 |
| | 8288 | 16395 | 11055 | 10283 | 8052 | 3695 | 4102 | 6848 | 1576 | 5301 | 7717 | 994 |
| | 2477 | 9188 | 4330 | 6788 | 6219 | 12712 | 8475 | 8239 | 14804 | 13446 | 8249 | 3014 |
| | 11497 | 719 | 15957 | 17377 | 11889 | 19701 | 16334 | 9730 | 14899 | 17716 | 13795 | 14007 |
| | 15861 | 9886 | 16290 | 1777 | 16807 | 13147 | 5390 | 5656 | 16417 | 11861 | 16848 | 8738 |
| | 10094 | 18845 | 16925 | 17514 | 13485 | 17384 | 15049 | 13629 | 16050 | 15795 | 15733 | 10818 |
| | 17446 | 13946 | 5886 | 1298 | 18331 | 2672 | 1478 | 4124 | 15983 | 15934 | 3583 | 13711 |
| | 1676 | 19213 | 15367 | 19827 | 17298 | 12179 | 5594 | 17065 | 6157 | 13890 | 17670 | 9574 |
| | 11208 | 1762 | 15748 | 10092 | 2000 | 6115 | 8274 | 11506 | 15771 | 13770 | 17670 | 13724 |
| | 4250 | 18579 | 18707 | 18706 | 18338 | 11926 | 18667 | 19212 | 9804 | 19854 | 14597 | 7979 |
| | 5533 | 5584 | 7353 | 4291 | 17318 | 16669 | 687 | 880 | 11774 | 18653 | 11461 | 14110 |
| | 6979 | 18340 | 8989 | 12588 | 16340 | 12839 | 4132 | 12893 | 15176 | 12464 | 5250 | 13418 |
| | 19208 | 6505 | 2317 | 5276 | 12735 | 5595 | 3237 | 2548 | 769 | 11313 | 4897 | 4054 |
| | 13148 | 18282 | 8680 | 17055 | 9088 | 13069 | 7258 | 15620 | 4755 | 2281 | 4479 | 14873 |
| | 14276 | 18888 | 1613 | 2084 | 2083 | 2525 | 15057 | 8026 | 1769 | 6771 | 18311 | 14286 |
| | 18220 | 3288 | 3011 | 1673 | 18154 | 842 | 9128 | 10218 | 12711 | 4076 | 14589 | 13986 |
| | 9857 | 976 | 14336 | 10790 | 16144 | 19128 | 6185 | 10202 | 19394 | 10344 | 5962 | 15092 |
| | 13101 | 13349 | 1772 | 5842 | 17973 | 9011 | 7194 | 12615 | 6592 | 16662 | 6996 | 4557 |
| | 2794 | 9462 | 13636 | 1591 | 641 | 17482 | 711 | 1379 | 4654 | 19782 | 16899 | 4214 |
| | 17607 | 4609 | 14972 | 12409 | 6334 | 8398 | 2027 | 15897 | 1125 | 2319 | 5865 | 18872 |
| | 5227 | 19597 | 6259 | 16933 | 6862 | 12848 | 17576 | 9766 | 5970 | 13699 | 9543 | 10511 |
| | 17456 | | | | | | | | | | | |
| 371: | 8393 | 9015 | 13413 | 2587 | 10796 | 17631 | 11121 | 433 | 4963 | 9556 | 575 | 5319 |
| | 15391 | 10530 | 9031 | 4635 | 9004 | 9073 | 3306 | 11645 | 3981 | 19101 | 19141 | 19812 |
| | 10554 | 17490 | 13822 | 14492 | 17246 | 1376 | 15351 | 19391 | 12231 | 4365 | 5194 | 2111 |
| | 5408 | 17546 | 18797 | 5903 | 6042 | 1218 | 4848 | 19643 | 4899 | 6748 | 1341 | 2965 |
| | 13343 | 10436 | 3965 | 12507 | 16052 | 10080 | 14622 | 15172 | 1156 | 15431 | 19244 | 5027 |
| | 7279 | 4985 | 13179 | 18612 | 9230 | 6746 | 8566 | 5265 | 5208 | 3815 | 11698 | 18164 |
| | 13048 | 16879 | 4441 | 8300 | 11252 | 16442 | 505 | 453 | 12406 | 1723 | 6094 | 17550 |
| | 19037 | 5884 | 14923 | 4421 | 18481 | 6530 | 12498 | 17991 | 3134 | 8890 | 3350 | 7985 |
| | 7864 | 10001 | 10340 | 991 | 5289 | 19317 | 10465 | 7319 | 2659 | 5841 | 13312 | 1585 |
| | 8483 | 2167 | 16410 | 18310 | 17967 | 11530 | 8907 | 847 | 867 | 8377 | 12438 | 12935 |
| | 1630 | 8528 | 11657 | 16778 | 524 | 942 | 13396 | 13561 | 12813 | 15308 | 14883 | 14448 |
| | 5321 | 8706 | 4558 | 4612 | 4061 | 16274 | 14724 | 2777 | 3112 | 607 | 6814 | 11242 |
| | 4393 | 19491 | 1312 | 1238 | 437 | 18920 | 2620 | 5133 | 8260 | 9619 | 13014 | 8506 |
| | 10965 | 2373 | 14342 | 18448 | 19165 | 17471 | 5405 | 6607 | 1741 | 14959 | 15075 | 16265 |
| | 13994 | 1258 | 14304 | 8744 | 10343 | 19837 | 12926 | 7213 | 3174 | 10993 | 14602 | 10617 |
| | 7779 | 10187 | 9485 | 15515 | 19398 | 18257 | 19349 | 1202 | 15472 | 7901 | 12094 | 13651 |
| | 1646 | 14731 | 1180 | 12154 | 16047 | 18288 | 2248 | 8051 | 19670 | 7996 | 7995 | 3855 |
| | 1551 | 14194 | 18409 | 5592 | 11704 | 13409 | 18199 | 12052 | 7391 | 8999 | 15302 | 4964 |
| | 15580 | 16350 | 15735 | 14708 | 15312 | 6145 | 15699 | 6159 | 15221 | 18322 | 10493 | 501 |
| | 6886 | 13963 | 12295 | 8982 | 13436 | 16066 | 11980 | 4664 | 9057 | 9034 | 16666 | 15687 |
| | 2427 | 11094 | 13668 | 3320 | 14079 | 9090 | 11181 | 8003 | 4257 | 11638 | 6544 | 6957 |
| | 3999 | 12296 | 10381 | 2653 | 4772 | 4810 | 8751 | 10568 | 10162 | 5600 | 5649 | 15893 |
| | 14376 | 16307 | 17697 | 9785 | 10884 | 16276 | 6169 | 6176 | 1037 | 9196 | 8367 | 7783 |
| | 14533 | 9056 | 15139 | 19917 | 12676 | 3038 | 10673 | 5503 | 7023 | 15682 | 10198 | 898 |

TABLE 2-continued

| SEQ ID NO: | homolog SEQ ID NOs | | | | | | | | | | |
|---|---|---|---|---|---|---|---|---|---|---|---|
| | 1297 | 5858 | 14777 | 6955 | 17092 | 945 | 3032 | 10231 | 16741 | 4106 | 11060 | 10054 |
| | 18270 | 12505 | 13314 | 1821 | 7784 | 11537 | 6572 | 3603 | 13635 | 5021 | 9052 | 7601 |
| | 6284 | 8815 | 10431 | 18883 | 18773 | 17616 | 11724 | 3501 | 16356 | 11013 | 14805 | 9024 |
| | 14557 | 7384 | 17109 | 7703 | 18849 | 14347 | 5364 | 6468 | 8936 | 3979 | 19281 | 10693 |
| | 13957 | 3977 | 13486 | 7380 | 17077 | | | | | | | |
| 372: | 4087 | 6477 | 5737 | 5639 | 1608 | 6099 | | | | | | |
| 373: | 11821 | 15570 | 15362 | 17684 | 12417 | 16687 | 6089 | 15073 | 1359 | 9786 | 19736 | 8877 |
| | 10254 | 5707 | 15924 | 3173 | 5784 | 19735 | 9392 | 2552 | 15018 | 11302 | 10241 | 18422 |
| | 14812 | 5768 | 9824 | 19506 | 6981 | 10715 | 19649 | 3163 | 9998 | 2058 | 6405 | 6584 |
| | 7848 | 14615 | 15185 | 2020 | 16636 | 15445 | 11375 | 18820 | 10331 | 1794 | 6619 | 8395 |
| | 6787 | 15426 | 6658 | 7293 | 10195 | 2815 | 19672 | 5744 | 14420 | 15534 | 15370 | 14303 |
| | 15177 | 12323 | 14958 | 14797 | 11491 | 452 | 5665 | 6655 | 9310 | 16947 | 3284 | 15338 |
| | 17037 | 6312 | 3537 | 1320 | 3839 | 1070 | 13922 | 11570 | 9105 | 5536 | 15484 | 14763 |
| | 14487 | 9068 | 12682 | 9682 | 10905 | 17502 | 4201 | 4406 | 8085 | 7056 | 8194 | 19718 |
| | 4289 | 19086 | 2788 | 10609 | 1276 | 11826 | 13369 | 15331 | 5251 | 8761 | 16059 | 6055 |
| | 8829 | 15454 | 5769 | 404 | 6808 | 15129 | 1725 | 10525 | 13488 | 7737 | 8203 | 2464 |
| | 17537 | 3566 | 8056 | 4191 | 10305 | 16861 | 7136 | 8740 | 1328 | 6582 | 7383 | 9441 |
| | 7191 | 15884 | 17130 | 5403 | 5900 | 19080 | 12583 | 10011 | 3547 | 16174 | 11235 | 17910 |
| | 9121 | 5888 | 18291 | 17740 | 7117 | 12383 | 15552 | 8043 | 8998 | 8613 | 9367 | 10541 |
| | 17801 | 8616 | 10220 | 1388 | 8599 | 4600 | 15321 | 13524 | 873 | 3602 | 1369 | 11422 |
| | 7039 | 17579 | 16732 | 1166 | 9497 | 14498 | 11817 | 691 | 12683 | 11133 | 10036 | 10168 |
| | 9240 | 7540 | 16302 | 2752 | 10828 | 18058 | 9911 | 15729 | 17807 | 1719 | 19117 | 1924 |
| | 3905 | 6227 | 4868 | 10358 | 11763 | 18113 | 5209 | 10740 | 6938 | 9635 | 14512 |
| | 17399 | 18121 | 12733 | 13966 | 5279 | 1953 | 1959 | 15567 | 18234 | 3818 | 5220 | 2744 |
| | 18925 | 13352 | 15418 | 7193 | 635 | 9142 | 8342 | 1452 | 16526 | 8583 | 14626 | 10595 |
| | 15517 | 3675 | 15449 | 18995 | 1550 | 12913 | 1574 | 10748 | 15207 | 689 | 10793 | 16997 |
| | 12087 | 3593 | 9495 | 12369 | 16764 | 13313 | 16678 | 1034 | 19702 | 12049 | 15046 | 15685 |
| | 1505 | 4817 | 6591 | 10004 | 17280 | 1057 | 2209 | 16242 | 6770 | 11621 | 11066 | 19348 |
| | 13114 | 5818 | 18606 | 11096 | 2735 | 11091 | 16599 | 13119 | 10928 | 11061 | 18170 | 18353 |
| | 3156 | 18093 | 8497 | 15157 | 14638 | 11736 | 1201 | 11263 | 18000 | 17999 | 11949 | 914 |
| | 4681 | 8852 | 14381 | 624 | 7004 | 5368 | 718 | 17732 | 11589 | 12259 | 1569 | 3028 |
| | 5910 | 8948 | 4159 | 8737 | 11933 | 15646 | 4723 | 2738 | 4789 | 376 | 8578 | 16888 |
| | 18857 | 6948 | 802 | 19507 | 5226 | 6977 | 6646 | 17557 | 2557 | | | |
| 374: | 16075 | 17346 | 1488 | 14198 | 4254 | 1650 | 2972 | 17330 | 12199 | 963 | 19510 | 17391 |
| | 5693 | 10970 | 15087 | 18216 | 17575 | 18987 | 17965 | 11155 | 16523 | 17488 | 9549 | 11549 |
| | 10008 | 17518 | 8820 | 12423 | 1502 | 16789 | 5728 | 716 | 10447 | 10464 | 16976 | 5052 |
| | 6412 | 5108 | 3314 | 6292 | 8733 | 16269 | 15372 | 10825 | 12586 | 10413 | 10380 | 12879 |
| | 10280 | 19593 | 3339 | 9629 | 3902 | 1154 | 10253 | 8577 | 7055 | 2366 | 3283 | 13877 |
| | 9422 | 4904 | 10226 | 1456 | 18827 | 6632 | 11525 | 14700 | 16759 | 2841 | 3514 | 3755 |
| | 17006 | 17415 | 7347 | 3067 | 13384 | 3558 | 2974 | 1846 | 3323 | 6629 | 3184 | 19561 |
| | 19703 | 15961 | 8827 | 2835 | 9303 | 1071 | 10179 | 14834 | 435 | 12500 | 4768 | 8437 |
| | 7517 | 2760 | 14250 | 12828 | 10786 | 1268 | 13055 | 13052 | 12497 | 16738 | 9520 | 19359 |
| | 10335 | 2636 | 2886 | 9647 | 6341 | 6642 | 7315 | 12387 | 19717 | 11540 | 13887 | 5657 |
| | 16407 | 18284 | 16813 | 16160 | 19921 | 18470 | 14030 | 12523 | 13879 | 8162 | 18330 | 4380 |
| | 12845 | 8696 | 15369 | 16716 | 14346 | 16690 | 4719 | 3277 | 5678 | 5680 | 10403 | 3623 |
| | 5774 | 2508 | 1744 | 19808 | 4467 | 13035 | 11579 | 7401 | 2215 | 4902 | 11210 | 11968 |
| | 15518 | 8984 | 3055 | 3245 | 18372 | 7421 | 8387 | 11179 | 7162 | 12630 | 5371 | 6163 |
| | 5316 | 14827 | 17771 | 590 | 15838 | 18775 | 7975 | 11865 | 15784 | 2067 | 15507 | 17191 |
| | 10843 | 14530 | 15228 | 9977 | 13811 | 16873 | 2501 | 8524 | 6493 | 9867 | 12072 | 8122 |
| | 14458 | 2666 | 15333 | 9399 | 4828 | 15607 | 12871 | 15613 | 1771 | 16671 | 7034 | 11542 |
| | 15229 | 10987 | 6960 | 14341 | 14525 | 7247 | 4763 | 19509 | 5283 | 18405 | 8785 | 16222 |
| | 14297 | 18434 | 14175 | 18636 | 10459 | 13065 | 17257 | 16561 | 1889 | 14928 | 6483 | 19913 |
| | 2456 | 1117 | 3838 | 6107 | 6860 | 7721 | 6402 | 1845 | 12187 | 10183 | 3985 | 7714 |
| | 6914 | 17425 | 9651 | 13259 | 791 | 15634 | 15360 | 10630 | 8039 | 9174 | 19497 | 1774 |
| | 12575 | 11290 | 11928 | 14723 | 17308 | 16624 | 18115 | 9049 | 7707 | 4914 | 15036 | 6484 |
| | 13266 | 7824 | 18137 | 7109 | 4623 | 13337 | 19831 | 7899 | 18876 | 14992 | 15343 | 4660 |
| | 14819 | 3465 | 1564 | 18556 | 19844 | 4349 | 19085 | 9971 | 13851 | 16931 | 2174 | 8283 |
| | 19354 | 11651 | 4757 | 15968 | 6959 | 10967 | 11188 | 17645 | 8006 | 6247 | 8959 | 10307 |
| | 13566 | 11039 | 13744 | 17853 | 863 | 11617 | 7364 | 10342 | 548 | 17035 | 13825 | 1142 |
| | 13781 | 9657 | 5941 | 1581 | 17069 | 12968 | 15470 | 16299 | 4281 | 15614 | 1937 | 4559 |
| | 14610 | 4696 | 13538 | 7697 | 3637 | 7603 | 11413 | 2179 | 7933 | 19467 | 8355 | 1987 |
| | 19608 | 967 | 15718 | 3480 | 8769 | 12950 | 16296 | 15497 | 18747 | 16455 | 2726 | 19646 |
| | 1232 | 9750 | 12105 | 12718 | 12852 | 5921 | 12836 | 3388 | 7411 | 16468 | 8997 | 11368 |
| | 1122 | 7595 | 14296 | 9278 | 19558 | 12461 | 14633 | 16726 | 17802 | 7427 | 18821 | 8484 |
| | 8671 | 7208 | 18639 | 13316 | 13956 | 4535 | 18240 | 4560 | 14766 | 13755 | 10837 | 5042 |
| | 14741 | 10899 | 6606 | 836 | 5977 | 3221 | 7913 | 9252 | 12441 | 5332 | 6266 | 4788 |
| | 11839 | 7268 | 17954 | 2356 | 3394 | 7563 | 11666 | 4588 | 13840 | 956 | 15465 | 19389 |
| | 17489 | 4423 | 4266 | 13131 | 10548 | | | | | | | |
| 375: | 16510 | 13467 | 14806 | 18916 | 13489 | 19287 | 6963 | 11609 | 12123 | 6168 | 14647 | 17406 |
| | 19726 | 10559 | 16928 | 16901 | 7555 | 12727 | 15736 | 13018 | 2908 | 998 | 11571 | 14927 |
| | 11630 | 8370 | 8372 | 13218 | 10996 | 17016 | 7958 | 9384 | 13045 | 13447 | 8144 | 1147 |
| | 15001 | 2276 | 2823 | 913 | 14592 | 3364 | 18232 | 14988 | 977 | 13106 | 11518 | 14539 |
| | 12112 | 17129 | 2915 | 10863 | 1580 | 4515 | 5798 | 8253 | 8082 | 416 | 19385 | 19171 |
| | 1100 | 16820 | 6199 | 4571 | 18783 | 1742 | 10182 | 13173 | 16635 | 17155 | 13139 | 6972 |
| | 5995 | 17971 | 7440 | 13865 | 9190 | 7070 | 17784 | 2010 | 723 | 15385 | 11201 | 10394 |
| | 4498 | 13493 | 13320 | 14352 | 678 | 13273 | 448 | 5709 | 11312 | 18597 | 11116 | 7510 |
| | 15024 | 12386 | 4804 | 16278 | 7734 | 1363 | 7445 | 19533 | 12959 | 1292 | 16198 | 16824 |
| | 12162 | 2158 | 10445 | 8558 | 12176 | 1883 | 5802 | 17888 | 7202 | 9357 | 9212 | 9289 |

TABLE 2-continued

| SEQ ID NO: | homolog SEQ ID NOs | | | | | | | | | | |
|---|---|---|---|---|---|---|---|---|---|---|---|
| | 15706 | 15848 | 18962 | 11998 | 16594 | 7471 | 9904 | 6557 | 5534 | 7297 | 14395 | 12716 |
| | 14630 | 1709 | 8057 | 5106 | 13882 | 13240 | 3414 | 8391 | 13833 | 18908 | 11344 | 5879 |
| | 12334 | 16882 | 8131 | 13298 | 15056 | 11047 | 2998 | 9898 | 12476 | 14335 | 16430 | 17095 |
| | 2214 | 1606 | 8257 | 16665 | 13613 | 6921 | 7748 | 14323 | 15979 | 5733 | 12116 | 6947 |
| | 8474 | 13708 | 15492 | 18185 | 6299 | 13610 | 18148 | 14215 | 18714 | 2930 | 12129 | 15295 |
| | 15268 | 14650 | 18384 | 18143 | 3511 | 6197 | 6361 | 17944 | 17442 | 5229 | 2611 | 565 |
| | 16358 | 16357 | 15084 | 16089 | 1181 | 17594 | 9098 | 2241 | 19299 | 12023 | 7283 | 10377 |
| | 6819 | 4949 | 8736 | 13205 | 2694 | 19763 | 13769 | 19621 | 13407 | 9290 | 16521 | 1825 |
| | 10029 | 12822 | 2903 | 15953 | 15986 | 11911 | 13793 | 11546 | 2234 | 14881 | 9908 | 11523 |
| | 15533 | 17577 | 11068 | 17517 | 17721 | 17374 | 10696 | 12227 | 19181 | 13058 | 8185 | 15758 |
| | 4153 | 877 | 8465 | 19011 | 4495 | 6613 | 16284 | 8138 | 18523 | 4389 | 15763 | 3113 |
| | 17826 | 2647 | 1098 | 10483 | 10463 | 19364 | 11397 | 11401 | 11381 | 6868 | 15127 | 1474 |
| | 16902 | 5599 | 19363 | 17325 | 9309 | 19361 | 5037 | 4928 | 3787 | 16923 | 4146 | 16939 |
| | 19535 | 15773 | 19339 | 15539 | 15125 | 18484 | 4203 | 18687 | 9493 | 10628 | 16954 | 18751 |
| | 5417 | 19261 | 19262 | 19234 | 1714 | 19898 | 19336 | 19291 | 19855 | 19286 | 19880 | 19877 |
| | 19295 | 19895 | 19875 | 1295 | 10357 | 6086 | 10734 | 11846 | 6683 | 12722 | 18816 | 18796 |
| | 7791 | 4566 | 18951 | 15711 | 11715 | 3398 | 18259 | 16246 | 1255 | 3813 | 1431 | 15683 |
| | 7433 | 3767 | 5490 | 5324 | 10201 | 9680 | 13775 | 10924 | 11448 | 5618 | 3801 | 6703 |
| | 2837 | 11877 | 2626 | 19090 | 4080 | 8371 | 9573 | 3492 | 13188 | 3045 | 16273 | 5297 |
| | 2403 | 2365 | 6847 | 7359 | 12126 | 16429 | 13888 | | | | | |
| 376: | 11821 | 15570 | 15362 | 17684 | 12417 | 16687 | 6089 | 1359 | 9786 | 19736 | 8877 | 10254 |
| | 5707 | 15924 | 3173 | 5784 | 19735 | 9392 | 2552 | 11302 | 15018 | 18422 | 14812 | 5768 |
| | 9824 | 19506 | 10715 | 19649 | 3163 | 9998 | 2058 | 6584 | 7848 | 14615 | 15185 | 2020 |
| | 15445 | 16636 | 11375 | 18820 | 10331 | 1794 | 6619 | 8395 | 15426 | 6787 | 6658 | 7293 |
| | 10195 | 2815 | 19672 | 5744 | 14420 | 15534 | 15370 | 14303 | 15177 | 12323 | 14958 | 14797 |
| | 11491 | 452 | 5665 | 6655 | 9310 | 16947 | 3284 | 15338 | 17037 | 6312 | 3537 | 1320 |
| | 3839 | 8693 | 1070 | 13922 | 11570 | 9105 | 5536 | 5454 | 15484 | 14763 | 14487 | 9068 |
| | 12682 | 9682 | 10905 | 17502 | 4201 | 4406 | 8085 | 8086 | 7056 | 8194 | 4289 | 2788 |
| | 19086 | 10609 | 17621 | 1276 | 11826 | 13369 | 15331 | 5251 | 8761 | 8829 | 15454 | 5769 |
| | 6808 | 15129 | 1725 | 10525 | 13488 | 7737 | 8203 | 2464 | 17537 | 3566 | 8056 | 4191 |
| | 16861 | 7136 | 8740 | 1328 | 6582 | 7383 | 9441 | 7191 | 15884 | 17130 | 5403 | 5900 |
| | 19080 | 10011 | 3547 | 16174 | 11235 | 17910 | 5888 | 18291 | 17740 | 7117 | 12383 | 15552 |
| | 8043 | 8613 | 9367 | 10541 | 17801 | 13465 | 8616 | 10220 | 1388 | 8599 | 4600 | 15321 |
| | 13524 | 873 | 3602 | 1369 | 11422 | 7039 | 16732 | 1166 | 9497 | 14498 | 11817 | 691 |
| | 12683 | 11133 | 10036 | 10168 | 9240 | 7540 | 16302 | 2752 | 10828 | 18058 | 9911 | 15729 |
| | 17807 | 1719 | 19117 | 1924 | 3905 | 6227 | 4868 | 10358 | 11763 | 18113 | 5209 | 8329 |
| | 10740 | 6938 | 14512 | 17399 | 18121 | 12733 | 13966 | 5279 | 1953 | 15567 | 3818 | 2744 |
| | 18925 | 13352 | 15418 | 7193 | 635 | 9142 | 8342 | 1452 | 16526 | 8583 | 14626 | 10595 |
| | 15517 | 3675 | 15449 | 18995 | 1550 | 12913 | 1574 | 10748 | 15207 | 689 | 10793 | 12087 |
| | 9495 | 12369 | 16764 | 13313 | 16678 | 1034 | 9702 | 15046 | 9046 | 15685 | 1505 | |
| | 4817 | 6591 | 10004 | 17280 | 18300 | 1057 | 2209 | 13541 | 16242 | 6770 | 17146 | 11621 |
| | 11066 | 2735 | 11091 | 11096 | 19348 | 10928 | 13114 | 5818 | 18353 | 3156 | 18093 | 15157 |
| | 11263 | 11949 | 914 | 4681 | 7472 | 8852 | 624 | 7004 | 5368 | 718 | 17732 | 12259 |
| | 3028 | 1569 | 5910 | 8948 | 4159 | 5738 | 8737 | 15646 | 4723 | 4789 | 12067 | 16888 |
| | 18857 | 373 | 6948 | 802 | 5226 | 6977 | 6646 | 17557 | 2557 | | | |
| 377: | 8393 | 9015 | 13413 | 2587 | 10796 | 17631 | 11121 | 634 | 433 | 4963 | 9556 | 575 |
| | 5319 | 15391 | 10530 | 431 | 9031 | 4635 | 9004 | 9073 | 3306 | 11645 | 3981 | 19141 |
| | 19101 | 19812 | 10554 | 16183 | 13822 | 14492 | 17246 | 1376 | 15351 | 19391 | 12231 | 4365 |
| | 5194 | 2111 | 5408 | 17546 | 18797 | 3789 | 5903 | 1218 | 4848 | 19643 | 6748 | 4899 |
| | 1341 | 2965 | 13343 | 10436 | 3965 | 12507 | 16052 | 10080 | 14622 | 1156 | 15431 | 5027 |
| | 7279 | 4985 | 13179 | 3070 | 3071 | 18612 | 2494 | 9230 | 6746 | 8566 | 5265 | 5208 |
| | 3815 | 11698 | 12148 | 18164 | 13048 | 16879 | 8300 | 4441 | 9892 | 11252 | 16442 | 505 |
| | 453 | 12406 | 1723 | 6094 | 17550 | 19037 | 5884 | 16347 | 17111 | 14923 | 4421 | 18481 |
| | 6530 | 12498 | 17991 | 3134 | 8890 | 3350 | 7985 | 7864 | 10001 | 10340 | 991 | 5289 |
| | 19317 | 10465 | 7319 | 2659 | 5841 | 13312 | 1585 | 8483 | 2167 | 16410 | 18310 | 17967 |
| | 11530 | 8907 | 847 | 867 | 8377 | 12935 | 12438 | 1630 | 8528 | 11657 | 18567 | 17817 |
| | 16778 | 524 | 942 | 2110 | 13396 | 13561 | 12813 | 15308 | 14883 | 14448 | 5321 | 8706 |
| | 4558 | 4612 | 4061 | 16274 | 14724 | 2777 | 607 | 3112 | 6814 | 11242 | 4393 | 19491 |
| | 1312 | 1238 | 437 | 18920 | 2620 | 5133 | 9619 | 8260 | 13014 | 8506 | 10965 | 3168 |
| | 2373 | 14342 | 18448 | 19165 | 17471 | 5405 | 6607 | 1741 | 14959 | 15075 | 16265 | 13994 |
| | 1258 | 14304 | 8744 | 10343 | 19837 | 12926 | 7213 | 3174 | 10993 | 14602 | 10617 | 7779 |
| | 10187 | 9485 | 15515 | 19398 | 18257 | 19349 | 1202 | 15472 | 7901 | 12094 | 13651 | 1646 |
| | 14731 | 1180 | 12154 | 16047 | 18288 | 7639 | 2248 | 8051 | 7996 | 7995 | 3855 | 1551 |
| | 14194 | 18409 | 5592 | 11704 | 8432 | 13409 | 18199 | 12052 | 7391 | 8999 | 15302 | 4964 |
| | 15580 | 16350 | 15735 | 14708 | 15312 | 6145 | 15699 | 6159 | 15221 | 15699 | 18322 | 501 |
| | 6886 | 13963 | 12295 | 8982 | 13436 | 16066 | 11980 | 4664 | 9057 | 9034 | 16666 | 15687 |
| | 2427 | 11094 | 13668 | 3320 | 14079 | 9090 | 11181 | 8003 | 4257 | 11638 | 6544 | 6957 |
| | 3999 | 12296 | 10381 | 2653 | 4772 | 4810 | 8751 | 10568 | 10162 | 5600 | 5649 | 15893 |
| | 14376 | 16307 | 17697 | 9785 | 10884 | 16276 | 6169 | 6176 | 1037 | 9196 | 8367 | 7783 |
| | 14533 | 9056 | 15139 | 19917 | 12676 | 3038 | 10673 | 5503 | 7023 | 15682 | 10198 | 898 |
| | 1297 | 5858 | 14777 | 6955 | 17092 | 945 | 3032 | 16741 | 4106 | 11060 | 10054 | 18270 |
| | 12505 | 13314 | 1821 | 7784 | 11537 | 6572 | 3603 | 13635 | 5021 | 9052 | 7601 | 6284 |
| | 8815 | 10431 | 18883 | 18773 | 17616 | 11724 | 3501 | 16356 | 11013 | 14805 | 14557 | 7384 |
| | 17109 | 7703 | 14347 | 18849 | 5364 | 8936 | 3979 | 19281 | 10693 | 13957 | 3977 | 7380 |
| | 13486 | 3384 | | | | | | | | | | |
| 378: | 13086 | 19930 | 5574 | 17164 | 15382 | 2809 | 1565 | 9389 | 817 | 831 | 5123 | 14538 |
| | 9536 | 1834 | 1833 | 13082 | 18812 | 19542 | 12765 | 13660 | 1610 | 1609 | 15422 | 15421 |
| | 1627 | 13773 | 5445 | 16272 | 10838 | 19127 | 19142 | 9628 | 10532 | 7251 | 8084 | 9179 |

TABLE 2-continued

| SEQ ID NO: | homolog SEQ ID NOs | | | | | | | | | | |
|---|---|---|---|---|---|---|---|---|---|---|---|
| | 10060 | 3233 | 3234 | 10382 | 15456 | 12062 | 12060 | 8373 | 598 | 11569 | 18041 | 16210 |
| | 3876 | 5308 | 5310 | 4105 | 19053 | 17469 | 5866 | 18520 | 18518 | 17299 | 16592 | 13763 |
| | 1649 | 2826 | 1088 | 5244 | 17633 | 8002 | 6325 | 8510 | 8509 | 17342 | 10265 | 8523 |
| | 11182 | 2722 | 2708 | 14181 | 17828 | 10012 | 8552 | 6241 | 10590 | 5676 | 10274 | 8661 |
| | 3295 | 6576 | 8917 | 12079 | 16538 | 11322 | 11319 | 15823 | 16815 | 16795 | 13353 | 14432 |
| | 2003 | 1985 | 7807 | 7667 | 1870 | 12245 | 15011 | 15010 | 7081 | 7327 | 7326 | 3951 |
| | 11419 | 11420 | 5668 | 5402 | 2091 | 2088 | 10840 | 16194 | 9002 | 9003 | 8127 | 8141 |
| | 1440 | 6106 | 6104 | 17126 | 17005 | 4082 | 9591 | 9590 | 1915 | 6725 | 10684 | 7300 |
| | 3317 | 3316 | 9330 | 19487 | 19488 | 14152 | 14153 | 2122 | 1914 | 1911 | 10665 | 14295 |
| | 14309 | 2813 | 2489 | 17345 | 11755 | 18173 | 14628 | 16281 | 4570 | 426 | 12610 | 17201 |
| | 17057 | 16060 | 16058 | 9609 | 987 | 9610 | 15673 | 921 | 1086 | 18306 | 11336 | 2498 |
| | 17087 | 17085 | 12034 | 12035 | 14678 | 14675 | 1138 | 544 | 16271 | 12318 | 12812 | 4308 |
| | 19378 | 14598 | 14599 | 7369 | 18594 | 7648 | 17481 | 19008 | 14345 | 5166 | 7493 | 13726 |
| | 13725 | 8384 | 3400 | 16200 | 7902 | 8410 | 8409 | 13137 | 16958 | 16957 | 15723 | 12257 |
| | 12253 | 15978 | 12973 | 4460 | 4459 | 13017 | 1570 | 2531 | 15107 | 15091 | 8965 |
| | 13199 | 13198 | 19203 | 19218 | 2645 | 523 | 5806 | 17244 | 17241 | 9229 | 13301 | 12697 |
| | 16182 | 14543 | 17648 | 7956 | 541 | 7604 | 12160 | 14921 | 4194 | 19094 | 17637 | 18276 |
| | 18272 | 14246 | 14245 | 6265 | 11350 | 6263 | 11351 | 1447 | 9984 | 5779 | 16703 | 16701 |
| | 8272 | 8270 | 15033 | 637 | 11702 | 3382 | 13215 | 6987 | 17734 | 17485 | 17484 | 8448 |
| | 11578 | 16065 | 14275 | 12748 | 19807 | 2279 | 9116 | 2296 | 2779 | 13325 | 13222 | 5611 |
| | 2538 | 12956 | 15346 | 10824 | 1158 | 4300 | 18255 | 6983 | 15168 | 4680 | 19799 | 12284 |
| | 6950 | 16092 | 3445 | 2799 | 10239 | 3660 | 12422 | 2797 | 18788 | 11987 | 9273 | 10359 |
| | 2829 | 13626 | 19734 | 592 | 14588 | 3599 | 6112 | 6093 | 6110 | 572 | 5844 | 11779 |
| | 4108 | 3093 | 11517 | 11539 | 455 | 10947 | 11127 | 13214 | 3927 | 11199 | 12891 | 15461 |
| | 15460 | 7465 | 5719 | 5718 | 3367 | 13458 | 13456 | 1149 | 14244 | 6969 | 12138 | 9126 |
| | 1661 | 15396 | 5031 | 16825 | 1467 | 3689 | 6716 | 6528 | 6526 | 8496 | 18877 |
| 379: | 16324 | 10027 | 16399 | 19626 | 19600 | 476 | 10737 | 6503 | 2637 | 5207 | 7908 | 18645 |
| | 13757 | 8204 | 17032 | 1213 | 10125 | 9070 | 5372 | 15085 | 10478 | 7338 | 18023 | 9641 |
| | 11812 | 14642 | 18106 | 9561 | 2651 | 1666 | 5437 | 14594 | 5439 | 12210 | 6002 | 12290 |
| | 5485 | 6003 | 14353 | 14349 | 14351 | 10819 | 8846 | 9429 | 2453 | 10112 | 16543 | 3140 |
| | 1146 | 1124 | 1121 | 15438 | 2354 |
| 380: | 15042 | 683 | 16630 | 18404 | 5663 | 2482 | 10670 | 11782 | 18811 | 18709 | 11700 | 19144 |
| | 6755 | 9799 | 13818 | 6126 | 2455 | 8789 |
| 381: | 17923 | 18890 | 5500 | 4771 | 6745 | 5378 | 3236 | 1210 | 11603 | 19433 | 19342 | 15300 |
| | 17953 | 11454 | 9261 | 12841 | 11591 | 5415 | 5453 | 5430 | 8278 | 14564 | 6761 | 17927 |
| | 18569 | 14781 | 10539 | 6214 | 3620 | 3528 | 17899 | 8748 | 12221 | 5504 | 5502 | 9489 |
| | 6425 | 8958 |
| 382: | 19132 | 10614 | 8139 | 10836 | 16040 | 11545 | 7879 | 2100 | 1703 | 14547 |
| 383: | 1189 | 16611 | 3586 | 4641 | 19633 | 17705 | 17150 | 8849 | 3552 | 7294 | 2029 | 6153 |
| | 18596 |
| 384: | 741 | 1633 | 5923 | 8765 | 16673 | 14609 | 3698 | 6449 | 2951 | 2093 | 11563 | 614 |
| | 14593 | 14762 | 6397 | 7731 | 14290 | 17038 | 4311 | 14640 |
| 385: | 11357 | 13113 | 2101 | 9359 | 2343 | 5986 | 9703 | 12857 | 8854 | 17190 | 4889 | 13808 |
| | 12572 | 3386 | 7845 | 17983 | 4794 |
| 386: | 1016 | 16046 | 10106 | 6272 | 16847 | 10542 | 15062 | 5576 | 4893 | 5448 | 15407 | 7831 |
| | 16578 | 18278 | 2702 | 7215 | 9961 | 6250 | 3252 | 18599 | 16433 | 3226 | 17007 |
| 387: | 7223 | 8111 | 7867 | 1322 | 9479 | 3291 | 18674 | 5132 | 12538 | 3515 | 18852 | 16518 |
| | 14682 | 5419 | 9781 |
| 388: | 13217 | 19387 | 1319 | 13219 | 1333 | 2384 | 4322 | 7600 | 13280 | 5924 | 13688 | 2181 |
| | 16877 | 16122 | 5091 | 927 | 6100 | 3686 |
| 389: | 11269 | 4678 | 13073 | 1755 | 1754 | 8654 | 3662 | 17371 | 3891 | 3973 | 2187 | 15246 |
| | 18462 | 4802 | 3390 | 619 | 643 | 13183 | 4014 | 1542 | 10000 | 19057 | 6229 | 1262 |
| | 14305 | 14256 | 17590 | 5708 | 4877 | 3775 | 8462 |
| 390: | 17182 | 3673 | 6158 | 5731 | 8195 | 15335 | 7264 | 7267 | 5346 | 10728 | 11675 | 2337 |
| | 19110 | 7961 | 8491 | 12046 | 10224 | 6729 | 18918 | 18228 | 3153 | 8723 | 3309 | 3313 |
| | 6222 | 15956 | 4632 | 12325 | 6835 | 6387 | 2622 | 4496 | 9897 | 10860 | 8044 | 10003 |
| | 13262 | 13236 | 6403 | 5331 | 4640 | 1303 | 4602 | 1304 | 18435 | 16053 | 18480 | 17646 |
| | 17644 | 17675 | 16363 | 4781 | 3269 | 8610 | 10852 | 3582 | 5717 | 9242 | 9340 | 9346 |
| | 13271 | 1345 | 3780 | 11086 | 14006 | 2264 | 5062 | 5146 | 16786 | 891 | 1282 | 11639 |
| | 2472 | 9621 | 19732 | 15665 | 10462 | 16384 | 18138 | 9510 | 19888 | 19119 | 4931 | 18991 |
| | 13945 | 18937 | 13580 | 18401 | 13863 | 1936 | 4639 | 10245 | 760 | 13679 | 14995 | 17389 |
| | 5259 | 10385 | 9763 | 15381 | 10901 | 10886 | 10888 | 12415 | 15437 | 8840 | 7871 | 4684 |
| | 12209 | 17107 | 11203 | 16435 | 8624 | 13410 | 8530 | 10422 | 11650 | 15110 | 13639 | 12675 |
| | 13689 | 19825 | 4662 | 13277 | 5625 | 9279 | 3369 | 5976 | 1377 | 2144 | 4086 | 18044 |
| | 16889 | 6767 | 18418 | 11859 | 8188 | 6500 | 16529 | 16528 | 14259 | 18077 | 11012 |
| | 10071 | 11825 | 16181 | 6479 | 3800 | 9154 | 19377 | 924 | 923 | 7361 | 4574 | 14380 |
| | 13895 | 17168 | 14901 | 17969 | 13735 | 17599 | 10270 | 4099 | 18973 | 3523 | 14337 | 8378 |
| | 4490 | 18286 | 5203 | 2114 | 13850 | 9109 | 9096 | 7060 | 4161 | 6561 | 1211 | 9640 |
| | 13790 | 19180 | 14796 | 5771 | 15355 | 14027 | 6282 | 12681 | 16502 | 4842 | 4262 | 4930 |
| | 15500 | 16490 | 14450 | 18361 | 15929 | 1171 | 7624 | 13836 | 15083 | 19541 | 1490 | 8022 |
| | 9426 | 19755 | 13700 | 10435 | 8346 | 13719 | 8681 | 19368 | 10906 | 19116 | 1509 | 3865 |
| | 12853 | 3125 | 5889 | 8316 | 18315 | 9077 | 436 | 1977 | 8354 | 5002 | 5025 | 16553 |
| | 5171 | 17152 | 9352 | 17908 | 9960 | 9963 | 4907 | 2079 | 14164 | 3744 | 3102 | 18375 |
| | 4128 | 4129 | 14794 |
| 391: | 5830 | 10547 | 4780 | 6670 | 1560 | 15309 | 12977 | 11581 | 15243 | 10500 | 7299 | 19550 |
| | 4614 | 11584 | 18988 | 17503 | 13880 | 18201 | 7124 | 6036 | 17359 | 15414 | 19074 | 13696 |
| | 4180 | 810 | 12806 | 13939 | 1259 | 2434 | 12029 | 5666 | 8718 | 751 | 18491 | 15717 |
| | 1795 | 4475 | 1738 | 627 | 5732 | 18253 | 8660 | 11107 | 16309 | 12868 | 4299 | 14698 |

TABLE 2-continued

| SEQ ID NO: | homolog SEQ ID NOs | | | | | | | | | | |
|---|---|---|---|---|---|---|---|---|---|---|---|
| | 14679 | 14502 | 8248 | 11990 | 9758 | 16167 | 9385 | 10043 | 10430 | 16906 | 12099 | 5791 |
| | 16810 | 13759 | 8562 | 2921 | 8889 | 10315 | 14077 | 2682 | 18457 | 14406 | 12241 | 10194 |
| | 5832 | 13548 | 15304 | 4676 | | | | | | | | |
| 392: | 18452 | 9432 | 5303 | 14233 | 9970 | 7637 | 14980 | 15265 | 7581 | 3016 | 10412 | 19809 |
| 393: | 19384 | 19382 | 682 | 6463 | 1021 | 6039 | 6041 | 6057 | 7898 | 7896 | 13532 | 13533 |
| | 8037 | 9356 | 16887 | 16866 | 7150 | 7148 | 11880 | 11903 | 7084 | 7083 | 3381 | 13816 |
| | 13817 | 12463 | 4530 | 2311 | 2312 | 10624 | 10623 | 15054 | 2256 | 2257 | 14016 | 14018 |
| | 8801 | 6140 | 6142 | 8800 | 6138 | 8357 | 8375 | 8360 | 3666 | 3668 | 11044 | 11022 |
| | 9473 | 9494 | 5001 | 5000 | 4831 | 4836 | 18327 | 19232 | 5812 | 5815 | 9999 | 7941 |
| | 7942 | 749 | 3079 | 7426 | 7451 | 8001 | 7999 | 8005 | 19635 | 4051 | 15885 | 12205 |
| | 2860 | 786 | 784 | 15576 | 15575 | 12310 | 12307 | 2306 | 3461 | 7640 | 10242 | |
| 394: | 12840 | 13577 | 8132 | 1535 | 5905 | 3211 | 3797 | 12558 | 6843 | 17949 | 15017 | 9231 |
| | 1310 | 17041 | 6367 | 18764 | 8461 | 15888 | 6866 | 6864 | 7983 | 8980 | 10079 | 15489 |
| | 11102 | 9933 | 7325 | 1749 | 8441 | 7720 | 17727 | | | | | |

Example 3

Consensus Sequence Build

ClustalW program is selected for multiple sequence alignments of an amino acid sequence of SEQ ID NO: 198 and its homologs, through SEQ ID NO: 394 and its homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. The consensus sequence of SEQ ID NO: 227 and its 25 homologs were derived according to the procedure described above and is displayed in FIG. 1.

Example 4

Identification of Amino Acid Domain by Pfam Analysis

This example illustrates the identification of amino acid domain by Pfam analysis.

The amino acid sequence of the expressed proteins that were shown to be associated with an enhanced trait were analyzed for Pfam protein family against the current Pfam collection of multiple sequence alignments and hidden Markov models using the HMMER software in the appended computer listing. The Pfam protein families for the proteins of SEQ ID NO: 198 through 394 are shown in Table 16. The Hidden Markov model databases for the identified patent families are also in the appended computer listing allowing identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 207 is characterized by two Pfam domains, i.e. "TFIIS_M" and "TFIIS_C". See also the protein with amino acids of SEQ ID NO: 213 which is characterized by three copies of the Pfam domain "WD40". In Table 16 "score" is the gathering score for the Hidden Markov Model of the domain which exceeds the gathering cutoff reported in Table 17.

TABLE 16

| PEP SEQ ID NO | GENE ID | Pfam domain name | begin | stop | score | E-value |
|---|---|---|---|---|---|---|
| 198 | CGPG106 | CMAS | 69 | 306 | −149.8 | 5.00E−05 |
| 198 | CGPG106 | Methyltransf_11 | 131 | 229 | 109.1 | 1.20E−29 |
| 198 | CGPG106 | Methyltransf_12 | 131 | 227 | 54.6 | 3.10E−13 |
| 200 | CGPG117 | SNF5 | 14 | 252 | 66.9 | 5.90E−17 |
| 202 | CGPG1288 | Cupin_3 | 57 | 131 | 130.8 | 3.40E−36 |
| 204 | CGPG1458 | Phosphorylase | 180 | 958 | 1454.7 | 0 |
| 205 | CGPG1542 | LMBR1 | 11 | 488 | 715.1 | 4.40E−212 |
| 206 | CGPG170 | Metallophos | 54 | 249 | 140.4 | 4.50E−39 |
| 207 | CGPG1828 | TFIIS_M | 206 | 327 | 203.5 | 4.50E−58 |
| 207 | CGPG1828 | TFIIS_C | 338 | 376 | 83.3 | 7.00E−22 |
| 209 | CGPG2217 | ORMDL | 14 | 156 | 356.8 | 3.20E−104 |
| 210 | CGPG2292 | Tim17 | 52 | 186 | 16.1 | 4.20E−05 |
| 210 | CGPG2292 | SAM_1 | 192 | 253 | 13.8 | 0.019 |
| 212 | CGPG2499 | Glycolytic | 4 | 339 | 588.8 | 4.50E−174 |
| 213 | CGPG2653 | WD40 | 135 | 172 | 40.3 | 6.20E−09 |
| 213 | CGPG2653 | WD40 | 235 | 271 | 40.7 | 4.60E−09 |
| 213 | CGPG2653 | WD40 | 276 | 313 | 38 | 3.00E−08 |
| 214 | CGPG2813 | HLH | 204 | 251 | 34.1 | 4.60E−07 |
| 215 | CGPG3002 | eIF-4B | 5 | 451 | −50.3 | 1.90E−10 |
| 216 | CGPG3154 | C2 | 14 | 102 | 101.8 | 1.80E−27 |
| 216 | CGPG3154 | C2 | 198 | 272 | 57.8 | 3.20E−14 |
| 217 | CGPG3235 | B_lectin | 66 | 176 | 156.8 | 5.30E−44 |
| 217 | CGPG3235 | S_locus_glycop | 189 | 315 | 227 | 3.90E−65 |
| 217 | CGPG3235 | PAN_2 | 332 | 402 | 103.9 | 4.20E−28 |

TABLE 16-continued

| PEP SEQ ID NO | GENE ID | Pfam domain name | begin | stop | score | E-value |
|---|---|---|---|---|---|---|
| 217 | CGPG3235 | Pkinase_Tyr | 488 | 757 | 75.6 | 2.10E−20 |
| 217 | CGPG3235 | Pkinase | 488 | 757 | 109 | 1.30E−29 |
| 218 | CGPG3274 | Allene_ox_cyc | 74 | 253 | 401.6 | 1.10E−117 |
| 219 | CGPG3275 | Auxin_inducible | 50 | 155 | 135.6 | 1.30E−37 |
| 220 | CGPG3363 | zf-AN1 | 21 | 58 | 10.5 | 0.0033 |
| 220 | CGPG3363 | zf-AN1 | 103 | 148 | 12.4 | 0.0019 |
| 221 | CGPG3367 | TFIIA | 9 | 375 | 556 | 3.40E−164 |
| 222 | CGPG3375 | Tryp_alpha_amyl | 33 | 111 | 55.2 | 1.90E−13 |
| 224 | CGPG3534 | Ank | 42 | 74 | 13.6 | 0.31 |
| 224 | CGPG3534 | Ank | 75 | 107 | 36.8 | 6.90E−08 |
| 224 | CGPG3534 | Ank | 108 | 140 | 1.6 | 17 |
| 224 | CGPG3534 | Pkinase_Tyr | 160 | 413 | 202.4 | 9.90E−58 |
| 224 | CGPG3534 | Pkinase | 160 | 413 | 198.5 | 1.40E−56 |
| 225 | CGPG3638 | Ribonuclease_T2 | 30 | 219 | 367.3 | 2.20E−107 |
| 226 | CGPG3918 | Metallophos | 60 | 255 | 159.1 | 1.10E−44 |
| 229 | CGPG3972 | 14-3-3 | 8 | 243 | 501.1 | 1.20E−147 |
| 230 | CGPG3990 | zf-C3HC4 | 259 | 299 | 47.3 | 4.60E−11 |
| 231 | CGPG3994 | Pkinase | 554 | 802 | 207 | 4.10E−59 |
| 231 | CGPG3994 | Pkinase_Tyr | 554 | 802 | 233 | 5.90E−67 |
| 232 | CGPG4026 | CMAS | 59 | 320 | −174.5 | 0.003 |
| 232 | CGPG4026 | Methyltransf_11 | 122 | 220 | 96.3 | 8.10E−26 |
| 232 | CGPG4026 | Methyltransf_12 | 122 | 218 | 37 | 5.90E−08 |
| 232 | CGPG4026 | Sterol_MT_C | 229 | 358 | 301.1 | 1.80E−87 |
| 233 | CGPG4048 | Pkinase | 21 | 275 | 342.1 | 8.80E−100 |
| 233 | CGPG4048 | Pkinase_Tyr | 21 | 275 | 65.1 | 1.20E−19 |
| 233 | CGPG4048 | NAF | 304 | 364 | 104.5 | 2.80E−28 |
| 234 | CGPG4052 | DUF298 | 127 | 242 | 222.4 | 9.20E−64 |
| 236 | CGPG4058 | Asp | 99 | 437 | −128.4 | 4.60E−06 |
| 237 | CGPG4069 | adh_short | 31 | 218 | −16.7 | 4.80E−05 |
| 239 | CGPG4088 | SWIB | 324 | 399 | 96.4 | 7.80E−26 |
| 241 | CGPG4121 | Cyclin_N | 58 | 190 | 133.7 | 4.80E−37 |
| 241 | CGPG4121 | Cyclin_C | 192 | 314 | 44.3 | 3.70E−10 |
| 242 | CGPG4122 | zf-C3HC4 | 100 | 141 | 27.6 | 4.10E−05 |
| 243 | CGPG4140 | p450 | 48 | 484 | 140.8 | 3.30E−39 |
| 244 | CGPG4154 | zf-CCCH | 90 | 115 | 22.6 | 0.0012 |
| 245 | CGPG4311 | FBPase | 70 | 395 | 347.9 | 1.50E−101 |
| 247 | CGPG4369 | BolA | 10 | 79 | 92.1 | 1.60E−24 |
| 248 | CGPG442 | 2-Hacid_dh | 85 | 394 | 140.9 | 3.20E−39 |
| 248 | CGPG442 | 2-Hacid_dh_C | 187 | 362 | 293 | 5.20E−85 |
| 248 | CGPG442 | ACT | 551 | 621 | 39.9 | 8.10E−09 |
| 249 | CGPG4454 | p450 | 45 | 447 | −35.5 | 2.10E−09 |
| 250 | CGPG4456 | p450 | 75 | 502 | 103.6 | 5.30E−28 |
| 252 | CGPG4588 | Auxin_inducible | 1 | 102 | 151.5 | 2.00E−42 |
| 253 | CGPG4765 | DUF868 | 28 | 304 | 175.5 | 1.20E−49 |
| 255 | CGPG4912 | WD40 | 243 | 281 | 31 | 3.80E−06 |
| 256 | CGPG4926 | WD40 | 42 | 79 | 22.8 | 0.0012 |
| 256 | CGPG4926 | WD40 | 126 | 163 | 25.8 | 0.00014 |
| 257 | CGPG4967 | Asp | 71 | 424 | −94.7 | 4.70E−08 |
| 258 | CGPG4977 | Usp | 3 | 157 | 85.3 | 1.80E−22 |
| 259 | CGPG5001 | adh_short | 5 | 181 | 6.4 | 1.40E−06 |
| 260 | CGPG5025 | adh_short | 30 | 212 | 5.7 | 1.50E−06 |
| 261 | CGPG5041 | DUF26 | 77 | 132 | 84.3 | 3.40E−22 |
| 261 | CGPG5041 | DUF26 | 188 | 242 | 100.7 | 4.00E−27 |
| 261 | CGPG5041 | Pkinase | 333 | 558 | 60.3 | 5.70E−15 |
| 262 | CGPG5116 | ArfGap | 15 | 137 | 174.1 | 3.20E−49 |
| 262 | CGPG5116 | C2 | 182 | 261 | 101.4 | 2.40E−27 |
| 263 | CGPG5144 | p450 | 61 | 535 | 157.9 | 2.40E−44 |
| 264 | CGPG5171 | p450 | 35 | 496 | 137 | 4.60E−38 |
| 265 | CGPG5194 | DUF1191 | 25 | 308 | 616.2 | 2.60E−182 |
| 268 | CGPG5221 | p450 | 30 | 499 | 135.4 | 1.40E−37 |
| 269 | CGPG5269 | PCI | 297 | 401 | 108.9 | 1.30E−29 |
| 270 | CGPG5404 | Peptidase_S10 | 68 | 480 | 683.3 | 1.70E−202 |
| 271 | CGPG5432 | MtN3_slv | 12 | 99 | 145.4 | 1.40E−40 |
| 271 | CGPG5432 | MtN3_slv | 133 | 219 | 140.4 | 4.40E−39 |
| 272 | CGPG5518 | Ribosomal_S8e | 1 | 238 | 325.9 | 6.30E−95 |
| 273 | CGPG5535 | WD40 | 335 | 371 | 28.8 | 1.80E−05 |
| 273 | CGPG5535 | WD40 | 434 | 471 | 37.1 | 5.50E−08 |
| 273 | CGPG5535 | WD40 | 476 | 513 | 47.2 | 5.20E−11 |
| 273 | CGPG5535 | WD40 | 518 | 555 | 35.6 | 1.60E−07 |
| 273 | CGPG5535 | WD40 | 567 | 604 | 36.1 | 1.10E−07 |
| 273 | CGPG5535 | WD40 | 621 | 658 | 34.9 | 2.50E−07 |
| 273 | CGPG5535 | WD40 | 663 | 706 | 35.5 | 1.60E−07 |
| 274 | CGPG5540 | ESCRT-III | 21 | 207 | 265.7 | 8.40E−77 |
| 275 | CGPG5568 | AA_permease | 69 | 521 | −67.1 | 0.00013 |
| 276 | CGPG5577 | SMC_N | 21 | 1049 | −2.8 | 1.50E−11 |
| 277 | CGPG5587 | Thioredoxin | 78 | 199 | 0.1 | 0.00015 |
| 278 | CGPG5594 | Histone | 27 | 100 | 99.6 | 8.80E−27 |

TABLE 16-continued

| PEP SEQ ID NO | GENE ID | Pfam domain name | begin | stop | score | E-value |
|---|---|---|---|---|---|---|
| 279 | CGPG5633 | PGAM | 91 | 277 | 153.2 | 6.30E−43 |
| 280 | CGPG5640 | Aminotran_1_2 | 30 | 385 | 362.1 | 8.00E−106 |
| 281 | CGPG5646 | iPGM_N | 2 | 363 | 876.8 | 9.10E−261 |
| 281 | CGPG5646 | Metalloenzyme | 373 | 488 | 173.3 | 5.40E−49 |
| 282 | CGPG5656 | Gln-synt_N | 17 | 99 | 85.7 | 1.30E−22 |
| 282 | CGPG5656 | Gln-synt_C | 105 | 358 | 528.1 | 8.50E−156 |
| 283 | CGPG5659 | Aminotran_3 | 35 | 361 | 321.7 | 1.20E−93 |
| 284 | CGPG5661 | PK | 1 | 345 | 702 | 3.80E−208 |
| 284 | CGPG5661 | PK_C | 355 | 469 | 115.4 | 1.50E−31 |
| 285 | CGPG5684 | Glycolytic | 4 | 339 | 578.6 | 5.60E−171 |
| 286 | CGPG5694 | TIM | 4 | 246 | 465.9 | 4.50E−137 |
| 287 | CGPG5704 | NDK | 2 | 136 | 329 | 7.30E−96 |
| 288 | CGPG5714 | NDK | 4 | 138 | 266.4 | 5.20E−77 |
| 289 | CGPG5721 | Rib_5-P_isom_A | 47 | 215 | 354.4 | 1.70E−103 |
| 290 | CGPG5728 | zf-CCCH | 80 | 106 | 39.3 | 1.20E−08 |
| 291 | CGPG5757 | Sad1_UNC | 203 | 330 | 195.6 | 1.00E−55 |
| 292 | CGPG5764 | Actin | 11 | 140 | 36.4 | 6.60E−08 |
| 293 | CGPG5783 | TPT | 272 | 442 | 71.5 | 2.40E−18 |
| 294 | CGPG5791 | AA_permease | 114 | 588 | 704.9 | 5.40E−209 |
| 295 | CGPG5799 | Aa_trans | 206 | 601 | 453 | 3.60E−133 |
| 296 | CGPG5856 | Pkinase | 79 | 353 | 159.5 | 8.00E−45 |
| 296 | CGPG5856 | Pkinase_Tyr | 79 | 353 | 149.4 | 9.00E−42 |
| 297 | CGPG5927 | AAA | 58 | 248 | 252.4 | 8.70E−73 |
| 297 | CGPG5927 | AAA | 322 | 510 | 290.8 | 2.40E−84 |
| 298 | CGPG5941 | PfkB | 42 | 336 | 86.2 | 9.00E−23 |
| 299 | CGPG5957 | CBM_20 | 86 | 178 | 23 | 5.70E−07 |
| 300 | CGPG5967 | DUF822 | 2 | 147 | 307.1 | 2.90E−89 |
| 301 | CGPG6040 | LEA_3 | 1 | 88 | 178.7 | 1.30E−50 |
| 302 | CGPG607 | PurA | 28 | 275 | 44.4 | 5.80E−12 |
| 303 | CGPG6178 | DUF1336 | 53 | 267 | 427.9 | 1.30E−125 |
| 304 | CGPG6185 | UQ_con | 7 | 148 | 197.9 | 2.10E−56 |
| 305 | CGPG6306 | APC8 | 1 | 161 | 401.5 | 1.10E−117 |
| 305 | CGPG6306 | TPR_1 | 339 | 372 | 34.7 | 2.90E−07 |
| 305 | CGPG6306 | TPR_2 | 339 | 372 | 23.8 | 0.00058 |
| 305 | CGPG6306 | TPR_2 | 373 | 406 | 23.7 | 0.00062 |
| 305 | CGPG6306 | TPR_1 | 373 | 406 | 34.1 | 4.40E−07 |
| 305 | CGPG6306 | TPR_2 | 407 | 440 | 22 | 0.0019 |
| 305 | CGPG6306 | TPR_1 | 407 | 440 | 24.3 | 0.00039 |
| 306 | CGPG6318 | MFS_1 | 31 | 496 | 35.3 | 1.90E−07 |
| 306 | CGPG6318 | PTR2 | 92 | 484 | 208.6 | 1.30E−59 |
| 307 | CGPG6326 | Kelch_1 | 34 | 79 | 45 | 2.40E−10 |
| 307 | CGPG6326 | Kelch_2 | 34 | 79 | 43.5 | 6.80E−10 |
| 307 | CGPG6326 | Kelch_1 | 152 | 198 | 26.7 | 7.70E−05 |
| 307 | CGPG6326 | Kelch_2 | 152 | 198 | 32.1 | 1.80E−06 |
| 307 | CGPG6326 | Kelch_2 | 203 | 249 | 20.2 | 0.0067 |
| 307 | CGPG6326 | Kelch_1 | 204 | 248 | 7.9 | 0.45 |
| 308 | CGPG6370 | Gp_dh_N | 3 | 151 | 326 | 5.80E−95 |
| 308 | CGPG6370 | Gp_dh_C | 156 | 313 | 362 | 8.80E−106 |
| 309 | CGPG6429 | ADH_N | 25 | 135 | 159.4 | 8.40E−45 |
| 309 | CGPG6429 | ADH_zinc_N | 166 | 305 | 105.1 | 1.90E−28 |
| 310 | CGPG6440 | PK | 1 | 345 | 789.4 | 1.90E−234 |
| 310 | CGPG6440 | PK_C | 357 | 471 | 167.5 | 3.10E−47 |
| 310 | CGPG6440 | PEP-utilizers | 486 | 575 | 134 | 3.60E−37 |
| 311 | CGPG6516 | Aldedh | 19 | 478 | 778.3 | 4.10E−231 |
| 312 | CGPG6653 | LRRNT_2 | 23 | 66 | 49.3 | 1.20E−11 |
| 312 | CGPG6653 | LRR_1 | 71 | 93 | 12.1 | 1.4 |
| 312 | CGPG6653 | LRR_1 | 95 | 117 | 10.5 | 2.8 |
| 312 | CGPG6653 | LRR_1 | 119 | 142 | 13 | 0.93 |
| 312 | CGPG6653 | LRR_1 | 144 | 166 | 19.5 | 0.011 |
| 312 | CGPG6653 | LRR_1 | 168 | 190 | 10.6 | 2.7 |
| 312 | CGPG6653 | LRR_1 | 192 | 214 | 8.8 | 5.7 |
| 312 | CGPG6653 | LRR_1 | 289 | 311 | 17.4 | 0.046 |
| 312 | CGPG6653 | LRR_1 | 313 | 335 | 10.8 | 2.4 |
| 312 | CGPG6653 | LRR_1 | 337 | 359 | 10.7 | 2.5 |
| 312 | CGPG6653 | LRR_1 | 361 | 384 | 12 | 1.5 |
| 312 | CGPG6653 | LRR_1 | 409 | 431 | 10.4 | 2.9 |
| 312 | CGPG6653 | LRR_1 | 457 | 479 | 11.9 | 1.5 |
| 312 | CGPG6653 | LRR_1 | 481 | 503 | 10.4 | 3 |
| 312 | CGPG6653 | LRR_1 | 505 | 527 | 10.5 | 2.8 |
| 312 | CGPG6653 | LRR_1 | 529 | 551 | 11.1 | 2.2 |
| 312 | CGPG6653 | LRR_1 | 553 | 575 | 9.3 | 4.7 |
| 312 | CGPG6653 | LRR_1 | 577 | 598 | 11.1 | 2.1 |
| 312 | CGPG6653 | Pkinase | 695 | 966 | 134.8 | 2.20E−37 |
| 312 | CGPG6653 | Pkinase_Tyr | 695 | 966 | 134.5 | 2.60E−37 |
| 313 | CGPG6712 | PGAM | 91 | 277 | 154.6 | 2.30E−43 |
| 314 | CGPG6737 | PGAM | 92 | 253 | 173 | 6.80E−49 |
| 315 | CGPG6747 | FBPase | 106 | 429 | 448.6 | 7.20E−132 |

TABLE 16-continued

| PEP SEQ ID NO | GENE ID | Pfam domain name | begin | stop | score | E-value |
|---|---|---|---|---|---|---|
| 316 | CGPG6796 | Alpha-amylase | 14 | 452 | 199.5 | 7.00E−57 |
| 318 | CGPG6810 | GH3 | 12 | 561 | 1261.5 | 0 |
| 320 | CGPG6953 | Ank | 121 | 153 | 50.4 | 5.60E−12 |
| 321 | CGPG7121 | L51_S25_CI-B8 | 20 | 93 | 108.9 | 1.40E−29 |
| 322 | CGPG7163 | Prenylcys_lyase | 149 | 500 | 788 | 5.20E−234 |
| 324 | CGPG7206 | Aldo_ket_red | 14 | 298 | 389.4 | 4.80E−114 |
| 325 | CGPG7225 | Subtilisin_N | 48 | 125 | 84.3 | 3.30E−22 |
| 326 | CGPG7267 | DUF588 | 34 | 164 | 154.6 | 2.40E−43 |
| 327 | CGPG7272 | DUF1005 | 50 | 254 | 524.8 | 8.50E−155 |
| 328 | CGPG7281 | FA_hydroxylase | 86 | 229 | 361.9 | 9.30E−106 |
| 329 | CGPG7308 | CoA_binding | 1 | 100 | −10.8 | 0.04 |
| 329 | CGPG7308 | NAD_Gly3P_dh_N | 4 | 147 | −0.6 | 2.00E−06 |
| 329 | CGPG7308 | F420_oxidored | 5 | 251 | 282.5 | 7.50E−82 |
| 330 | CGPG7316 | Anti-silence | 1 | 155 | 419.9 | 3.20E−123 |
| 331 | CGPG7371 | Response_reg | 29 | 157 | 94.8 | 2.30E−25 |
| 332 | CGPG7457 | PfkB | 114 | 408 | 146.6 | 6.00E−41 |
| 335 | CGPG7636 | LSM | 13 | 81 | 78.2 | 2.40E−20 |
| 338 | CGPG7804 | FAR1 | 62 | 279 | 364.9 | 1.20E−106 |
| 338 | CGPG7804 | SWIM | 556 | 589 | 37.3 | 4.90E−08 |
| 339 | CGPG7823 | Rotamase | 104 | 188 | 91.8 | 1.90E−24 |
| 339 | CGPG7823 | Rhodanese | 203 | 298 | 44.1 | 4.40E−10 |
| 340 | CGPG7828 | DnaJ | 12 | 81 | 66.1 | 1.00E−16 |
| 340 | CGPG7828 | zf-CSL | 96 | 174 | 25.2 | 0.00021 |
| 343 | CGPG7986 | F-box | 48 | 96 | 31.2 | 3.40E−06 |
| 343 | CGPG7986 | LRR_1 | 189 | 216 | 9 | 5.4 |
| 343 | CGPG7986 | LRR_1 | 428 | 451 | 8.2 | 7.7 |
| 343 | CGPG7986 | LRR_1 | 561 | 584 | 8.4 | 6.9 |
| 345 | CGPG8015 | zf-CCHC | 18 | 35 | 24.2 | 7.90E−05 |
| 349 | CGPG8083 | Tryp_alpha_amyl | 28 | 105 | 37.6 | 3.90E−08 |
| 350 | CGPG8106 | BURP | 56 | 280 | 380 | 3.20E−111 |
| 353 | CGPG8152 | PAP_fibrillin | 9 | 124 | 45.9 | 1.20E−10 |
| 354 | CGPG8166 | PBD | 118 | 166 | 49.9 | 7.80E−12 |
| 355 | CGPG8377 | Oleosin | 30 | 109 | 55 | 2.20E−13 |
| 356 | CGPG8976 | Ceramidase_alk | 50 | 795 | 1545.5 | 0 |
| 357 | CGPG8987 | FH2 | 439 | 839 | 552.9 | 3.10E−163 |
| 358 | CGPG9013 | NAD_binding_1 | 234 | 350 | 138.6 | 1.50E−38 |
| 359 | CGPG9080 | EGF_CA | 315 | 357 | 42.2 | 1.60E−09 |
| 359 | CGPG9080 | Pkinase | 433 | 716 | 120.3 | 4.90E−33 |
| 359 | CGPG9080 | Pkinase_Tyr | 433 | 704 | 113.1 | 7.40E−31 |
| 360 | CGPG9081 | DUF676 | 30 | 247 | 319 | 7.50E−93 |
| 361 | CGPG9130 | MMR_HSR1 | 266 | 369 | 71.9 | 1.80E−18 |
| 362 | CGPG9133 | PPR | 125 | 159 | 13.2 | 0.19 |
| 362 | CGPG9133 | PPR | 161 | 195 | 2.8 | 3.2 |
| 362 | CGPG9133 | PPR | 196 | 230 | 22.7 | 0.0012 |
| 362 | CGPG9133 | PPR | 232 | 266 | 42.1 | 1.70E−09 |
| 362 | CGPG9133 | PPR | 267 | 301 | 29.4 | 1.20E−05 |
| 362 | CGPG9133 | PPR | 302 | 336 | 49.4 | 1.10E−11 |
| 362 | CGPG9133 | PPR | 337 | 371 | 32.9 | 1.00E−06 |
| 362 | CGPG9133 | PPR | 372 | 407 | 7.9 | 0.8 |
| 362 | CGPG9133 | PPR | 408 | 442 | 49.7 | 8.80E−12 |
| 362 | CGPG9133 | PPR | 443 | 477 | 22.6 | 0.0013 |
| 362 | CGPG9133 | PPR | 478 | 512 | 37.8 | 3.40E−08 |
| 362 | CGPG9133 | PPR | 513 | 547 | 42.9 | 1.00E−09 |
| 362 | CGPG9133 | PPR | 548 | 582 | 30.2 | 6.70E−06 |
| 362 | CGPG9133 | PPR | 583 | 617 | 38.4 | 2.20E−08 |
| 363 | CGPG9134 | HD | 91 | 232 | 46.2 | 1.00E−10 |
| 364 | CGPG9137 | RnaAD | 65 | 337 | 122.2 | 1.30E−33 |
| 365 | CGPG9141 | Pantoate_transf | 40 | 306 | 402.9 | 4.40E−118 |
| 366 | CGPG9145 | Lung_7-TM_R | 168 | 423 | 385.2 | 8.80E−113 |
| 367 | CGPG9147 | DNA_pol_E_B | 178 | 389 | 249.9 | 5.00E−72 |
| 368 | CGPG9148 | p450 | 36 | 502 | 128.8 | 1.40E−35 |
| 369 | CGPG9155 | Pkinase | 86 | 347 | 56.9 | 6.10E−14 |
| 369 | CGPG9155 | Pkinase_Tyr | 86 | 351 | 73.7 | 2.90E−20 |
| 370 | CGPG9163 | Na_H_Exchanger | 12 | 378 | 280.1 | 3.80E−81 |
| 370 | CGPG9163 | TrkA_N | 416 | 531 | 118.8 | 1.50E−32 |
| 371 | CGPG9170 | Complex1_30kDa | 90 | 158 | 103.8 | 4.70E−28 |
| 371 | CGPG9170 | Complex1_49kDa | 298 | 537 | 2.8 | 6.10E−13 |
| 373 | CGPG9183 | HTH_11 | 1 | 56 | 72.4 | 1.30E−18 |
| 373 | CGPG9183 | BPL_LipA_LipB | 84 | 182 | 94.5 | 2.90E−25 |
| 373 | CGPG9183 | BPL_C | 275 | 322 | 43.3 | 7.80E−10 |
| 374 | CGPG9186 | DHBP_synthase | 8 | 203 | 370.6 | 2.20E−108 |
| 374 | CGPG9186 | GTP_cyclohydro2 | 208 | 366 | −2.3 | 3.80E−10 |
| 375 | CGPG9205 | NTP_transferase | 4 | 288 | 421 | 1.50E−123 |
| 375 | CGPG9205 | MannoseP_isomer | 299 | 465 | 350.8 | 2.00E−102 |
| 375 | CGPG9205 | Cupin_2 | 380 | 450 | 55.3 | 1.80E−13 |
| 376 | CGPG9207 | HTH_11 | 6 | 59 | 50.9 | 3.90E−12 |
| 376 | CGPG9207 | BPL_LipA_LipB | 83 | 180 | 104.5 | 2.80E−28 |

TABLE 16-continued

| PEP SEQ ID NO | GENE ID | Pfam domain name | begin | stop | score | E-value |
|---|---|---|---|---|---|---|
| 376 | CGPG9207 | BPL_C | 271 | 317 | 46.5 | 8.50E-11 |
| 377 | CGPG9219 | Complex1_30kDa | 107 | 175 | 99.8 | 7.60E-27 |
| 377 | CGPG9219 | Complex1_49kDa | 311 | 537 | -11.6 | 5.90E-12 |
| 378 | CGPG9220 | GDC-P | 3 | 443 | 700.9 | 8.30E-208 |
| 379 | CGPG9230 | Peptidase_S10 | 88 | 488 | 657.2 | 1.20E-194 |
| 381 | CGPG9238 | Tryp_alpha_amyl | 36 | 114 | 56 | 1.20E-13 |
| 382 | CGPG9259 | Mit_rib_S27 | 14 | 93 | 135.3 | 1.50E-37 |
| 383 | CGPG9271 | NPH3 | 215 | 418 | 189.9 | 5.60E-54 |
| 384 | CGPG9275 | ETC_C1_NDUFA5 | 35 | 91 | 112.8 | 9.00E-31 |
| 386 | CGPG9283 | DUF1195 | 6 | 161 | 180.3 | 4.30E-51 |
| 387 | CGPG9309 | MAP65_ASE1 | 38 | 575 | 52.8 | 1.10E-12 |
| 389 | CGPG9322 | Pkinase | 103 | 383 | 170 | 5.40E-48 |
| 389 | CGPG9322 | Pkinase_Tyr | 103 | 383 | 158.7 | 1.30E-44 |
| 390 | CGPG9335 | Sugar_tr | 7 | 726 | 210.6 | 3.30E-60 |
| 390 | CGPG9335 | MFS_1 | 11 | 685 | 107.7 | 3.00E-29 |
| 391 | CGPG9341 | RMMBL | 531 | 573 | 35.9 | 1.20E-07 |
| 392 | CGPG9344 | TPR_2 | 531 | 564 | 23.9 | 0.00051 |
| 393 | CGPG9345 | UPF0261 | 5 | 432 | 483.7 | 2.00E-142 |
| 394 | CGPG976 | Glyco_transf_8 | 216 | 533 | 401.3 | 1.30E-117 |

TABLE 17

| Pfam domain name | accession number | gathering cutoff | domain description |
|---|---|---|---|
| 14-3-3 | PF00244.9 | 25 | 14-3-3 protein |
| 2-Hacid_dh | PF00389.19 | 11.2 | D-isomer specific 2-hydroxyacid dehydrogenase, catalytic domain |
| 2-Hacid_dh_C | PF02826.7 | -82.2 | D-isomer specific 2-hydroxyacid dehydrogenase, NAD binding domain |
| AAA | PF00004.18 | 12.3 | ATPase family associated with various cellular activities (AAA) |
| AA_permease | PF00324.10 | -120.8 | Amino acid permease |
| ACT | PF01842.13 | 0 | ACT domain |
| ADH_N | PF08240.2 | -14.5 | Alcohol dehydrogenase GroES-like domain |
| ADH_zinc_N | PF00107.16 | 23.8 | Zinc-binding dehydrogenase |
| APC8 | PF04049.3 | -19.8 | Anaphase promoting complex subunit 8/Cdc23 |
| Aa_trans | PF01490.7 | -128.4 | Transmembrane amino acid transporter protein |
| Actin | PF00022.8 | -30 | Actin |
| Aldedh | PF00171.11 | -209.3 | Aldehyde dehydrogenase family |
| Aldo_ket_red | PF00248.10 | -97 | Aldo/keto reductase family |
| Allene_ox_cyc | PF06351.2 | 25 | Allene oxide cyclase |
| Alpha-amylase | PF00128.12 | -93 | Alpha amylase, catalytic domain |
| Aminotran_1_2 | PF00155.10 | -57.5 | Aminotransferase class I and II |
| Aminotran_3 | PF00202.10 | -207.6 | Aminotransferase class-III |
| Ank | PF00023.18 | 0 | Ankyrin repeat |
| Anti-silence | PF04729.4 | 25 | Anti-silencing protein, ASF1-like |
| ArfGap | PF01412.8 | -17 | Putative GTPase activating protein for Arf |
| Asp | PF00026.13 | -186.1 | Eukaryotic aspartyl protease |
| Auxin_inducible | PF02519.4 | -15 | Auxin responsive protein |
| BPL_C | PF02237.6 | 16 | Biotin protein ligase C terminal domain |
| BPL_LipA_LipB | PF03099.8 | -0.2 | Biotin/lipoate A/B protein ligase family |
| BURP | PF03181.5 | -52 | BURP domain |
| B_lectin | PF01453.14 | 28.2 | D-mannose binding lectin |
| BolA | PF01722.7 | 23 | BolA-like protein |
| C2 | PF00168.18 | 3.7 | C2 domain |
| CBM_20 | PF00686.9 | -3 | Starch binding domain |
| CMAS | PF02353.10 | -177.9 | Cyclopropane-fatty-acyl-phospholipid synthase |
| Ceramidase_alk | PF04734.3 | 25 | Neutral/alkaline non-lysosomal ceramidase |
| CoA_binding | PF02629.8 | -12.8 | CoA binding domain |
| Complex1_30kDa | PF00329.8 | -3 | Respiratory-chain NADH dehydrogenase, 30 Kd subunit |
| Complex1_49kDa | PF00346.8 | -108 | Respiratory-chain NADH dehydrogenase, 49 Kd subunit |
| Cupin_2 | PF07883.1 | 16.6 | Cupin domain |
| Cupin_3 | PF05899.2 | 4.4 | Protein of unknown function (DUF861) |
| Cyclin_C | PF02984.8 | -13 | Cyclin, C-terminal domain |
| Cyclin_N | PF00134.13 | -14.7 | Cyclin, N-terminal domain |
| DHBP_synthase | PF00926.10 | -116 | 3,4-dihydroxy-2-butanone 4-phosphate synthase |
| DNA_pol_E_B | PF04042.5 | -47.5 | DNA polymerase alpha/epsilon subunit B |

TABLE 17-continued

| Pfam domain name | accession number | gathering cutoff | domain description |
|---|---|---|---|
| DUF1005 | PF06219.2 | 25 | Protein of unknown function (DUF1005) |
| DUF1191 | PF06697.2 | 25 | Protein of unknown function (DUF1191) |
| DUF1195 | PF06708.1 | 25 | Protein of unknown function (DUF1195) |
| DUF1336 | PF07059.2 | −78.2 | Protein of unknown function (DUF1336) |
| DUF26 | PF01657.7 | 0 | Domain of unknown function DUF26 |
| DUF298 | PF03556.6 | 25 | Domain of unknown function (DUF298) |
| DUF588 | PF04535.2 | 25 | Domain of unknown function (DUF588) |
| DUF676 | PF05057.4 | −60.7 | Putative serine esterase (DUF676) |
| DUF822 | PF05687.3 | 25 | Plant protein of unknown function (DUF822) |
| DUF868 | PF05910.2 | 25 | Plant protein of unknown function (DUF868) |
| DnaJ | PF00226.19 | −8 | DnaJ domain |
| EGF_CA | PF07645.4 | 24.5 | Calcium binding EGF domain |
| ESCRT-III | PF03357.10 | −35.4 | ESCRT-III complex subunit |
| ETC_C1_NDUFA5 | PF04716.3 | 25 | ETC complex I subunit conserved region |
| F-box | PF00646.21 | 13.6 | F-box domain |
| F420_oxidored | PF03807.6 | −34.5 | NADP oxidoreductase coenzyme F420-dependent |
| FAR1 | PF03101.4 | 0 | FAR1 family |
| FA_hydroxylase | PF04116.2 | −64.1 | Fatty acid hydroxylase |
| FBPase | PF00316.10 | −170.3 | Fructose-1-6-bisphosphatase |
| FH2 | PF02181.13 | −98.3 | Formin Homology 2 Domain |
| GDC-P | PF02347.5 | −306.2 | Glycine cleavage system P-protein |
| GH3 | PF03321.3 | −336 | GH3 auxin-responsive promoter |
| GTP_cyclohydro2 | PF00925.11 | −49 | GTP cyclohydrolase II |
| Gln-synt_C | PF00120.14 | −124 | Glutamine synthetase, catalytic domain |
| Gln-synt_N | PF03951.9 | 9 | Glutamine synthetase, beta-Grasp domain |
| Glyco_transf_8 | PF01501.9 | −43.2 | Glycosyl transferase family 8 |
| Glycolytic | PF00274.9 | −174.5 | Fructose-bisphosphate aldolase class-I |
| Gp_dh_C | PF02800.9 | −64.1 | Glyceraldehyde 3-phosphate dehydrogenase, C-terminal domain |
| Gp_dh_N | PF00044.12 | −74.2 | Glyceraldehyde 3-phosphate dehydrogenase, NAD binding domain |
| HD | PF01966.11 | 18 | HD domain |
| HLH | PF00010.15 | 8.2 | Helix-loop-helix DNA-binding domain |
| HTH_11 | PF08279.1 | 11.3 | HTH domain |
| Histone | PF00125.13 | 17.4 | Core histone H2A/H2B/H3/H4 |
| Kelch_1 | PF01344.14 | 7.8 | Kelch motif |
| Kelch_2 | PF07646.4 | 14 | Kelch motif |
| L51_S25_CI-B8 | PF05047.5 | 25 | Mitochondrial ribosomal protein L51/S25/CI-B8 domain |
| LEA_3 | PF03242.3 | 25 | Late embryogenesis abundant protein |
| LMBR1 | PF04791.5 | −116.3 | LMBR1-like membrane protein |
| LRRNT_2 | PF08263.2 | 18.6 | Leucine rich repeat N-terminal domain |
| LRR_1 | PF00560.21 | 7.7 | Leucine Rich Repeat |
| LSM | PF01423.12 | 13.7 | LSM domain |
| Lung_7-TM_R | PF06814.3 | 25 | Lung seven transmembrane receptor |
| MAP65_ASE1 | PF03999.2 | −134.8 | Microtubule associated protein (MAP65/ASE1 family) |
| MFS_1 | PF07690.5 | 23.5 | Major Facilitator Superfamily |
| MMR_HSR1 | PF01926.11 | 31.2 | GTPase of unknown function |
| MannoseP_isomer | PF01050.8 | −70 | Mannose-6-phosphate isomerase |
| Metalloenzyme | PF01676.7 | −14.4 | Metalloenzyme superfamily |
| Metallophos | PF00149.17 | 22 | Calcineurin-like phosphoesterase |
| Methyltransf_11 | PF08241.1 | 17.1 | Methyltransferase domain |
| Methyltransf_12 | PF08242.1 | 21.4 | Methyltransferase domain |
| Mit_rib_S27 | PF08293.1 | 25 | Mitochondrial ribosomal subunit S27 |
| MtN3_slv | PF03083.5 | −0.8 | MtN3/saliva family |
| NAD_Gly3P_dh_N | PF01210.12 | −44 | NAD-dependent glycerol-3-phosphate dehydrogenase N-terminus |
| NAD_binding_1 | PF00175.10 | −3.9 | Oxidoreductase NAD-binding domain |
| NAF | PF03822.4 | 4.5 | NAF domain |
| NDK | PF00334.9 | −59.9 | Nucleoside diphosphate kinase |
| NPH3 | PF03000.4 | 25 | NPH3 family |
| NTP_transferase | PF00483.12 | −90.5 | Nucleotidyl transferase |
| Na_H_Exchanger | PF00999.10 | −67.9 | Sodium/hydrogen exchanger family |
| ORMDL | PF04061.4 | 25 | ORMDL family |
| Oleosin | PF01277.7 | −27 | Oleosin |
| PAN_2 | PF08276.2 | −4.9 | PAN-like domain |
| PAP_fibrillin | PF04755.2 | 25 | PAP_fibrillin |
| PBD | PF00786.17 | 12.2 | P21-Rho-binding domain |
| PCI | PF01399.15 | 25 | PCI domain |
| PEP-utilizers | PF00391.12 | 10 | PEP-utilising enzyme, mobile domain |
| PGAM | PF00300.12 | −3 | Phosphoglycerate mutase family |
| PK | PF00224.10 | −244 | Pyruvate kinase, barrel domain |

TABLE 17-continued

| Pfam domain name | accession number | gathering cutoff | domain description |
|---|---|---|---|
| PK_C | PF02887.5 | −44 | Pyruvate kinase, alpha/beta domain |
| PPR | PF01535.11 | 0 | PPR repeat |
| PTR2 | PF00854.12 | −50 | POT family |
| Pantoate_transf | PF02548.5 | −93 | Ketopantoate hydroxymethyltransferase |
| Peptidase_S10 | PF00450.11 | −198 | Serine carboxypeptidase |
| PfkB | PF00294.13 | −67.8 | pfkB family carbohydrate kinase |
| Phosphorylase | PF00343.9 | −601.1 | Carbohydrate phosphorylase |
| Pkinase | PF00069.14 | −70.8 | Protein kinase domain |
| Pkinase_Tyr | PF07714.5 | 65 | Protein tyrosine kinase |
| Prenylcys_lyase | PF07156.3 | −164.1 | Prenylcysteine lyase |
| PurA | PF04845.3 | 25 | PurA ssDNA and RNA-binding protein |
| RMMBL | PF07521.1 | 18.5 | RNA-metabolising metallo-beta-lactamase |
| Response_reg | PF00072.12 | 4 | Response regulator receiver domain |
| Rhodanese | PF00581.9 | 25 | Rhodanese-like domain |
| Rib_5-P_isom_A | PF06026.4 | 25 | Ribose 5-phosphate isomerase A (phosphoriboisomerase A) |
| Ribonuclease_T2 | PF00445.8 | −53 | Ribonuclease T2 family |
| Ribosomal_S8e | PF01201.11 | 25 | Ribosomal protein S8e |
| Rotamase | PF00639.10 | 4 | PPIC-type PPIASE domain |
| RrnaAD | PF00398.9 | −73.3 | Ribosomal RNA adenine dimethylase |
| SAM_1 | PF00536.18 | 11.3 | SAM domain (Sterile alpha motif) |
| SMC_N | PF02463.8 | −95.8 | RecF/RecN/SMC N terminal domain |
| SNF5 | PF04855.3 | 25 | SNF5/SMARCB1/INI1 |
| SWIB | PF02201.9 | −7 | SWIB/MDM2 domain |
| SWIM | PF04434.7 | 10 | SWIM zinc finger |
| S_locus_glycop | PF00954.11 | −12.7 | S-locus glycoprotein family |
| Sad1_UNC | PF07738.2 | −20.4 | Sad1/UNC-like C-terminal |
| Sterol_MT_C | PF08498.1 | 30.5 | Sterol methyltransferase C-terminal |
| Subtilisin_N | PF05922.6 | 26.1 | Subtilisin N-terminal Region |
| Sugar_tr | PF00083.13 | −85 | Sugar (and other) transporter |
| TFIIA | PF03153.4 | 25 | Transcription factor IIA, alpha/beta subunit |
| TFIIS_C | PF01096.9 | 15 | Transcription factor S-II (TFIIS) |
| TFIIS_M | PF07500.3 | 7.4 | Transcription factor S-II (TFIIS), central domain |
| TIM | PF00121.8 | −97 | Triosephosphate isomerase |
| TPR_1 | PF00515.16 | 7.7 | Tetratricopeptide repeat |
| TPR_2 | PF07719.5 | 20.1 | Tetratricopeptide repeat |
| TPT | PF03151.7 | −15.3 | Triose-phosphate Transporter family |
| Thioredoxin | PF00085.9 | −25.7 | Thioredoxin |
| Tim17 | PF02466.8 | 2.7 | Tim17/Tim22/Tim23 family |
| TrkA_N | PF02254.7 | 4.7 | TrkA-N domain |
| Tryp_alpha_amyl | PF00234.10 | −4 | Protease inhibitor/seed storage/LTP family |
| UPF0261 | PF06792.1 | 25 | Uncharacterised protein family (UPF0261) |
| UQ_con | PF00179.16 | −30 | Ubiquitin-conjugating enzyme |
| Usp | PF00582.16 | 36.1 | Universal stress protein family |
| WD40 | PF00400.20 | 21.5 | WD domain, G-beta repeat |
| adh_short | PF00106.14 | −17 | short chain dehydrogenase |
| eIF-4B | PF06273.1 | −205.7 | Plant specific eukaryotic initiation factor 4B |
| iPGM_N | PF06415.3 | −263.4 | BPG-independent PGAM N-terminus (iPGM_N) |
| p450 | PF00067.11 | −105 | Cytochrome P450 |
| zf-AN1 | PF01428.6 | 0 | AN1-like Zinc finger |
| zf-C3HC4 | PF00097.13 | 16.9 | Zinc finger, C3HC4 type (RING finger) |
| zf-CCCH | PF00642.14 | 0 | Zinc finger C—x8—C—x5—C—x3—H type (and similar) |
| zf-CCHC | PF00098.12 | 17.9 | Zinc knuckle |
| zf-CSL | PF05207.3 | 2.9 | CSL zinc finger |

Example 5

Plasmid Construction for Transferring Recombinant DNA

This example illustrates the construction of plasmids for transferring recombinant DNA into the nucleus of a plant cell which can be regenerated into a transgenic crop plant of this invention. Primers for PCR amplification of protein coding nucleotides of recombinant DNA are designed at or near the start and stop codons of the coding sequence, in order to eliminate most of the 5' and 3' untranslated regions. DNA of interest, i.e. each DNA identified in Table 1 and the DNA for the identified homologous genes, are cloned and amplified by PCR prior to insertion into the insertion site the base vector.

A. Corn Transformation Vector

Elements of an exemplary common expression vector, pMON93093 are illustrated in Table 18. The exemplary base vector which is especially useful for corn transformation is illustrated in FIG. 2 and assembled using technology known in the art. The DNA of interest are inserted in a expression vector at the insertion site between the intron1 of rice act 1 gene and the termination sequence of PinII gene.

TABLE 18

| | pMON93093 | | |
|---|---|---|---|
| function | name | annotation | Coordinates of SEQ ID NO: 19940 |
| Agro transforamtion | B-AGRtu.right border | Agro right border sequence, essential for transfer of T-DNA. | 11364-11720 |
| Gene of interest expression cassette | E-Os.Act1 | upstream promoter region of the rice actin 1 gene | 19-775 |
| | E-CaMV.35S.2xA1-B3 | duplicated35S A1-B3 domain without TATA box | 788-1120 |
| | P-Os.Act1 | promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | first intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | first exon of the rice actin 1 gene | 3671-3750 |
| | I-Os.Act1 | first intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | Synthetic CP4 coding region with dicot preferred codon usage. | 4466-5833 |
| | T-AGRtu.nos | A 3' non-translated region of the nopaline synthase gene of Agrobacterium tumefaciens Ti plasmid which functions to direct polyadenylation of the mRNA. | 5849-6101 |
| Agro transformation | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | romoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |

TABLE 18-continued pMON93093

| function | name | annotation | Coordinates of SEQ ID NO: 19940 |
|---|---|---|---|
| | T-Ec.aadA-SPC/STR | 3' UTR from the Tn7 adenylyltransferase (AAD(3")) gene of *E. coli*. | 11170-11227 |

B. Soybean Transformation Vector

Figure 3:
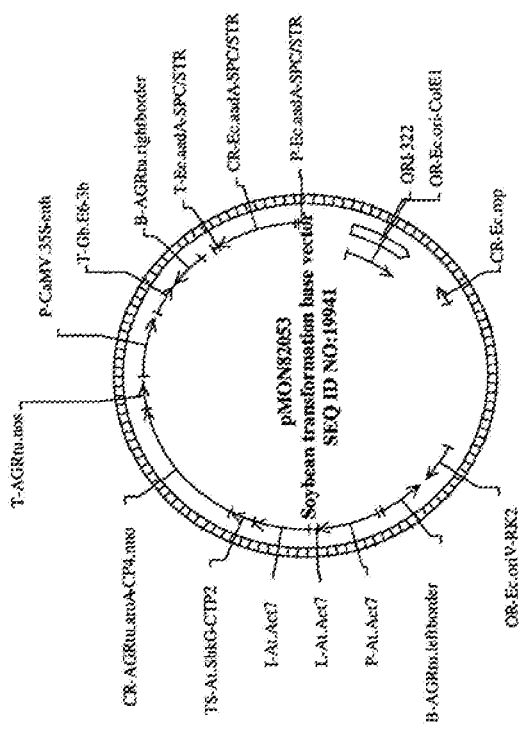

Plasmids for use in transformation of soybean are also prepared. Elements of an exemplary common expression vector plasmid pMON82053 are shown in Table 19 below. This exemplary soybean or canola transformation base vector illustrated in FIG. 3 is assembled using the technology known in the art. Recombinant DNA of interest, i.e. each DNA identified in Table 1 and the DNA for the identified homologous genes, is cloned and amplified by PCR prior to insertion into the insertion site the base vector at the insertion site between the enhanced 35S CaMV promoter and the termination sequence of cotton E6 gene.

C. Cotton Transformation Vector

Figure 4:
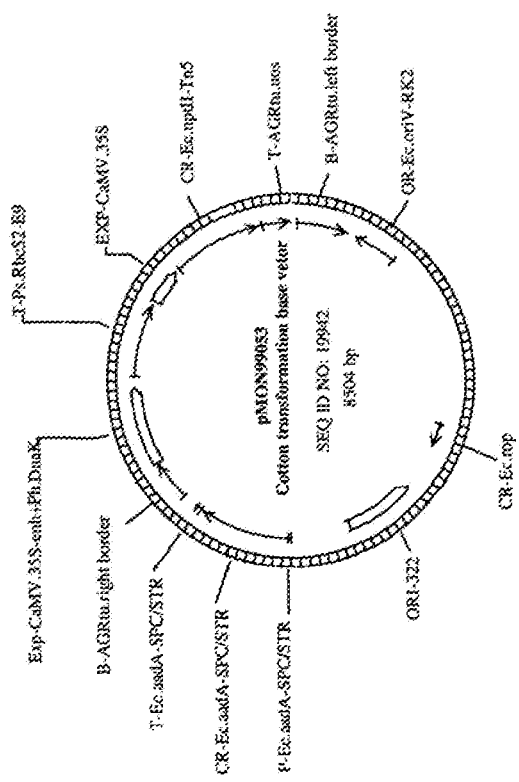

Plasmids for use in transformation of cotton are also prepared. Elements of an exemplary common expression vector plasmid pMON99053 are shown in Table 20 below and FIG. 4. Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 1 is amplified by PCR prior to insertion into the insertion site within the gene of interest expression cassette of one of the base.

TABLE 19 pMON82053

| function | name | annotation | Coordinates of SEQ ID NO: 19941 |
|---|---|---|---|
| Agro transforamtion | B-AGRtu.left border | Agro left border sequence, essential for transfer of T-DNA. | 6144-6585 |
| Plant selectable marker expression cassette | P-At.Act7 | Promoter from the *arabidopsis* actin 7 gene | 6624-7861 |
| | L-At.Act7 | 5'UTR of *Arabidopsis* Act7 gene | |
| | I-At.Act7 | Intron from the *Arabidopsis* actin7 gene | |
| | TS-At.ShkG-CTP2 | Transit peptide region of *Arabidopsis* EPSPS | 7864-8091 |
| | CR-AGRtu.aroA-CP4.nno_At | Synthetic CP4 coding region with dicot preferred codon usage. | 8092-9459 |
| | T-AGRtu.nos | A 3' non-translated region of the nopaline synthase gene of Agrobacterium tumefaciens Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton; | 688-1002 |
| Agro transformation | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | romoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of *E. coli*. | 1526-1583 |

TABLE 20

| function | name | annotation | Coordinates of SEQ ID NO: 19942 |
|---|---|---|---|
| Agro transforamtion | B-AGRtu.right border | Agro right border sequence, essential for transfer of T-DNA. | 11364-11720 |
| Gene of interest expression cassette | Exp-CaMV.35S-enh + ph.DnaK | Enhanced version of the 35S RNA promoter from CaMV plus the petunia hsp70 5' untranslated region | 7794-8497 |
| | T-Ps.RbcS2-E9 | The 3' non-translated region of the pea RbcS2 gene which functions to direct polyadenylation of the mRNA. | 67-699 |
| Plant selectable marker expression cassette | Exp-CaMV.35S | Promoter and 5' untranslated region of the 35S RNA from CaMV | 730-1053 |
| | CR-Ec.nptII-Tn5 | Neomycin Phosphotransferase II gene that confers resistance to neomycin and kanamycin | 1087-1881 |
| | T-AGRtu.nos | A 3' non-translated region of the nopaline synthase gene of Agrobacterium tumefaciens Ti plasmid which functions to direct polyadenylation of the mRNA. | 1913-2165 |
| Agro transformation | B-AGRtu.left border | Agro left border sequence, essential for transfer of T-DNA. | 2211-2652 |
| Maintenance in E. coli | OR-Ec.oriV-RK2 | The vegetative origin of replication from plasmid RK2. | 2739-3135 |
| | CR-Ec.rop | Coding region for repressor of primer from the ColE1 plasmid. Expression of this gene product interferes with primer binding at the origin of replication, keeping plasmid copy number low. | 4644-4835 |
| | OR-Ec.ori-ColE1 | The minimal origin of replication from the E. coli plasmid ColE1. | 5263-5851 |
| | P-Ec.aadA-SPC/STR | romoter for Tn7 adenylyltransferase (AAD(3")) | 6382-6423 |
| | CR-Ec.aadA-SPC/STR | Coding region for Tn7 adenylyltransferase (AAD(3")) conferring spectinomycin and streptomycin resistance. | 6424-7212 |
| | T-Ec.aadA-SPC/STR | 3' UTR from the Tn7 adenylyltransferase (AAD(3")) gene of E. coli. | 7213-7270 |

Example 6

Corn Plant Transformation

This example illustrates the production and identification of transgenic corn cells in seed of transgenic corn plants having an enhanced agronomic trait, i.e. enhanced nitrogen use efficiency, increased yield, enhanced water use efficiency, enhanced tolerance to cold and/or improved seed compositions as compared to control plants. Transgenic corn cells are prepared with recombinant DNA expressing each of the protein encoding DNAs listed in Table 1 by *Agrobacterium*-mediated transformation using the corn transformation vectors pMON93093 as disclosed in Example 6. Corn transformation is effected using methods disclosed in U.S. Patent Application Publication 2004/0344075 A1 where corn embryos are inoculated and co-cultured with the *Agrobacterium tumefaciens* strain ABI and the corn transformation vector. To regenerate transgenic corn plants the transgenic callus resulting from transformation is placed on media to initiate shoot development in plantlets which are transferred to potting soil for initial growth in a growth chamber followed by a mist bench before transplanting to pots where plants are grown to maturity. The plants are self fertilized and seed is harvested for screening as seed, seedlings or progeny R2 plants or hybrids, e.g., for yield trials in the screens indicated above.

Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and improved seed composition.

Example 7

Soybean Plant Transformation

This example illustrates the production and identification of transgenic soybean cells in seed of transgenic soybean plants having an enhanced agronomic trait, i.e. enhanced nitrogen use efficiency, increased yield, enhanced water use efficiency, enhanced tolerance to cold and/or improved seed compositions as compared to control plants. Transgenic soybean cells are prepared with recombinant DNA expressing each of the protein encoding DNAs listed in Table 1 by *Agrobacterium*-mediated transformation using the soybean transformation vectors pMON82053 disclosed in Example 7. Soybean transformation is effected using methods disclosed in U.S. Pat. No. 6,384,301 where soybean meristem explants are wounded then inoculated and co-cultured with the soybean transformation vector, then transferred to selection media for 6-8 weeks to allow selection and growth of transgenic shoots.

The transformation is repeated for each of the protein encoding DNAs identified in Table 1.

Transgenic shoots producing roots are transferred to the greenhouse and potted in soil. Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and improved seed composition.

Example 8

Canola Transformation

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 1. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 9.

Example 9

Selection of Transgenic Plants with Enhanced Agronomic Trait(s)

This example illustrates identification of nuclei of the invention by screening derived plants and seeds for an enhanced trait identified below.

Many transgenic events which survive to fertile transgenic plants that produce seeds and progeny plants will not exhibit an enhanced agronomic trait. Populations of transgenic seed and plants prepared in Examples 6 and 7 are screened to identify those transgenic events providing transgenic plant cells with a nucleus having recombinant DNA imparting an enhanced trait. Each population is screened for enhanced nitrogen use efficiency, increased yield, enhanced water use efficiency, enhanced tolerance to cold and heat, increased level of oil and protein in seed using assays described below. Plant cell nuclei having recombinant DNA with each of the genes identified in Table 1 and the identified homologs are identified in plants and seeds with at least one of the enhanced traits.

A. Selection for Enhanced Nitrogen Use Efficiency

Transgenic corn plants with nuclei of the invention are planted in fields with three levels of nitrogen (N) fertilizer being applied, i.e. low level (0 pounds per acre N), medium level (80 pounds per acre N) and high level (180 pounds per acre N). Liquid 28% or 32% UAN (Urea, Ammonium Nitrogen) are used as the N source and apply by broadcast boom and incorporate with a field cultivator with rear rolling basket in the same direction as intended crop rows. Although there is no N applied in the low level treatment, the soil should still be disturbed in the same fashion as the treated area. Transgenic plants and control plants can be grouped by genotype and construct with controls arranged randomly within genotype blocks. For improved statistical analysis each type of transgenic plant can be tested by 3 replications and across 4 locations. Nitrogen levels in the fields are analyzed before planting by collecting sample soil cores from 0-24" and 24 to 48" soil layer. Soil samples are analyzed for nitrate-nitrogen, phosphorus (P), potassium (K), organic matter and pH to provide baseline values. P, K and micronutrients are applied based upon soil test recommendations.

Transgenic corn plants prepared in Example 6 and which exhibit a 2 to 5% yield increase as compared to control plants when grown in the high nitrogen field are selected as having nuclei of the invention. Transgenic corn plants which have at least the same or higher yield as compared to control plants when grown in the medium nitrogen field are selected as having nuclei of the invention. Transgenic corn plants having a nucleus with DNA identified in Table 3 as imparting nitrogen use efficiency (LN) and homologous DNA are selected from a nitrogen use efficiency screen as having a nucleus of this invention.

B. Selection for Increased Yield

Many transgenic plants of this invention exhibit improved yield as compared to a control plant. Improved yield can result from enhanced seed sink potential, i.e. the number and size of endosperm cells or kernels and/or enhanced sink strength, i.e. the rate of starch biosynthesis. Sink potential can be established very early during kernel development, as endosperm cell number and size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform. well at these higher densities. One approach to increasing yield is to increase harvest index (HI), the proportion of biomass that is allocated to the kernel compared to total biomass, in high density plantings.

Effective yield selection of enhanced yielding transgenic corn events uses hybrid progeny of the transgenic event over multiple locations with plants grown under optimal production management practices, and maximum pest control. A useful target for improved yield is a 5% to 10% increase in yield as compared to yield produced by plants grown from seed for a control plant. Selection methods may be applied in multiple and diverse geographic locations, for example up to 16 or more locations, over one or more planting seasons, for example at least two planting seasons to statistically distinguish yield improvement from natural environmental effects. It is to plant multiple transgenic plants, positive and negative control plants, and pollinator plants in standard plots, for example 2 row plots, 20 feet long by 5 feet wide with 30 inches distance between rows and a 3 foot alley between ranges. Transgenic events can be grouped by recombinant DNA constructs with groups randomly placed in the field. A pollinator plot of a high quality corn line is planted for every two plots to allow open pollination when using male sterile transgenic events. A useful planting density is about 30,000 plants/acre. High planting density is greater than 30,000 plants/acre, preferably about 40,000 plants/acre, more preferably about 42,000 plants/acre, most preferably about 45,000 plants/acre. Each of the transgenic corn plants and soybean plants with a nucleus of the invention prepared in Examples 6 and 7 are screened for yield enhancement. At least one event from each of the corn and soybean plants is selected as having at least between 3 and 5% increase in yield as compared to a control plant as having a nucleus of this invention.

C. Selection for Enhanced Water Use Efficiency (WUE)

The following is a high-throughput method for screening for water use efficiency in a greenhouse to identify the transgenic corn plants with a nucleus of this invention. This selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment. The hydration status of the shoot tissues following the drought is also measured. The plant height are measured at three time points. The first is taken just prior to the onset drought when the plant is 11 days old, which is the shoot initial height (SIH). The plant height is also measured halfway throughout the drought/re-water regimen, on day 18 after planting, to give rise to the shoot mid-drought height (SMH). Upon the completion of the final drought cycle on day 26 after planting, the shoot portion of the plant is harvested and measured for a final height, which is the shoot wilt height (SWH) and also measured for shoot wilted biomass (SWM). The shoot is placed in water at 40 degree Celsius in the dark. Three days later, the shoot is weighted to give rise to the shoot turgid weight (STM). After drying in an oven for four days, the shoots are weighted for shoot dry biomass (SDM). The shoot average height (SAH) is the mean plant height across the 3 height measurements. The procedure described above may be adjusted for +/-~one day for each step given the situation.

To correct for slight differences between plants, a size corrected growth value is derived from SIH and SWH. This is the Relative Growth Rate (RGR). Relative Growth Rate (RGR) is calculated for each shoot using the formula [RGR %=(SWH−SIH)/((SWH+SIH)/2)×100]. Relative water content (RWC) is a measurement of how much (%) of the plant was water at harvest. Water Content (RWC) is calculated for each shoot using the formula [RWC %=(SWM−SDM)/(STM−SDM)×100]. Fully watered corn plants of this age run around 98% RWC.

Transgenic corn plants and soybean plants prepared in Examples 6 and 7 are screened for water use efficiency. Transgenic plants having at least a 1% increase in RGR and RWC as compared to control plants are identified as having enhanced water used efficiency and are selected as having a nucleus of this invention. Transgenic corn and soybean plants having in their nucleus DNA identified in Table 3 as imparting drought tolerance improvement (DS) and homologous DNA are identified as showing increased water use efficiency as compared to control plants and are selected as having a nucleus of this invention.

D. Selection for Growth Under Cold Stress

Cold germination assay—Three sets of seeds are used for the assay. The first set consists of positive transgenic events (F1 hybrid) where the genes of the present invention are expressed in the seed. The second seed set is nontransgenic, wild-type negative control made from the same genotype as the transgenic events. The third set consisted of two cold tolerant and one cold sensitive commercial check lines of corn. All seeds are treated with a fungicide "Captan" (MAESTRO® 80DF Fungicide, Arvesta Corporation, San Francisco, Calif., USA). 0.43 mL Captan is applied per 45 g of corn seeds by mixing it well and drying the fungicide prior to the experiment.

Corn kernels are placed embryo side down on blotter paper within an individual cell (8.9×8.9 cm) of a germination tray (54×36 cm). Ten seeds from an event are placed into one cell of the germination tray. Each tray can hold 21 transgenic events and 3 replicates of wildtype (LH244SDms+LH59), which is randomized in a complete block design. For every event there are five replications (five trays). The trays are placed at 9.7 C for 24 days (no light) in a Convrion® growth chamber (*Conviron Model PGV36, Controlled Environments*, Winnipeg, Canada). Two hundred and fifty milliliters of deionized water are added to each germination tray. Germination counts are taken 10th, 11th, 12th, 13th, 14th, 17th, 19th, 21st, and 24th day after start date of the experiment. Seeds are considered germinated if the emerged radicle size is 1 cm. From the germination counts germination index is calculated.

The germination index is calculated as per:

$$\text{Germination index}=(\Sigma([T+1-n_i]*[P_i-P_{i-1}]))/T$$

where T is the total number of days for which the germination assay is performed. The number of days after planting is defined by n. "i" indicated the number of times the germination had been counted, including the current day. P is the percentage of seeds germinated during any given rating. Statistical differences are calculated between transgenic events and wild type control. After statistical analysis, the events that show a statistical significance at the p level of less than 0.1 relative to wild-type controls will advance to a secondary cold selection. The secondary cold screen is conducted in the same manner of the primary selection only increasing the number of repetitions to ten. Statistical analysis of the data from the secondary selection is conducted to identify the events that show a statistical significance at the p level of less than 0.05 relative to wild-type controls.

Transgenic corn plants and soybean plants prepared in Examples 6 and 7 are screened for water use efficiency. Transgenic plants having at least a 5% increase in germination index as compared to control plants are identified as having enhanced cold stress tolerance and are selected as having a nucleus of this invention. Transgenic corn and soybean plants having in their nucleus DNA identified in Table 3 as imparting cold tolerance improvement (CK or CS) and homologous DNA are identified as showing increased cold stress tolerance as compared to control plants and are selected as having a nucleus of this invention.

E. Screens for Transgenic Plant Seeds with Increased Protein and/or Oil Levels

The following is a high-throughput selection method for identifying plant seeds with improvement in seed composition using the Infratec® 1200 series Grain Analyzer, which is a near-infrared transmittance spectrometer used to determine the composition of a bulk seed sample. Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides a predicted values as well as information on how well the sample fits in the calibration.

Infratec® Model 1221, 1225, or 1227 analyzer with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Calculations are performed automatically by the software. Seed samples are received in packets or containers with barcode labels from the customer. The seed is poured into the cuvettes and analyzed as received.

TABLE 21

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc |
| | Soybean typical: 50 cc; minimum 5 cc |
| Typical analytical range: | Determined in part by the specific calibration. |
| | Corn - moisture 5-15%, oil 5-20%, protein 5-30%, starch 50-75%, and density 1.0-1.3%. |
| | Soybean - moisture 5-15%, oil 15-25%, and protein 35-50%. |

Transgenic corn plants and soybean plants prepared in Examples 6 and 7 are screened for increased protein and oil in seed. Transgenic inbred corn and soybean plants having an increase of at least 1 percentage point in the total percent seed protein or at least 0.3 percentage point in total seed oil and transgenic hybrid corn plants having an increase of at least 0.4 percentage point in the total percent seed protein as compared to control plants are identified as having enhanced seed protein or enhanced seed oil and are selected as having a nucleus of this invention.

Example 10

Cotton Transgenic Plants with Enhanced Agronomic Traits

Cotton transformation is performed as generally described in WO0036911 and in U.S. Pat. No. 5,846,797. Transgenic cotton plants containing each of the recombinant DNA having a sequence of SEQ ID NO: 1 through SEQ ID NO: 197 are obtained by transforming with recombinant DNA from each of the genes identified in Table 1. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 11

Monocot and Dicot Plant Transformation for the Suppression of Endogeneous Protein This example illustrates monocot and dicot plant transformation to produce nuclei of this invention in cells of a transgenic plant by transformation where the recombinant DNA suppresses the expression of an endogenous protein identified by Pfam, SNF5, LMBR1, TFIIS_M, TFIIS_C, or Glyco_transf_8. Corn callus and soybean tissue are transformed as describe in Examples 6 and 7 using recombinant DNA in the nucleus with DNA that transcribes to RNA that forms double-stranded RNA targeted to an endogenous gene with DNA encoding the protein. The genes for which the double-stranded RNAs are targeted are the native gene in corn and soybean that are homolog of the genes encoding the protein with an amino acid sequence of SEQ ID NO:200, 201, 205, 207, 211, and 394.

Populations of transgenic corn plants and soybean plants prepared in Examples 6 and 7 with DNA for suppressing a gene identified in Table 3 as providing an enhanced trait by gene suppression are screened to identify an event from those plants with a nucleus of the invention by selecting the trait identified in this specification.

SEQUENCE LISTING (19942 sequences)

SEQ ID NO: 1 - DNA, 1350 bp, Arabidopsis thaliana
ccacgcgtccgcaaataatccctgacttcgtcacgtttctttgtatctccaacgtccaataaatgaaagcaactctagcagcaccctcttctctcacaagcctcccttatcgaaccaactcttctttcggctcaaagtcatcgcttctctttcggtctccatcctcctcctcctcagtctctatgacgacaacgcgtggaaacgtggctgtggcggctgctgctacatccactgaggcgctaagaaaaggaatagcggagttctacaatgaaacttcgggtttgtgggaagagatttggggagatcatatgcatcatggcttttatgaccctgattcttctgttcaactttctgattctggtcacaaggaagctcagatccgtatgattgaagagtctctccgtttcgccggtgttactgatgaagaggaggagaaaaagataaagaaagtagtggatgttgggtgtgggattggaggaagctcaagatatcttgcctctaaatttggagctgaatgcattggcattactctcagccctgttcaggccaagagagccaatgatctcgcggctgctcaatcactctctcataaggcttccttccaagttgcggatgcgttggatcagccattcgaagatggaaaattcgatctagtgtggtcgatggagagtggtgagcatatgcctgacaaggccaagtttgtaaaagagttggtacgtgtggcggctccaggaggtaggataataatagtgacatggtgccatagaaatctatctgcgggggaggaagctttgcagccgtgggagcaaaacatcttggacaaaatctgtaagacgttctatctcccggcttggtgctccaccgatgattatgtcaacttgcttcaatcccattctctccaggatattaagtgtgcggattggtcagagaacgtagctcctttctggcctgcggttatacggactgcattaacatggaagggccttgtgtctctgcttcgtagtggtatgaaaagtattaaaggagcattgacaatgccattgatgattgaaggttacaagaaaggtgtcattaagtttggtatcatcacttgccagaagccactctaagtctaaagctatactaggagattcaataagactataagagtagtgtctcatgtgaaagcatgaaattccttaaaaacgtcaatgttaagcctatgcttcgttatttgttttagataagtatcatttcactcttgtctaaggtagtttctataaacaataaataccatgaattagctcatgttatctggtaaattctcggaagtgattgtcatggattaactcaaaaaaaaaaaaaaaaaaa

SEQ ID NO: 2 - DNA, 293 bp, Arabidopsis thaliana
atgaaaagttcatcggagctccttgtaataatgattttcttattcttggcgcttctcataatctcccacgctcaatcacttccaggtacgtttccatttaatagtatgtaatctcacgtattcttatataatttatataatctcatcgtattgtatcaatagtattattattaatatgatttggacctgtgttgcaggtacgccgtatggcggccctggtccgtatccgcgtagttaccctgtgtgttacccaccgtattgccgtccatgagagtttcaatttggtcacatga

SEQ ID NO: 3 - DNA, 876 bp, Arabidopsis thaliana
accgaaactcaatttgtgaaatttgggggtttaaggatgaagggtttagtgtctactggttggaaaggtcctgtcaagttcaggatgcccactgctgaaaacttggtacctattcgattggacattcaattcgaaggtcagcgttacaaagatgctttcacttggaacccttcagacccggataatgaagtcgttatctttgccaaaagaactgttaaagacttgaaacttccctatgcatttgtcactcagattgcccaatctattcagtctcagctctcagactttcgggcttatgaaggacaagacatgtacactggtgaaaaaatcataccaattaagcttgatctccgagttaaccagactctcatcaaggatcagttcttatgggacctaaacaattttgagagtgatcctgaggaatttgcaagaaccttgtgcaaggatttaggtgttgaagaccctgaagttggacctgctgttgcctttgcaataagggaacaactttacgagattgcaattcaaagtgtggcttcagctagggagagtagattaagcaagaaaggccgcagaggatctgatcatggttcagcgagcaaggcaagtggcctgtcaatggacttaatgaagttattcagttttaagtccagtgtagttcggaaaaggaaagacttggatgtttatgaaccagttgtggatctgctaacaagtgaggaagttgatgcgcttgaagccagggaagagagacatgcaaggtgaagagtttcgtttacatgtataaatatttcttagggcaacactcaaaatatgttgtatcatgcttaacttgagttaatgatattaagacaatcttttatgagaaaaaaaaaaaaaaaa

SEQ ID NO: 4 - DNA, 495 bp, Arabidopsis thaliana
atgaggagaggaggcaaggaagaagacgaagttgaacagttgcttcaagcagctcaagatgagatgatactaaagctctctgttgattctcacacttctcgatcttcttccgattacttagatccagatcttcactctagatttctcgctctcaaatctcaaaagaagaaggatcagcagcaacaacagaaacaacggccgagaatgcagccgaaatcaaaggatgtggttgaagaaacaccagaagatctcatgcttagattcgcggctctgaaaacttctctcccctccgcgtcttcttcgtcctctgttcttcttcaggatgaaatcggagaagatggtgatgaaatcggagaagatgctgaagtggataagctgatccaatgggctatagacgcagcccgtctcgatccgtctccgtcttctgacgatgagcaaagccagaattgcgatagcgatgatgagaatgattcaactagagatgttaaaccttaa

SEQ ID NO: 5 - DNA, 404 bp, Arabidopsis thaliana
atgggctgcatcggtgttgtgaatgtaacaagcataaatccatatctcacaagaagatcaaacaaaccctacaattcaagaagaccatcatccatggctgctgcgattagagctgagtctactgagaaattagggattacaattgaaaagaatcctcctgagtccaaactaacccaactcggtgttcgtagttggcccaagtggggttgtcctccaagcaagtttccatggacttacagtgcaaaggagacttgttatttactacaaggaaaagtgaaagtgtaccctaatggatccgatgaaggcgtagagatcgaagcaggcgactttgttgttttccctaaaggaatgagttgcacttgggatgtctctgttgctgttgataaacattaccaattcgagtg

SEQ ID NO: 6 - DNA, 782 bp, Arabidopsis thaliana
atgaagaaatctacagagactccggcgagaccgaacgcaactgttaaaactcagaaacctcctttcagacctgccgttgatgacaccaaacctgttcttcaggaccctgtaaggatctctctctctctctctctctattttccgtacattgtgtgtgtttcgatgtccttaacgatgtcatttgagctaaagatcactaatttcgttttccatgtcatatgaatcgatgtatctccattttgtcaattttcttatgtttaggtctgaaatgtgaaagttaattgagagatcatgaagaatcatttgttcttctagaaagccatagaactagagcttcagatcaaacaaaaactttttttaagtatagataagaattttaaagccaaatggtgaaagttcacttcatttagtagccattagcaatttccatttgaatacattctagttacaaagaggaactatttcaccggtggatcaatgtttttccataatgaaattctgacttctttcgtgtgcgggtcaaaactgttttgtgccaattgtttgacgtgttgatgtaatatctagttgtaccattcttccaagaatatactgactctggattccaatggttctggttagggtttatcttctcaatacatgttatcttgaatgatttagtggatcttaatgcagtttgtaacatttatttttattagattctgagatcggatccaatggagacagaagaagctgtgctgagattgccttctttcccaatgatcagaccatctgaatcgtag

SEQ ID NO: 7 - DNA, 3060 bp, Arabidopsis thaliana
attcatttatttgtcagctttcaaactctttgtttcttgtttgttgattaacccctaattaaagcttgaacactccattgttctctactctaccattatctcacagagattcatggatacgatgcgaatctccggtgtatcaaccggagctgaggttttaatacaatgcaattccttatcaagcctcgtttctcgtcgttgcgacgacggaaaatggcgaacgagaatgtttccggcgagaaacagagacttgcgtccatcgccgacgagaagatcctttttgtcggtgaaatctatctctagcgaaccgaaagccaaagtaaccgacgcagttctcgattccgaacaagaagtgtttattagctcgatgaatccgtttgcgccagatgctgcttcggtagcttcgagtatcaagtaccacgcggagtttacgccattgttttcaccggagaagtttgagttgccaaaggcgttctttgcgactgcgcaaagtgttagagatgctttgatcatgaattggaatgcaacttatgagtattacaacagagtgaatgtgaaacaagcgtattatttgtcaatggagtttttgcagggtagagccttatcgaatgccgtgggtaaccttgggcttaatagcgcttatggtgatgctttgaagaggcttggttttgatttggaaagcgtggctagtcaggagccagatcctgcacttgggaatggtggactcgggagacttgcctcgtgttttttggattccatggcaactttgaattatccggcttggggttatggacttagatacaagtatggcttgttcaaacagagaattacaaaagatggacaggaggaagctgcagaagattggcttgagctaagcaatccttgggaaatagtcagaaacgatgtctcatatcctattaagttctatgggaaagtggtttttggatcagatggtaagaaacggtggattggtggagaagacattgttgctgttgcttatgatgttcctatacctggttataaaactaagacaactatcaatctgcggctctggtcaacaaaagctccttccgaagattttgatttatcttcatataactctgggaagcatactgaggcagcagaagctctattcaacgctgaaaagatttgcttcgtgctttaccccggagatgagtcaactgaaggaaaggctcttcgtctgaagcaacaatacactctgtgctcagcctcgctacaagatatcgtagcacgttttgagacaaggtctggaggaaacgtcaactgggaggaatttccagagaaggttgcagtgcagatgaatgacactcaccctaccctatgcattcctgagctaatgaggattctaatggatttaaaaggactaagctgggaagacgcttggaaaatcacacaaaggactgtggcatacacaaaccatacagtcttgcctgaggcactggagaagtggagtttagaactcatggagaaattgcttcctcgtcatgtggagattatcgaaaagattgatgaggagctagttcgcacaattgtttcagagtatggcaccgcggatcctgacttacttgaagaaaaactgaaggcaatgaggatcttggaaaatgtcgagttgccttctgcctttgcagatgtgatcgtgaagccggtgaacaaaccagttactgcaaaagatgctcaaaatggcgtgaaaacggaacaagaagaggaaaaaactgctggagaggaagaggaagacgaagttatcccagaaccaacagtagaaccccccaagatggtccgtatggccaaccttgctgttgtgggtggtcatgctgtaaatggcgttgcagagatacacagtgaaatagtgaaacaggacgtgtttaatgatttcgtacagttgtggccagaaaaatttcagaacaaaacaaatggagtaacaccaaggcgatggattcgtttttgcaacccatatttaagtgatattataactaactggataggcacagaagactgggtcttaaataccgaaaaggttgcggaactaagaaagtttgcagataatgaagatctccaatctgagtggagggcagcaaagaagaagaacaagttgaaggttgtatcacttatcaaggaaagaactggatatactgtcagccccgatgcaatgttcgacattcggatcaagcgtatacatgagtacaagcgacaactgctaaatatcttgggaattgtttaccgctacaaaaagatgaaggaaatgagtgctagtgagagagagaaagcatttgttccaagagtttgcatatttgggggaaaagcatttgccacatatgtgcaagctaagagaattgttaaatttatcacagatgttgcgtctacaattaaccatgatccagaaataggtgacctccttaaggttatctttgttcctgattacaatgtcagtgttgctgaattgctcattccagcaagtgagctttctcagcacatcagtactgctgggatggaagctagtgggacaagcaacatgaaattttcgatgaacggttgcgttttgattggaaccttggatggggcgaatgtcgagattagagaagaagttggagaagaaaatttcttcctctttggtgccaaagctgatcagattgtgaacctcaggaaggagagagcagagggaaagtttgttcccgatcctacttttgaagaagtcaagaagttcgttggaagcggcgtctttggctcaaatagctatgatgaactaatcggctctttggaaggaaacgaaggctttggacgagcggattacttcctagttggcaaagactttcctagttacatcgaatgccaagaaaaagtcgacgaggcataccgagaccagaaaagatggacgagaatgtcaataatgaacacagcaggttcattcaagtttagcagtgaccggacgatccacgaatacgccaaagacatatggaatattaagcaagtggaacttccatgagccttgagacaagtctaccttaagaactcttttgtacgtcccatgtttggcgcgcaaat

SEQ ID NO: 8 - DNA, 1530 bp, Arabidopsis thaliana
atgggcgatttcaacctcgctctcgtgattgtcgcgatcgttgtttgcgtcatcgtattcatctctagcatctatcttctcgtcaactatcagcatccagatgatgcaaaccaggcttatttccccaaattcgtcgttgtttttggcctttctattgctatgatctcgattctcatgttaccggctgatgtggccaatcggcatgcttgtcgacatgctatatacaatggagcttgcaatctcaccttgcccatgaaggatctttggcttgctatttatatcgtggacgctattctcgtgttctttgtcatccccttcgcaatgtttttctatgaaggcgaccaggacaagactcttggaaagaggataaaaagtgccttaatttgggtagttaccacggctgttgtttgtgctctggtgcttggaattttatatggtgtcattggaaaggtggacttctcggtcaggcatttggcttctgccacatccactttccctacttcctggcagttttcaaatactcaaccatgcataggtaacactgctcgccagtgctcagcatttacagctaatcccacatctgagaaaacatggactatgcgtactacttttccagaatatgttgttgctcttgcgacaattgttgggtcagttcttttcacgatatttggtggtgttggtattgcatgtctaccattaggacttatcactgcattcatcaggcgaccaaaggctgttatcactcgatcacaatatataaaggaggcaaccgaactaggtaaaaaggcaagagaactaaagaaagcagctgatggacttcatcaggaagaaagaagtggtgctaagggcaggaaatggcggaaaaatgtgaaagcagttgaaaaggagttgctccaattggaggaagatgtgaacctcttagaagagatgtatcctcaaggagagcaggcagaaactgcatgggctttcactgtgctcggatacttggccaagtttattcttggaatcgtaggattgatcgtttccattgcttgggttgcacacatcatcatatatctactcgtcgaccctcctctctccccttttcttaacgaggttttcattaagcttgatgatgtttggggtcttttaggcactgctgcctttgctttcttctgtttctaccttctacttgctgttatcgctggggcaatgatgctgggtttgaagctggtcttcattaccattcatccaatgaaatggggagctactctaatgaactctttcctcttcaatgtcggcctcattcttctttgttcaatcagcgtgattcaattttgtgccactgcatttggatattacgctcaagccactgctgcccaggagatatttggccacacattgcagtcccttagaggaattaagtacctttacaagtacaatgtgttccaaatcgggtttgttatcctggctggactgactttcctatattacattgcctttggatggagaagaaaaaaaactagtggccgtttccagctctcttcttaa

SEQ ID NO: 9 - DNA, 942 bp, Arabidopsis thaliana
atgggcgcgaattctattccgacggacgcaaccattgatcttgatgagcagatctcgcagctcatgcagtgcaagcctctctcggagcaacaggttagagcattatgcgagaaagccaaggagatcttaatggatgaaagcaatgttcagcctgtgaaaagccctgtgacaatctgcggtgatattcatggacagttccatgatcttgcagagcttttccgtatagggggaatgtgccctgataccaattacctgtttatgggagactatgtggaccgtggttattattctgttgaaactgttacgctgttagtcgccttaaagatgcgatatcctcagcgaatcactattcttagaggaaaccatgaaagtcgtcagattactcaggtttatggattttatgatgaatgtctacgaaagtacggcaacgcaaatgtttggaaaatctttacagacctcttcgactattttcctctgacagccttggttgagtcagaaatattttgccttcatggtggattatctccatctatcgagacccttgacaacataaggaattttgatcgagttcaagaagtgccccatgaagggccgatgtgtgacttattatggtctgaccccgatgaccgatgtggttggggcatctctcctcggggtgccggatatacatttggtcaggatatatctgaacaattcaatcacacaaacaacttaaagctgatcgcccgagctcaccagttggttatggatggatacaactgggctcacgagcaaaaagtggttactattttcagtgcaccaaactattgttaccgttgtgggaacatggcctcgattcttgaggtcgacgactgcaggaaccacaccttcatccagtttgaaccagcaccgaggagaggagaaccagacgtcacccgaaggactccagactatttcctgtga

SEQ ID NO: 10 - DNA, 1137 bp, Arabidopsis thaliana
atggagagtgatttgattgatttgttcgagggagctaagaaggcagccgatgcggcggctcttgacggtgttacctcttcaggtcctgaggtttctcaatgtatcgatgcccttaaacagctcaagaagtttcctgtcacatacgataccctcgttgcgactcaggtgggaaagaagctgaggtctcttgcaaaacatcctgttgaagatatcaaaagcgtagctactgatctgcttgagatatggaagaaagttgtcattgaagagacagccaaagctaagaaaaccgaaggcactaacggttgtaaagaggctaaggtgaataagatggatgttgagaagccttcaaatcctgctcctgttaaagttcagaaacttcagaggggtgattcggctaagagtatcaaggttgagagaaaggaacctgacaataaagttgttaccggtgtcaagatagagagaaaggtacctgacatcaaagtcaccaatggaaccaagatagattatcgtggtcaggctgtgaaagatgaaaaggtctcaaaggacaaccaatcaagtatgaaagctccagctaaagcagctaatgctcctccaaaactaactgcaatgctcaaatgcaatgatcctgtgcgtgacaaaatccgtgagttgcttgtggaggcgttgtgcagggttgctggagaagctgatgactatgagagagagtcagtaaatgctagtgatcctttacgtgttgctgtctcagtggaatcactgatgtttgagaaattgggtcgctcaactggagctcagaagcttaagtacagatctataatgttcaacctgagggatagtaacaacccggacttaagaaggagggttctcactggggagatttcaccagagaaactcataacattgtctgccgaagatatggcaagtgacaagaggaaacaagagaacaaccagatcaaagagaaagccctgtttgattgtgagcgtggtcttgctgcaaaagcatctaccgaccagttcaagtgcgggcggtgtggtcagcgcaaatgcacctactatcagatgcaaacaagaagtgctgatgagccaatgacgacttatgttacatgtgttaactgtgacaaccactggaagttctgttga

SEQ ID NO: 11 - DNA, 1418 bp, Arabidopsis thaliana
aactctttgtttcttgtttgttgattaacccttaattaaatttcaattcccaacaccttaatttgttcgacaaacccaagaagattcgatgggtaagaacgattttctaaccccaaaggcgattgcgaatcgaattaaagccaaaggacttcaaaagcttcgatggtattgtcagatgtgtcagaaacaatgccgagacgagaatggattcaagtgtcattgtatgagcgaatctcaccagaggcagatgcaagtttttgggcagaatccgactcgtgttgtcgatggttactctgaagaattcgagcagacgtttctcgatctgatgaggcggagccaccgtttctctcgtatcgctgccactgttgtctacaatgagtatattaacgatagacatcatgttcacatgaattcgacggagtgggcgacgttgacggagtttatcaagcatcttgggaaaactggtaagtgtaaggttgaagaaactcctaaaggttggtttattacttatatagatagagattctgagactttgtttaaggagaggttgaagaataagagagttaagagtgatttagctgaggaggagaagcaagagagggagattcagagacagattgagagagctgctgagaaattgaatggtggtggtggtgaaggtgaaaccagtggtaatgatgaagttgtggatgatggtgatgatgagaggaagaaagatgaagacttgaggttgaagagtggggtcaaggttggatttgctcttggtggaggtgttaaacaggttgctacgggtaaagagagaggggaaagctcgaaacttttgtttggggatgaagagaatgacaaggttgagagaggggagaagaggaagagaagtggggactccgggaggagcgagaaggagaggagatcagctttggatgagttgatgaaggaggaagagaagaagaaggagaggatgaatcggaaagattactggttgttcgaagggatcattgtgaaggtgatgagtaaggctttggcagagaaagggtattataagcaaaaaggtgttgtgaagaaagtgattgataattatgttggggagatcaaaatgcttgattctaaacatgtgttgagagttgatcaaaaggagctagagactgtgcttccacaaattggagggatggtgaagatagtgaatggggcatatcgtggttcgaatgcaaggttgttgggtgtggatacagagaagttctgtgctaaagtgcagatcgagaaaggtgtctatgatggaagagtcatcaagtccattgagtacgaggacatatgcaaacttgcttagttatatcttttagaccatatcgggttttacgatgccttgtatttctgcttggcgcgccaaaaattggagctctgcagagctttcgttcgtatca

SEQ ID NO: 12 - DNA, 474 bp, Arabidopsis thaliana
atggcgaatctgtatgtgaaagcggttccaccaccggatatgaataggaatacggaatggttcatgtatccaggagtttggacgacttacatgcttattctcttcttcggttggctcgttgttctctctgtctctggttgttcccctggaatggcttggactgttgttaatctcgctcacttcgttgtaacgtatcacagcttccactggatgaaaggaactccttttgcagatgaccaaggaatctacaatggtttaacttggtgggaacaaatggacaatggtcaacagcttacccgcaaccgcaaatttcttaccctagttcctgttgttctgtacttgattgcatcgcatacaacagattacagacatccatggctgttcctcaacacactcgctgtgatggttctcgttgttgccaagttccccaacatgcacaaggtacgcatctttggtatcaatggtgataaataa

SEQ ID NO: 13 - DNA, 874 bp, Arabidopsis thaliana
aactctttgtttcttgtttgttgattaacccttaattaaatggtggtaggcggcggaggagaaggagatcagaagagaagcagcggagaaatgatggcgatggcgagtttattcaacgatcagcagaatccaattcaacagtttcaggttaaattcaaagaagtagaaactaatttcaagacatggttgtcgaaacagtcgattccggtggaagccgccgtcgtatccaccatgagcggtgtacaaggagctttcattggtggtctcatgggaacactctctcctgaaatgcctcaagccggcgttgaccctcaagccatagcttcgatgaaacaagctcaggctcttgtgggtggtccttgggtccaagctcggaattttgctgcaattactggtgtgaatgctggaattgcttctgttatgaagcggattagaggcaaagaggatattgaatctgcagtggtggcagcgttaggatctggatttgcatactcattggtgagccaaggattgcaaggacaacctatgaatgcaatcactactgctgctggttttgctgtttttcaaggagtgttttttaaattgggagaaagattctctaaaccgagtactgaagatccatttttcacaagaggaaggacaatgctagtgaagctaggtttggagaaatacgagaagaacttcaagaaaggacttttaactgatcccacattgccattgctcactgatagcgcgctgaaagatgcgaacatcccaccagggccaagacttatgatactagatcatatccagagggacccggagataaagggcaaacgaaagtagggcgcgccaaaaattggagctctgcagagctttcgttcgtatcatcggt

SEQ ID NO: 14 - DNA, 1206 bp, Arabidopsis thaliana
atggcgatgtcgggaactttccatttgacttctgactatgtccctggttacacactttcagacagccgttgcttctttaactctgctgtttcaagaagaacacttgccatattaccttgctcttcctgtctcgatcacaagaatgggcgtctgaaatctgtccccaatagaagttcttttgtgtgccgagcaagttctggcggctataggagaaatcctgatttctcaagacttaataagcatggttaccggggaaacaacaggcaaagcggagggagagaagattttgatatcgaaaactctgatatgttgtcttcaagaaatgggcctttattcaacctgtctagttcccccaaattccaagctacctcatcccctggacctagagagaaagagatcgtggagcttttcagaaaggttcaagctcagctccgagctcgtgctgcagcaaagaaagaagaaaaaaagattgaagaagcttctaaagggcagggaaaagaaagtgaaactgttgactctcttcttaagttactaaggaagcactcgggagagcaaagcaagaggcaagttagcaaatttagcagccagggagaagtacaaggagatactgttgacaaacaagatcgcaccggaaatcttgtcacttcagggaacaaagataataatgcatcatcctttaccagaccaacatcaagcttcagaagaaagtcgccagtaccaagatctcaatcaccgccagcttattctagcgaggcaacttttgatcaatcatcaagttacagtgtaacctggacccagaagaaggatacagtagagttgcatgatgagcctgaacatgagcctgcgtatgagcatgagcatgagcctgaaaatgagtcagaacctgggcctgtgacaactatgcttgaaccagattcagagctgaaaccagagtcatcatcattttatcaagaggaggaggatgatgatgttacttttgatgtgttatcacaggatgatggtattttagatgtgttatcagatgatgatgagtctctcgatgatgctgatgaagatagtgatgaagctgaggaagaagccgtgaaagacttgagtgaattgaagctggtcgaacttagaggcatagcaaagtcacggggactaaaagggttgtcaaagatgaagaaagccgaattagtggagttgcttggtagtgattccagctga

SEQ ID NO: 15 - DNA, 1127 bp, Agrobacterium tumefaciens
ttaattaatggaacttctgttatcggaaatttattgtgccttgggagaatagcaaatgaccgaacgtctcgaagacatcgccatcaaaatggttgccgacggcaagggcctgctcgcagccgatgaatccacaggaacgatcaaaaagcgtttcgacagcatcaacctggaatccaccgagaccgcccgccgcgattatcgcgaaatgctgttccgctctgacgacgccatgaagaagtacatctccggcgtcattctttatgaagaaacccttttccagaaggctgccgatggcacgcctttcgttgatatcatcaaggccgccggcagcctgccgggcatcaaggtggatatcggcgccaagccgatggctttccacccgcatgaattcatcaccgaaggccttgatggcctttatgagcgcctgcgcaagtatcatgaagccggcgcgcgtttcgccaagtggcgcggcgtcatcaccatcggtgagcagcgtccgagctggggctcgatcaaggcaaactcccagtctcttgcccgttatgctgccctctgccagcaggccgatatcgtgccgattgttgagccggaagtgctgatggacggcgagcctggcacgcatgacatcgaccgctgcgccgaagtcacgcaatgggttctccagaccgtgtttgcggatctgttcgatgcccgcgtcaacctcgaaggcatgatcctcaagccgaacatgatcatcgatggcaagaacgctcgcaaggcttcggtcgaggaagtggcggaaaagaccgtcaaggttctgaaggcgacggtaccaactgccgttccgggcatcgccttcctttccggcggccagtcctccgaagaagctacggcgcatctctccgccatgaatgccggttacgacctgccctggtcgctgacctattcctacggccgcgctcttcaggataccgctctcaagacctggggcggcaaatcggaaaacgtcgccgccggccagcgtgccttcacgcaccgcgccgccatgaacagccttgccgccaagggcaactggaaacaggagctcgaaaaggcagcctgagctatcgctcacaggcaaattgtgcaattgaagccgccatttaaat

SEQ ID NO: 16 - DNA, 1934 bp, Arabidopsis thaliana
ttaattaagcttcatcacagctacgaccatgagctaccaaaacgaggaagaagaggaaggaggagacaccaacgattgcttctacgagtctcttgatcgtttagcttcttcctcttcttgctcttgttccgcttctaactctgataagaacacgtctaaggaaaacgaagacagtgggaatagtaataaggataatgcatccaagtctaagaagaaaggaagttggtttaagagtattaagagtgttgcaagtagcatgactggtcatagcaaagagagacgaagcagcgatgatagagatacatcgtcagagagaggtggtcggaggtcgagctctgctactgatgattctcaggaatcttcttttcatgggccggaaagagttagggttagacagtatgggaaatcatctaaagagctcacggcattgtacaaaacgcaggagattcaagcgcataatggttctatttggagcattaagtttagtttggatggtaaatatcttgctagtgctggtgaggattgcatcattcacatctggcaagtcgttgaggctgagaagaagggtgagttgttacttgatagaccggaactgttgcttttggctactaatgggtctccagaaccgactactatgtcaccaaggagaagagggagaacttctataagtagaaagtcattgagtttagagaacatatttgttccagattctcttttcgggctttcggaaaagcccttttgttcctttcagggacatgtggatgatgtacttgaccttgcttggtccaagtctcagcatttgctctcttcatcaatggataaaacagttcgtttgtggaatttgtccagccagacttgcttgaaagtattttcgcacagtgattacgtgacttgcattcaatttaatccggttgatgatagatacttcatcagtggatccttagatgcaaaagttcgcgtctggagcattccagatcgtcaagtagttgactggtatgatcttcatgagatggtcacttctgcttgctacactccagatggtcagggtgtgttggttggttcatacaaaggtagctgtcggatgtacagtgcatcagataacaagctgcaacagaaaagccagataaatttacagaacaagaagaagaaagctcatcaaaaaaagataactggtttccagtttgttcctgggagctcatctgaagtgcttgtcacatcttccgattcaaggatccgtgttgttgatggaactgatctagttaacaaacttaaagggtttcgaaatacgagcagccagatctctgcctcaatcacagcagatgggaaatacgtagtttcagcaagcgaggattcacacgtgtacatatggaagtacgaatcccctgcttctcgaccaagcagaagtaacaacaacaagaacgtgacagtcacaaactcttacgagcatttccatagccaagacgtctctgcagccatctcatggcctggaatggcctcaacagaaaactggggaacccaaaacagagcggggtttaacggaagcaccaataacttggacaatatctccacagctaaccatccgcctacaccggtagaccagctggggactgtggagcgattaaacagtccacggaatgggatcatatcgagcgcaacaaacggatactttttcgatagaatgtcagcgacttggcctgaagagaaactgttgtttgcaaggaacagaagtgggaatcgtctgagtacggatatgtcgtcgtcaaatggaaactcagggaatgtatcggcttcttggggaatggtgattgtcactgcaggtctcagaggagagatacgaacgtttcagaactttggtttgcccattcggatttgataaaaactgtacagagtggtgaagaaaaatcgagtgaggggaaattggagctctgcagagc

SEQ ID NO: 17 - DNA, 1273 bp, Arabidopsis thaliana
atggcactcgttaatgaccatcccaacgagaccaattacttgtcaaaacaaaattcctcctcttccgaagatctctcctcgccgggactggatcagccagatgcagcttatgccggtggaggaggaggaggaggctcggcttcgagcagtagcacgatgaattcagatcatcaacaacatcaggggtttgtattttacccatccggtgaagatcatcacaactctttgatggatttcaacggatcatcatttcttaactttgatcatcacgagagctttcctcctccagccataagctgtggtggtagtagcggtgggggcggcttctccttcttggagggcaacaacatgagctacggcttcacaaactggaatcatcaacatcatatggatattattagccctagatccaccgaaactccccaaggccagaaagactggttatattctgattcaactgttgtaaccactggttctagaaacgagtctctttcgcctaaatccgctggaaacaaacgttctcacacggtaattacaaacaacaaagtcttggtgaatatttttcatataagatgtcaatgaaagatcgttgatatatactactatcaatttgaattatggatatatagggagagagcactcaaccgtcgaagaaactgagtagcggtgtgaccggaaagaccaagcctaagccaacaacttcacctaaagatccacaaagcctagcagccaaggtttgctttcttgacattaatttacattcattaaaataaaactcaatctctcaacacatatttacatatgttttattttgttcagaatcgaagagaaaggataagtgaacgtctcaagatattgcaagaacttgttcccaatggcaccaaggtacacatccatataaccatttatgacagatttattatattacttattctcatgataataatatttgttatgtttcacaggttgatttggtgacaatgcttgaaaaggctattagttatgtcaagttccttcaagtacaagttaaggtatattagttatgacaaacatccctcaaattaattttcaggattgatttaattaccatatttatcgaattattacgtaacacgtattgatataatctattgtttgttaggtattagcgaccgatgagttttggccggctcaaggaggaaaagctcctgacatttctcaagttaaagacgccattgatgccattctctcctcatcacaacgagacaggaattcgaatctgatcaccaattaa

SEQ ID NO: 18 - DNA, 1359 bp, Arabidopsis thaliana
atggcggctgctgtatcatctgtttgggcaaagcctggtgcttgggctcttgaagccgaggaacatgaagctgagctcaaacaacaaccctctcccaccaaccagaaatcctctgccgaagattcctccgatttcccttccttagccgctgcagcgaccaccaaaacgaagaagaagaagggccaaaccatctctcttgctgaattcgctacctacggtactgctaaggcaaagccggctccacagacggagcgtctcactcaggctgagctggtcgctcttccgaccggtccacgtgaacgctctgctgaggagcttgatagatctaagcttggaggtggtttccggagctatggtggtggtcgttatggagatgagtcgtccagctcgaggtggggttcgtctagggtttcggaggatggggaaaggagaggcggtggattcaaccgggatagggaacctagcagggattcgggtccgtcgcgtgcggatgaggatgataactgggccgccgccaagaaaccaattagcggaaacggattcgagagaagagagagaggcagcggcggaggattcttcgaatctcagtctcagtccaaggctgatgaagtcgatagctgggtctccactaagccatcggagccccggagattcgtttctagcaacggcggcggcggtgacagatttgagaaaaggggaagttttgaatccttgtctagaaaccgggattctcaatacggtggtggtggtggttctgaatcggatacctggggaagaagaagagaagaaagcggtgctgctaatggctcgccaccaccgagcggtggttcacgcccaagattggtgttacagccacgtacacttcccgtggccgttgtggaggtcgtgaagccggagagtccggtcttggtcattgtggagaaacctaaaggtgctaatccttttgggaacgcaagacctagagaggaagttctggctgagaaaggccaggattggaaagagattgacgagaagctcgaggctgaaaagcttaaggacattgctgcagccatggagaagcctaatgagaaatctacagggaagatgggctttggtcttggcaatggccgtaaagacgaggaacgtattgaaagaagttggaggaaaagcacggagcattctgaggaggatgctcaagaggaggaaccagctgtagaaggggcaaagaaggaagagactgaggacaaaccggctgtagaagaggctaagaaggaagaaactgagggtgaacaggctgtagaagaggctaagaaggaagagactggtggcgaaccggctgtagaagaggcaaagaaggaagagacggaggacaaaatctaa

SEQ ID NO: 19 - DNA, 3243 bp, Arabidopsis thaliana
ctcagatcgcttccgacgccgctgaactgtgtccgtcttgatctgtgtttaggagaaagcttctagggtttttgttttggttgctgagtagaatttgttggatctgaaacggaaatcaaaatgggctttttcagtacgatactaggattttgtggatttggagttgggatttcattgggacttgttattggttacgttctcttcgtctacttgctccccaacgacgtcaaggttcgtttttttcactgagatttgtggttcaatcctatgtccacgcttgatcgttcataaactacattaggattagcaaatggaattaaacttattgctcacttgcaacaacatttctctaggcttgacatgtttacttgaactcttcttggctgtattggtgtatgtgtctaaattagttatgcatcccagaataggaatttcccaaacagtgttatgtggtgatacagtcattttacagttcaagtttgtgaccctttcgctcttataggatcctgaaattcgttcaatagctgaccaagatcccaaagctatgctacggatgcttccagagatacctctatgggtcaaaaatccggatttcgatcgtgtatgtgattcttccccctactcttgatattacaagttttttttttgttgtctcaggctctgatctttgtctttctatcttcttgtgaattaggttgactggataaacagatttctcgagtacatgtggccttatctcgacaaggttacatacctggactgatgttcttgtgatacttcactttctcttaccttcatttgctaaattttgaattttggtctctccaactatccatgtaggccatatgtaagactgcaaagaatatagcaaaaccgatcattgaggagcagataccaaagtacaagattgactctgttgaatttgaaacacttactctaggctctttaccccctacatttcaaggtcggataatcctttcttctcatctttaatatctccttgaatgtcctgtttgcataatggaactaagaactggaggatggatggtggtgaaatgcgaaagatgattatgaattgattccaggacttacgacgattattcttctctttgcagggatgaaagtttatctcacggatgagaaagagttgattatggaaccatgcttgaaatgggccgcaaatcccaatatcttggttgccatcaaggcatttgggttgaaggcaacagttcaggtaattatgctgccaagtgcttagtcaaccttaaagaaggaacgacctacttaatattatcagtcatgattgtccctcacttaccaaggaatttttgtcaggtggtcgatctgcaagtttttgctcagcctcgtatcactctcaagccattagttccaagtttcccttgttttgccaatatctatgtgtctcttatggagaaggtatgtggtataacctttttcattataaggtcaatttgtgtagtagtcagcctcattatcagatctttggtagagattttgtgtttttgactgatccttgctactatggcagccacatgttgattttggactgaagcttggtggagcagatcttatgtcaatccctggcctctacagatttgttcaggttgatatctttctcttacatacatcattcaaatccctgacttgtatgagtaagaatttttttatgagggagaggtatgattgatcattatatgggctactcattctatttagtctagttttatgaagagtatttgtttcaatctgttaaggctgaagggcagatgaaactgtgacatttcgtttggccaatacatatgtatttggacattaaatctcttatttggtgaaagttgtttggtctttttgcttttacgtttctgctggatcaaatattcatttgtagttccattgctgcgttaattgtttcaggagcaaatcaaggatcaagttgcgaacatgtatctctggcctaagacccttgtagttccaatccttgaccctgcaaagtatgccattctgcctttatcttttgaatagtcaatccatgtcttaaatttaattatgctgagcaaatcttaatttttaaactgcagggcgttcagaaggcctgttggaattgtccatgtgaaagttgtgagggctgtggggctgaggaaaaaagatctgatgggcggggcagatccattcgtgaaaatcaagctctctgaagataagattccttctaagaagacaacagttaaacacaagaatttgaatcctgaatggaatgaggagttcaaattctcggtcagagatccccagactcaggttctagagttcagtgtgtatgactgggaacaggtaaaaagctatcaaaagggtgactggtgccttggagtgggtatatatgtaatatttgtttttataacgcaggttgggaatcccgagaagatgggtatgaatgtattagctctgaaagaaatggtgcctgacgaacataaagcattcaccttggaactgcgtaagactctggacggcggtgaagatgggcagcctcctgacaagtatagggggaagctggaggttgaactcttgtataagccattcacggaggaagaaatgcccaaaggctttgaagaaacgcaagccgtgcagaaagctccagaaggcacaccggctgctggaggaatgcttgtggtaatagtgcattcggctgaggatgttgaaggaaagcaccataccaatccttacgtgcgcatctatttcaaaggagaagagagaaaaacaaagcacgtgaagaagaacagagacccaaggtggaatgaggagttcacctttatgctcgaggagcctccagtccgtgagaagctgcacgttgaagtgctgagcacctcttccaggataggtctattgcatcccaaggtaacacactcgtttcgctcagagtaactaacactagcaagtgttttgtgttggtctaatctagaagtggttgttgatggacaggaaacactggggtatgtggatattccagtggtggacgtggtgaacaacaaaaggatgaatcagaagtttcaccttattgattctaagaacggaaagatccaaatcgagctcgagtggcgaactgcctcttgatttctgagttgattcgagaacaaacaaagagataattggtttgatgttgttaaaaactatgtgttgttgtacaaaatgggctttaactcttaaaaaccaacattcagatttgcagagcct

SEQ ID NO: 20 - DNA, 2428 bp, Arabidopsis thaliana
ttaattaaatgggtatggttttatttgcttgcttgcttttactaatcatattcccaacttgtggctatgcagctataaacacatcaagtcctttgtcaataagacaaactctgagttctcctggtggattttatgagttaggcttcttcagtcctaataatactcagaatcagtatgtcgggatctggttcaagaagattgttcctcgtgtagttgtgtgggtggctaacagagatacgccagttactagctctgcagcaaatctcactatcagcagcaatgggagcctgatcttgcttgatgggaaacaagatgttatttggtcaacaggaaaagctttcacatccaacaaatgtcatgcggagctcttagataccggaaattttgttgtaattgatgatgtttcagggaataaattatggcaaagcttcgagcatcttggtaatactatgctgcctcagtcatcattgatgtatgatacttctaatggcaagaagcgtgtgttgactacatggaaaagtaacagcgatccttcgcctggggagttctcactggagattacaccacaaatccccacacaaggccttataagaagaggctcagtaccttactggagatgtggtccttgggcaaaaacaagattctctgggatatctggaattgatgcatcatatgtaagtccattcagcgttgtccaggatacagcagccggcacaggatctttctcttattccacattaagaaactataatctctcatatgttacgctaacaccagaagggaaaatgaagatcctctgggatgatggaaataattggaagcttcacttgtctctcccagagaacccatgtgatctatatggtagatgcgggccttatggtttgtgtgtgagatctgatcccccaaagtgtgaatgcttgaaagggtttgtaccaaagtctgatgaggagtggggaaaaggaaactggacaagtgggtgtgtgagacgtacaaaattatcttgccaagcaaaatcttctatgaaaacacaaggcaaagacacagacatcttctatcgtatgacagatgtaaagactccggatctgcaccaatttgcaagctttctcaatgccgaacagtgctatcaaggttgtctaggcaactgttcttgcacagccttcgcctatattagtggaattggatgtttggtatggaatggggagctagcagacaccgttcaatttttgtctagcggagagtttctcttcattcgtcttgcaagttcagaattggctggaagcagtcgaaggaagattatcgtaggcactactgtcagcctttccattttcttgatcttggtatttgctgcaattatgttgtggagatacagagcgaaacaaaatgatgcatggaagaatggttttgaacgacaagatgtctccggcgtcaatttctttgagatgcatacaatacgaactgccaccaataacttcagtccttcaaataaacttggtcaaggtggatttggtccagtttacaagttggtagatgggaaggaaataggtgttaaacgccttgctagtagttccggtcagggtacagaggagttcatgaatgaaataacactgatctcaaaattgcaacacagaaacttggttcggcttttgggatactgcatcgacggagaagagaagctactgatctatgagttcatggtgaacaaaagtctcgatatttttatatttgatccatgtctaaagtttgagcttgattggccaaagagatttaatatcattcaaggtattgcgcgtggacttctctatctccaccgtgactcacgcctcagagttattcaccgagacctgaaggtcagcaatattcttctggacgacagaatgaatccaaaaatatcagattttggattggctcggatgttccagggaacccaatatcaagacaacactcgcagagttgtaggaactctaggatatatgtctcccgagtatgcatgggcaggattgttctctgagaagtctgatatctatagcttcggagttctgatgttagaaatcatcagcggaaagagaatttcacggttcatctatggtgatgaaagcaaaggccttcttgcttatacatgggattcttggtgcgagaccgggggatcaaatctacttgacagagatcttactgatacatgccaagcattcgaagttgcgagatgtgttcagattggtctgctctgtgttcaacacgaagccgtcgacagacccaacactcttcaagtactatccatgcttacttcagcaacagatcttccagtaccaaaacagccaatatttgcagtgcatactctaaacgatatgccaatgttacaggctaattctcaagatttcttatctgtaaatgagatgacagaatctatgatccaaggaaggtaaggcgcgcc

SEQ ID NO: 21 - DNA, 762 bp, Arabidopsis thaliana
atggcttcttcagcagtgtctctccaatccatctctatgacaactctcaacaatctttcatgtaatcaacaatttcatcgaagctctcttcttggttcctctaaatccttccaaaatcttggtatctcatctaacggttcagatttctcctatccatcaagtttcactgccaagaagaacctcactgcttctcgagctctctcccaaaacgggaatatcgaaaaccctagaccaagcaaagttcaagaactgagtgtgtacgaaatcaacgaattagatcgacacagccccaagattcttaaaaacgcattcagcttaatgttcggtctcggagatctcgtaccattcacaaacaaactctacacaggcgatctcaagaaacgcgtgggcatcacggcaggtctctgcgtcgtcatcgaacacgtcccagagaagaaaggtgaaagattcgaagctacttatagcttctacttcggagactatggccacttgtccgttcaaggaccatacttgacttacgaggattcgttcctcgccatcactggtggtgctggaatctttgaaggtgcctacggacaggtcaagcttcaacagcttgtgtatccgacaaaactgttctacactttttaccttaaagggttggctaatgatttgccgttggagctcaccggaacaccggtaccgccgtctaaggacatagagccggcgccggaagctaaggcactggagcctagcggagttataagtaactataccaactaa

SEQ ID NO: 22 - DNA, 513 bp, Arabidopsis thaliana
atgaggaagttaagaggaatcaaaattagaagaccgattaaacaaatctcaagatggatcctccggagaattaagattcgtcgttcaagatacacccggttaagcccaaaccgcccggtttgcaagccgagagccatcacaaaactcataagttggggtcgaagtctcacatcccacagcgccaggtttattgggtctaaatgctccaattcagggtacataccaattggtcaagaacccattcgagaaaagcccgacccggttccgaaaggtcactcggcggtttacatcggtaaaaaagacggcgactttcagagagttttggtgcctatcgtttactttaaccatcctctgtttggtgagcttcttagagaggctgaagaagaatttgggttttctcaagaaggtggaatcactatcccttgtccttactcagatttcaaacgggtccaaacccgaattgaatccgggtcgggtttctgtaaatttccctggagccggcggtggcaataa

SEQ ID NO: 23 - DNA, 561 bp, Arabidopsis thaliana
atggcaggaggaggaacagaagcgtttcctgatcttggagagcattgccaagaccctgattgcaaattactcgattttctcccttttacttgcgacggctgcaaattggtgttttgtttggagcatagatcatacaagtcacataactgtccgaaatccgatcatgggagcagaacggtttccatctgtgaaacatgttcaatagcgattgaaacaactggttttgatgaaaaaggaatcaaatctttgcttgagaaacacgaaagatccggagattgtgatccaaacaagaaaaagaaaccaacgtgtcctgtaaaacgttgcaaagagattctgacttttgcgaataaccttacttgcaaatattgtggagtcaagttctgtttgaaacaccggtttccgacagatcatgtctgtaacaagaagatcattaataccgcgggaacaagctcgaggtggaacgagaggtttatggaagctttgagtttaagaaaccagaaagggtgtggaagagggagctctgtttcatcaaaatcttcaccatcagttagatcgttttag

SEQ ID NO: 24 - DNA, 1128 bp, Arabidopsis thaliana
atgggtacaacaacgacaacaagcgctgtgtatatccatgttatcgaggatgtcgtcaacaaagttcgtgaggagttcattaacaacggaggtcctggcgagagtgttctcagcgagcttcaaggaatttgggagacgaagatgatgcaagccggagtcttgaatggaccaatagagaggtcatcggctcagaagccaacacctggtggtccactgactcatgatttgaatgttccttatgaaggtacagaggagtacgagactcccactgctgaaatgctcttccctcctacaccattgcagactccccttccaacgccgcttcccggtactgctgataactcatccatgtataacatccctaccggctcaagtgattatcccactcctggaactgagaatggagtcaacattgatgttaaagcaagacctagtccttatatgccaccgccttctccgtggacaaatcctagacttgatgtcaatgttgcttatgtggatggccgtgatgagcctgagagaggaaactctaaccagcagtttacgcaggatttatttgtgccatcctctgggaaacgaaaacgtgatgattcttctggacattatcaaaatggtggatctatacctcaacaggatggtgcaggcgatgctatccctgaggcaaactttgagtgtgatgcattccgcataacctctattggcgatagaaaggtaccacgagacttcttcagctcatcatcgaagattcctcaggttgatgggccaatgcctgacccttatgatgaaatgctctctacaccaaatatatatagttatcaaggacccagtgaagagtttaacgaggccagaactcctgctccaaacgagatccaaacgagcactcctgttgctgtacaaaacgatatcattgaagatgatgaagagctgttgaacgaagatgatgatgatgacgagttggacgacctagaaagtggcgaggatatgaacacacaacacctggttttagctcaatttgacaaggtgacgcgcacaaagagcaggtggaagtgcagtctgaaagacgggatcatgcatataaacgataaggacattctcttcaacaaagcagcaggcgagtttgacttctga

SEQ ID NO: 25 - DNA, 555 bp, Arabidopsis thaliana
atggagaaatcaacaagaaccctattcataaccatcgtgataacctccatgttgctagggtttggaaactctgatcttgctcaggacagagaggagtgtacgaaccagctcatagaactatccacgtgtattccgtacgttggaggagacgccaaggctccaacaaaagattgttgtgcagggtttggccaagttataagaaagagtgagaagtgtgtttgcatattggtcagagacaaagatgatcctcaacttggtatcaagattaacgcaaccctagccgctcatcttccctccgcttgtcatatcacggctcctaacatcactgactgtatttcgattctgcatctacctcgtaactcaacattggctaaagagtttgagaacttaggaaggattgaagacaactacaactccacatctcctacacaaattcataaagatgggacaggaggaggaaaagccgaaccagtgaagagtaatggatggaaggagaagagttggttgggtgttgagcttttaatatatttgctagtttctctcatcttcttttaa

SEQ ID NO: 26 - DNA, 1260 bp, Arabidopsis thaliana
atgagaaagaagaagacccgatttcagttccttctcaatcccaactcaaaattcgtcttttttcctcgcgcgatttcttcttcttcttcttcttcttccgacaacaacaacgatggttcagtttcatcttccagacaaaacaaccgacagatgggttatgatccttcagaggaactctttggtgttgatttcaagcccaggttcatatctggtgattcgcgtgaaccaaggtcatggtttggtcctaacggtcagtacattcgagagcttccttgtccaacttgtaggggaagaggttatacttcatgttcaaattgcggaatcgagaggtcgcgattagactgccctcaatgcaaaggaaagggcataatgacttgtctcagatgtttgggggattgtgtcatatgggaagaatcaatcgatgaacgaccttgggagaaagctagatccaggtagtgttgttattcaagagttgaagtcttaattctgtttaatgtttgactaataaacctcatttttttctgccacagttctccatttagagtaaaggaggatgatgaggttgataatttagagataaagttcagtaaaaggcgaaaatcgaagcggatttatcagtcaccaactcctgaagttggacaaaagatcagccgatctctaaaaagtctcaatgccaaaactggactttttagtaagcgcatgaagattatacatcgtgatccagtgcttcatgctcaaagagtagctgcaattaagaaagctaaaggaacaccagctgctagaaagcatgcatccgaatctatgaaagctttcttcagtaaccctgtaaaccgtgaacagagaagcctatctatgaaaggaactaagttttactgcaagaactgtggacaggaaggccatagacgccattactgtccagaactaggcactaatgcggacagaaaatttagatgtcggggttgcggcgggaaaggccacaaccgtagaacttgtcctaagtcgaaatcaatagtcactaaaggcatttccactaggtatcacaaatgtggaatatgcggtgagagaggtcacaacagcagaacatgccggaagccgaccggagtgaatcctagttgcagtggtgaaaattccggggaagatggtgttggtaaaataacgtatgcttgtgggttctgcaagaaaatgggacataatgtaagaacctgtccaagtaaacaagtttcagacagtgattcttgtttagagcaagaaggttcttga

SEQ ID NO: 27 - DNA, 1380 bp, Arabidopsis thaliana
atggaagaggattatcaacagccgaggtttacgattggtaggcaatcatcaatggcgccggagaagattccggagccgtcggttcactcagaagaagaggtgtttgaggatggagaagagatcgatggtggtgtgagactaatgtatttggctaatgaaggtgacattgaagggattaaggagcttattgattcagggattgatgctaattacagagacattgatgatcggactgctttacacgtggcggcttgtcaaggattgaaagatgttgttgagcttcttcttgatcggaaagctgaggttgatcctaaagatcgttggggaagcactccatttgcagatgcgatattttacaagaacattgatgttatcaagattcttgagatacatggagctaaacatccgatggctccaatgcacgttaagactgctcgtgaagtccctgagtatgaaataaatcctagtgagcttgatttcactcaaagcaaagagataacaaagggaacttactgtatggcaatgtggcgtggtattcaagttgcggtgaaaaagctggatgatgaagttttgagcgatgacgatcaagtgaggaagttccatgatgagcttgcattgctccaaaggcttaggcatccaaacattgtgcagtttcttggtgctgtaacccaaagtaacccaatgatgattgtgactgaatatttgcccaggggggatttgcgtgaattgctcaaacgaaaaggacaattgaaaccagctactgctgttagatatgcccttgatattgctaggggaatgagctatcttcatgagatcaaaggagaccctataatccaccgcgatcttgaaccttcaaacattctgcgggatgattcagggcatctgaaagttgcagactttggagtaagcaagcttgttactgttaaagaagacaagccttttacatgtcaagacatttcttgtcgatatatagctcccgaggttttcactagtgaagaatacgatacaaaagctgatgttttctcatttgcattgatcgttcaggagatgatcgaaggccgaatgccgtttgctgaaaaggaagacagtgaagcttctgaagcttatgctggcaaacatcggccattattcaaagctccatcaaagaattacccacatggtcttaaaacgttgatagaagaatgctggcatgagaaacctgcaaagcgaccaactttcagagagatcattaaacgacttgagtccattcttcaccacatgggtcacaagcgacaatggaggatgaggccattgacatgctttcagaatttcgagcacaagaagaaacataattgggatttgagcagccatgacggctcatcatccggttcacatttgtga

SEQ ID NO: 28 - DNA, 1049 bp, Arabidopsis thaliana
ttaattaaaaccctcaaaatcacaatcttctcttacaaaaaactttgaaagatgaagattcttctagcatcattgtgtttgatcagtcttctcgtaatcttgccttctgtcttctctgcttcttcttcctctgaagattttgatttcttctacttcgtccaacaagtaataaaatcattctaagaatgtttctgatgattttttataatcatctaatattgttttgtgttttattgtatagtggccaggatcatactgtgacacacagaagaagtgttgttatccaaattcaggcaaaccagctgctgattttggcattcatggtctttggcctaactacaaagatggaacttatccatctaactgtgatgcctctaaaccattcgatagctcaacggtaataagatcaaacatttctgttttaaggtcaaaaatatggtttaaggtaaaaaatatggaaagttttgtacataaccggttggtttgatttggtttggtacagatatcagatcttctcacttcaatgaagaagagctggccaacactggcttgcccaagcggttcaggtgaagcgttttgggagcacgaatgggagaagcatggtacttgctctgaatcggttatcgatcaacatgaatatttccaaaccgctcttaaccttaaacagaaaaccaatctccttggagctctaaccaaagccggtacgttttgatgtcaaagtacctttttattttcccggtttggatctcattggtctaactattggtttattatgtaatagggattaatccggatggaaaatcttactctttggagagcataagagattcgataaaagagtcaattggtttcactccttgggttgagtgtaacagagatggttctggtaatagccaattgtaccaagtctatctttgtgttgaccggtctggttccggtttaatcgaatgtccggttttcccacatgggaaatgtggagctgagatcgaattcccttctttttagtttccaatttctaaattcagtctcttgaaccggcatggcgcgcc

SEQ ID NO: 29 - DNA, 1078 bp, Glycine max
ttaattaaggagagggaagatgatgatgatgacaatggaggggatgatggacaagggggtgttggatgatgtgataagaaggcttctggaagggaaaggagggaaacaggtgcaactctctgagtcggagatccgtcaactctgcgtcaacgccagacaaatcttcctctctcagccaattcttctcgacctccgtgctcccatccgcatctgcggtgatatacatggtcagtaccaggacttgctgaggctttttgaatatggtggctaccctcctgcggcaaactacttgtttctgggggattatgtggatagagggaagcaaagtttggagactatatgtttgcttttggcctacaaaataagatatccagacaaaatttatctcttgaggggaaaccatgaagaagcaaagataaaccgtatatatggtttttatgatgaatgtaaaaggaggttcaatgttaggctatggaagatatttacggactgctttaactgtttgccagtggctgcactcattgatgagaaaatactttgtatgcatgggggactctctccagaattagaaaatttagatcagataagagagattcaaaggcctactgaaattccagatagtggtctcctatgtgatctgctttggtctgatcctgatgctagcattgagggctgggcagagagtgaccgaggagtttcatgtacttttggagctgatgtagttgcagagtttttggataaaaatgacgttgatcttgtttgcagagggcatcaggttgtggaggatggatatgagttttttgctaaaagaagattagtcacgatattttctgctccaaattatggtggggaatttgacaatgctggtgcgttgttaagcgttgatgattctcttgtatgttcctttgagatactgaaacccgctgatagagcatcaggaagtggttcatcaaaaatgaattttaagaagccacccaaactcggaaagatatagtaattggcaaagattttcggttcaaataggaatccaatccagctaactcaacttgtacggagttgaaattgtcaagatttaaat

SEQ ID NO: 30 - DNA, 1082 bp, Glycine max
ttaattaattgttaacagagtgatttgggagcttttgatatgtcgagtggatccgtgagacgggtttcccgtcaagatatccagctggtgcaaaatctcatagaacgatgtctacaactgtatatgagccagaaagaagttgtggaaacactattagctcaagcaaaaatagagcctggtttcactgaactagtttggcaaaagcttgaagaagaaaatgaagaattcttcaaggcttattatgcaagattggttttgaagcagcaaataatgcaattcaacaaattgctggatcagcaagtgcaattaatgcagttacactcaagtactgttgcatcactacctacatctaacgggtcacatatccctgcagtgtcatcactacctagctctaatgggtcacatatccctgcaatacctgagaatccagcatgctacactgcagaccgaacccaaacaagtttgaagccagaaaatatgcaacatcatgttgattccagattatctaatgtgtttaataatggcgggtcatcactacatacaagtatgcatgctgcagttgatatgtctgctcatggtaataggattaatggcccttctagcatgctttctgctcaaagcgcaaacatgggtctgatacaaggaatcaatggtggtggaatgatcaaatctgagcctggatattctggttgttctccttacatgtttggtactgatggaaatgtcctggagacacgcccaactattggtggtgcttcagtcacatcattcactaatgttgagtccaactcacattctctgaatgaggtggtcctagatccagacacttcttcatttggatttctggggcagattcccagaaattttagcctttcagatctgactgctgatttttctcagagttctgatatactggagacctattctaggtcacccttcctagctacggataatgagaacttccttgacagaggagaacaggacaataataggctggactccatatcagaaggcttgagttatgaagactttgggagtgagtgaatagttgataccatttagtcatcgaactttatttaaat

SEQ ID NO: 31 - DNA, 994 bp, Glycine max
ttaattaaggggtgtgatctggaagtgaaggtgaagaaatgcttcttcaaacgaggcaatttggcacagcgtgtccatgggtcagactcacacccgcaagcaaaagaaatagctcagtctcattgagaaggagcaattgtggcccaaaatgttcggtgtcccaattggaattgaagagtgagagtgagagcaaaacgaagccgtatccagcagaggcatcgaggaccataatggagttggctaaggtgggcacgctgtgtacgttgacccaagagggtttgccccttggtactggggttcgattcgcggttgaccctgaacatggcactcccttgttctgcttcaattccactgacaacactaacatcccctcttctcttcatgttcagtttgaacaatttggattgcgcactcctcagtgcactattcaaggaacccttaccaaaccacaggatccaaagcgtcttgtttctgtgtggaggaaaaggtttggagaagaagttgatcgagattttatttacattattgccgtggatcgggtactccaattggaagacattcaggaggatggcatatgggtcacctcttcagattacaaaaatgctcaacccgatcctcttcgagactctgcacacaacttagtcactgaaatcaacaccaacaatatggaagacattactcgcttttgcaatgtctacgttgatttggatttcctggtctccgaggcaaagatgctatgggttgatcgcttgggctttgacatgcgtttgtcttcccctcacaaaggcgtgtttgacgtccgcattcctttccccagagaagtcaccgatgagaaaggtgccaagtcgacgtttaattgtatgtcacaactcgcttgggaggtagaaagaaacttccaacatccagacttttcaaaggttaaagagttgaagccagtcaagtccccttttctgtaaccaacatgccaattcttcagttgttatcaaatttaaat

SEQ ID NO: 32 - DNA, 963 bp, Glycine max
ttaattaatcactctctctctctccacaccacactgaggagggagacagtggaaggaaggaacactcaaatcactgaaccagccatggctaccttctccaaggaacgcgagaactttgtatacgttgccaagttagctgaacaagctgaacgctatgatgaaatggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaacccatcattctgtcatatgtctaagatttgatgcattaatttttctcaatcatattttctccattgtagtgaagcctctatttaaat

SEQ ID NO: 33 - DNA, 1169 bp, Glycine max
ttaattaatatcgattttattgtaccttccaaacaaaccctgcagcgatttgtttccttccatctccgccgtaccatgtcggaagcaccaccgcctccaactgccgatgcgtcaccgcctccgtactggtgctaccactgcgagaagcgcgtctccgtcgaaacgctcgcgaatctccccgacgtcgtccgcggcgagtgcaagaacggctttgtggaatccatgcccacgccgtcgcgctctcgctccccctccgcctcctccgacgacccctacttcggctcgcagttcctccaggtccttcgcctaatcgctcagtcggcgcgtgacgacgacgcgtcgcctccgccgccgccgagccgctctccggagaacgatttcctcaggatcgagctcggcggctgggacaacgacgaggagaacgaaaacgacgacgataacggcgacgaggagttcgaggaacacgaggaggcggaggatcgctccggcaacgaagatccgcacggaggagacgacgaggatctgagaagaaggaggcgcgagctacttcggcttcggattagggatttggcgactcgtacgaggagcatgcggaaccggatcttggattgggccgagattctgatgggcctcgaggacaattccatcgagttccgcctccagctgccagaatccgaccgctacgtcggaaatcccgaggattacgtcgacgcggcagagtacgaggcgctgctgcagacgctggcggagagcgacgggggaggcaggaggggagcgccgccggcgtcgaaggccgcgctggaagccttgccgacggtgaaaattgcgtcggaaagcgaagccgtggcgtgcgctatatgtaaagatttgctcggtgttggagacgcggcgaagaggttgccgtgcgggcatcggtatcatggagattgcattgttctttggttgagttctcgaaattcttgccctgtttgcaggtttgagctaccaacggatgataaggaatacgaggaagagagagtggttatcgctgcttcttcgaattcgaacggagcttcgagttccggtggaggtggaagtgccattgtttgattccgcttggtatgttccgtcatgctctgctctgctctgttctgttctgccatttgtgtaatatatttcgtgatttaaat

SEQ ID NO: 34 - DNA, 2532 bp, Glycine max
ttaattaatatataagaacatggaggagacacgagaagatgcagggccggcagagcaagggccatctaatgtgtcgtggtggccttcagattttgttgaaaaatttggatctgtttctttgggttctcaggatgagatcttaagtaataaggagtctcctcgacattttgacaaagatgttttgtcttctcagaaagcatcacaaacactctggcgcattggagtgctttcagaaccaataccaaatggtttctattcagtcattccggagacaagactcaaggaactttttgatagtattcctaccttggacgagcttcatgctctgggtggagagggttttaaggctgatatcattcttgtggattcagagaaagataaaaagctatccatgttaaagaaattaattatggcattagttagaggattaaactctaatccagctgccataattaagaagatagctggattagtttctgatttttataagcgtcccaatgtggaaagtccagcaaaagctgcactagatgaaagctctcacatgtttgagaatcgaggagtccagatgctggggcaaataaagcatggttcttgccgtcctcgagctatcttatttaaagtattagctgatactgttggtcttgaaagtaggctcatggtgggcttgccaaatgatggagctattgaatgtcaagactcatacaagcatatgtctgtgatcgttgtattaaattccgtggaaatgctggttgatcttatgcgatttccaggccaattgttaccacgatcaaccaaggcagtttttatgactcacatttctgcaggagagagtgattcagcagaaaatgattcttgtgattcaccattagaacctaacagccctttatttggggtttcagagagtgctgagaaggaggaaaacctccaattccatagaagatttgaagcatcttcaaatgtatcaggcctttccttgagaaatgtgatgttaagatcaaatagcagtttgagtttgtcacatagtgaacccaacattgccactgcatttggtcggcgtagtcggagaaaggtcattgctgaacagaggacagctagttcaagtccagaacatccatcatttcgagcacgtgggcggtccatgcttagtggtgataggacaacgtttagagattttgccgatgatcaggctacatcaagatccagctataggtcagacaacacatcctcgtcagaagctcgtcggatacgaagaagaagcatcagcattacaccagagattggagatgatatcgtaagggctgtaagggcaatgaatgaaactctgaagcaaaatcgtcttttgagagaacgaggggatgataactcattccccaattctccaaacaatagtagtagtgatgcaaatcttcagaaaaatgtgtcaaatttccatcttgatggccatgatgaaagatctgccctctattcttttcagcgtgaccaaggagcttcacaaaaggcaatgtcattaccatcttcaccacacgattatggaggccaggcttctgagagaagtggatcatcaagatacggagtgaatgatgaaatggagtcaacatggaataaagtactggaatctccaatgttcaataataaacctctgttaccatatgaaaaatggaatattgacttctccgaattgactgttggaactcgcgtagggattggtttctttggagaagttttccgtggcatatggaatggcacagatgttgcaatcaaggtttttctagagcaagatttaactgctgaaaatatggaagatttttgcaacgagatatctattctgagccggctccgacatcctaatgttatcttgtttcttggtgcttgcacaaagcctccacgcttgtcaatggtcacagaatatatggagttgggatcattgtattacttgatacatttgaacggtcagaagaaaaagcttaattggcggagaagactaaggatgttgcgtgacatatgcaagggtttgatgtgcatacacagaatgaaggttgttcaccgtgatctgaaaagtgcaaattgtctagtgaataagcattggactgtcaaaatatgtgattttgggctttcaagaataatgacagagtctcccatgagagattcttcatcagctggaacgccagaatggatggctcctgagcttattcgaaatgaaccgttcacagaaaaatgtgatatcttcagccttggggtgataatgtgggaactctgtaccttgaacagaccatgggaaggagtaccacctgagagggtggtttattctgttgcgaatgagggttccagattggagataccagaaggccctctaggcaggctgatttcagagtgttgggcagaatgtcatgaacggccaagttgtgaggagattctttctcgtttggtggacatcgagtactccttgtgctgaagcaatatcttttgtacatagaaaactttgggtagagttgttacattgtattatcggctgatgttgtggactatttaaat

SEQ ID NO: 35 - DNA, 1176 bp, Glycine max
ttaattaatctccactcccatatcgaaacaaagtcgttttgagttccgccgaaggcaccgtaggttgcagcagctatggatttggcatccaatctcggtggcaagattgacaaagccgaagttctctctgccgttcagaagtatgagaagtatcatgtttgctatggaggtcaagaggaagagagaaaagctaattataccgatatggttaataaatactatgatcttgttaccagcttttatgagtttggctggggggaatctttccattttgcacccagatggaaaggagaatctcttcgagagagcatcaaaagacatgaacacttccttgcttcacaacttggactgaagccagggcagaaggttttggatgttggatgtggaattgggggaccattaagagaaatttctcgattcagcttaacttcaattaccgggttgaataacaatgagtaccagataacaagaggaaaggaactcaatcgcattgctggagtggacaagacttgcaattttgtcaaggctgacttcatgaaaatgccattaccagacaacagttttgatgcagtgtatgcgattgaagccacttgccatgcaccagatgcttatggatgctataaagagatttttagagtgttaaagcctggtcaatgttttgctgcttatgaatggtgcatgaccgattcttttgatccccaaaacccagagcaccaaaaaatcaaggcagaaattgagattggtgatgggctacctgacattcgattgactgctaagtgtcttgaagctctgaagcaagcaggttttgaggtaatatgggagaaagatctagcagtggactctcctcttccttggtatttgcctttagacaaaagtcatttctcactgagtagcttccgtctaactgctgtcgggcgacttttcaccaaaaacatggtcaaggttctggagtatgttggactggctccaaagggtagtctaagggttcaagatttcctagagaaggctgcagagggactagttgaaggaggaaagagagagattttcacaccaatgtacttcttcttggcccggaagcctgattcagacaggaactaagctggttgtacaaataggttgctgttttcatcagttactgtgattctggtagggtgaatcgcaagctaggatttaaat

SEQ ID NO: 36 - DNA, 1394 bp, Glycine max
ttaattaattttctttttttcgtttgttttacttttaagatgggtgagaagagcaacgttggcggcgacgcgattaacacgacactgcttcacgggaagtacgagctgggccggctgttaggccacggaaccttcgcgaaggtgtaccacgcgcgccacctgaagacgggaaagagcgtggcgatgaaggtggtgggcaaagagaaggtggtgaaggtaggcatgatggagcagatcaagagagagatctcagccatgaacatggtgaagcacccaaacatcgtgcagcttcacgaggtcatggcgagcaagtccaagatctacatcgccatggagctcgtccgcggcggcgagctcttcaacaagatcgccagaggccgtctccgggaggagatggccagactttacttccaacaactcatctctgctgtggacttctgccacagccgcggcgtctaccaccgtgacctcaagccagagaaccttctcctcgacgacgacggcaacctcaaggtcaccgacttcggcctcagcactttctccgagcacctccggcacgacggcctgctgcacactacgtgcggcacgccggcctatgtcgcgcccgaggtgattgggaaaagaggctacgacggcgccaaggccgatatttggtcttgtggcgtaatcctctacgtacttcttgctggttttttacccttccaggatgacaacctggtggccttgtacaagaaaatttaccgcggtgacttcaagtgtccgccgtggttctcctccgaggcgcggaggctcatcaccaagctcctcgaccccaacccgaacacgcgaatcacaatttcaaaaatcatggactcgtcgtggttcaagaaacccgtgccgaagaacttgatgggaaagaaaagagaggaattggatctggaggagaagattaaacagcatgagcaggaggtttctactacgatgaatgcttttcacatcatttcgctctcggaggggttcgatttgtcgccgttgttcgaggaaaagaagagagaagagaaagagttacggtttgcgaccacgcgccccgcgagcagcgtgatttcgagattggaagatttggcgaaggcggtgaagttcgacgtgaagaagagcgagactaaggtgaggttgcagggtcaagaaaaagggcgaaaaggtaaactcgctattgctgcggacttgtacgccgtgacgccgtcgtttttggtggtggaggttaagaaggacaacggtgacaccttggagtataaccagttctgtagcaaggagcttcgtccagctcttaaagatatcgtgtggaggacttctcctgcagagaatcctacactcgcttgaagaacaaccaagactcccatgctaattgtcatttaaat

SEQ ID NO: 37 - DNA, 857 bp, Glycine max
ttaattaatcacgttttagggctttctccaccttccgcaatgcacaaattgggaagaggtcatcgtgacaaactccagcagttcataacaataactggagccagcgagaaactagccctgcaggctctgaaggctagtgattggcatcttgaaggagcatttgatttcttttacagccaaccccagcttaaaacatttactgattctaggcacttggaggagctatacaatagatataaagatgcatatgttgatatgattttggcagatggtatcactctcctttgcaatgatatccaggtggatcctcaagatatagtaatgttagttctttcatggcacatgaaggctggcaccatgtgtgaattttccaagaaggagtttattgaaggtctacaatctttggggattgattctctggaaaagttccgtgaaaagataccttatatgcgctctgagctgaaagatgaacagaaattccgtgagatatataattttgcttttggctgggcaaaagagaagggtcaaaaatctcttgcattggatactgctattggtatgtggcaattattatttgctgagaagcagtggccgctggttgatcattggtgccagttcttgcaggctcggcataacaaagcaatatctagggacacatggtctcagcttttggagtttgcaaagactgttggctcaaatttatctgattatgatgccgaaggtgcttggccatatcttattgatgaatttgtggagtatctcaacgagaatggcataatccaaaatgatctgatcaatgattctagtctaaaacgatgatgcattcaaatctcaataaattgttatttaatttaaat

SEQ ID NO: 38 - DNA, 1267 bp, Glycine max
ttaattaacgaaatgggaaaacgagagaagcagaagcagaggcacgagaagggacaccgtggaagagggtctttcaactatcttcaagaggaccgtgattttgatgacactccaagaccctcaccctctgaagaagaatgtgctgatgacagcaatgaggaaaaagaagaagaagaagaagaagaaggtcatgaaaaccaatctcatgatatgccttccaagttcctcctttaccaacaatctgtgcagtcacccaaaggagatataagttatttgcaaaagttctttctcatgtacgtgggtggaaggatgcccctccatcttcaagaagatttctgtggcacggcgcttcttagtacagaatggctccgcagtgattcaagaagaacagtagtaggattagatttggatcttgaggcactcaattggtgcatggaaagcaacatacctaaagttggggctgatggattttcaagaatgtctctctttcatgggaatgtcctacaacctcttcagtctaaacttgtaaaaatagatcctcagcagctggtaagtgacatttcactgtcacagaatgaagaaaatcttcagactgatgtgccagaatctgatgctccaacaggctctgttgctcaagatgacaagtatactaagagaaacataatactgcctggaagagatatcgtgtgtgcttttaactacagctgctgttgtctacataaacgagcagaactggttctgtatttcaagcatgctcgtgaggccttgtcaactaaaggtggaatttttgtgatggatttatatgggggtacgtcatcagagcacaagttgaggcttcagagaagatttcccaattttacgtatgtatgggagcaagctgaatttgatattattcaacggaagacaaggattagcctccattttcatatgaagaaggaacaaagaaaacttcgccatgcattttcatacagctggcggttgtggacattgcctgaaattagggattgcctagaagaggctggatttcggtctgttcacttttgggttcgagagatgccagacaccacagaaattatgagaacagaggggtttggtgcgggaaagaatgtaaaatatgaagaggctacaagttttcagcaacaagattcttggaatgcttacatagttggtgttgcgtaacttcatcttagaaagtgtatttctgttgcattaattttgtcataagactcataactggacaagcatcactgttaatcagcatttaaat

SEQ ID NO: 39 - DNA, 1400 bp, Glycine max
ttaattaagttcatcctttgattatatcacatactcaccatggaggctaagttggccaccaccataatacttattttctccgtaatttggcttatgagggtgaatggcatagacccttgtgcctctcaagcggataattccgacctgaacgtgattcccatctacagcaaatgctcaccgttcaaaccaccaaagtcagactcatcgtgggacaacagaattataaacatggcctcaaaagacccactccgattcaaatacttgtccaccttagtgggccaaaagaccgtgtccacggccccaatcgcttcgggccagaccttcaacatcggcaactacgtcgtcagggtcaaattgggaacccctggtcaacttttgttcatggtcctcgacaccagcaccgacgaggccttcgttccatgctcgggctgcacgggctgctccgacaccactttctcgcccaaagcctccaccagctatggcccattggactgctctgttccccagtgcggtcaggtccgcgggctttcgtgccccgccacaggtaccggcgcgtgctccttcaaccaatcctacgcgggctcatctttctccgccaccctagtccaagactcgttaagattagccactgatgttatccccaactactccttcggctgcgtcaacgccatcaccggcgcctctgtcccggcccaagggcttttgggcctgggccgtggcccgctgtccttgctctcccaatccgggtcaaattactcgggcatcttctcttactgtctccccagcttcaagtcctactacttctctgggtcgctcaagctcgggcccgtgggccagcccaagagcattcgcaccaccccgcttcttcgcagccctcaccgtccttctctttactacgtgaacttcaccggaatcagcgtgggacgtgtcctggtaccctttcccagcgagtatcttgggtttaacccgaatacaggatccggaaccataattgattcgggcacggttataacccggttcgtggagcccgtttacaacgcggtgagggaggagttcaggaagcaggtgggaggcactacattcacgagcattggagccttcgatacgtgttttgtgaaaacctacgaaactctggcgccgccaattacgctgcacttcgaggggttggacctgaaactgccgttggaaaacagcttgatccacagcagcgcgggttcgctggcgtgtcttgcaatggcggcggcacccgacaatgtgaactcggtgttgaacgtcatcgccaactttcagcaacagaaccttaggattttgtttgataccgtcaataataaggttggcatagcccgtgaggtttgtaactagctggttggctacatttttatttatttatttatttaaat

SEQ ID NO: 40 - DNA, 1133 bp, Glycine max
ttaattaatgcagtctattattagagagaagaattgagttggaagaacccagaaaaagaaacaaaaaataaataaaacgatgtggtggccattcagcagaataggatcttctgggttttcatcatattctactgccgaggaagttactcatggaatcgatggaagtggtctcactgctattgttacaggagcatctagtggtcttggtgctgagactgctcgtgtccttgctttgcgtggtgtccatgtgattatgggggtgatagatatgattggtgcaaaaactatcaaggaagcaatacttaaggagattcccatagctaaagttgatgtcatggagttagatcttagctctatgacatctattcggaattttgcatcaaatttcaattcatctggtctttcattgaatattttgataaacaatgcagggatttgtgcagctccttttgcactatccaaggataacattgaacttcaatttgccataaattacttaggccactttcttttaacaaatatgttgttggatactatgaagaaagcaacaagtgaaagtaagaaacaaggaagaattattaatgtctcctcaattggttatcgattcacgtatcgtgaaggaatcatttttgacaaaattaacgaccaatcaagttacaacaattggtgtgcatatggccaatcaaagcttgctaacattttacatgccaatgaactcgcaagacgtctcaaggaagatggaatagatattactgctaattctgttcatccaggagccactgtttccaccaatattcacattcatagtggtttattaaatggtttacacaaaatagcatggctatttggactcgagaagatattgggatatatggcaaaaaatgtgcagcaaggagcatcaacaacatgttatgtagccttgcacccacaagtgagtggaatcagcggcaagtattttgaagataataatcttgcagaagtatactcacatggaagggacatgaatttggccaagaagttgtgggattttagcataaatttgactaagtaaaatgcataatgataattgtcaatgtaaatggaatactgtattagagaataaaaatgccaatgatcatattgtgaatttaaat

SEQ ID NO: 41 - DNA, 1106 bp, Glycine max
ttaattaagaatattcctttcttttcggtttcaatctctggatccgtcgtgacagacggcatggccacttccaatggcttcgtcgacggcactccctcggaatctgcattgatctttctcggcaccggttgttcgagcatggttcccaacctcatgtgcctccttcagccttctgaccctccctgccccgtctgcgtccagtcattgtccatccctcccgaacgaaaccctaattacaggtgcaatacgtctctcctaattgactacggcgccgccgccgccaacggtggcgatcgcaagtatatattgatcgatgtcggcaagacgttcagggagaccgtgcttaggtggttcgttgcccatcggattcccagaattgattctattattttaactcatgaacatgccgatgcagtccttggattggatgatatacgtgctgtgcaggcttttagtccaacaaatgatattgatcccacacccatatacttgagtcagcattcaatggatagcatagcagagaagtttccttatttggttcagaaaaagcgcaaggaaggagcagaaatacgaagggtggctcaaattgactggaacattattgcggatgactgcaatcaacagttttttgcgtcgggattaaaattcactcctttaccagttatgcatggagaggattacatctgtttgggctttctttttggtgagaaaaacagggtggcttatatatctgatgtttcccggtttcctgctagtacagagtatgtcatctcaaaaagtggagctggacagttggatcttcttatattggattctttatataggactgggtcacacaatgttcacctttgttttccacagactctagaaactgtgaagaggttgtgtccaaagcaaacactactaattggcatgactcacgagtttgatcaccataaagacaatgagtttttgatggagtggtccagaagggaaggaattccggtgaagcttgctcatgatggtttgagagtccccataaacttatagtaagggaaggttaaagcatgtgacaatgtataccgcatactgttgatcttaattagattggattggagcatttaaat

SEQ ID NO: 42 - DNA, 1690 bp, Glycine max
ttaattaagtttggacagtgatgtctgtgaacaataataacccttctaagggcattggggcctcttcctcatcctttggtaatgctggagtaccctccaattctataccttcaaaccctggattttcacagtcccaaggacaggcccagattcctgttggttatcaaggacagtttccactgtcccaggcccatgctattgtccaagctcagtccaaggcccaggcccaggcccaggcccaagcagcagctgcagctcatgctcaactccaggctcatttgcaagctcagggattgagtcttaatcagaaccaggctggtggtttgggggtgtcgtcaccgttgatttccacgccgggtaatgcgagtgggaaacggatccctctgaaaccccccatgcggccagttgggttttcccctcccaacagcttctccccattgagaccagtggagctcacgcctgctgctcggaggaagaagcagaagcttcctgagaaacagctgcaagataaagtggctgctattctgcccgagtctgcgctgtatactcagcttcttgagtttgagtctcgcgttgatgctgcgcttgctagaaagaaggctgacatccaggaagcgctcaaaaacccgccgtgtattcagaaaactcttcgtatttatgtatttaatacttttgctaatcaaattcgcacaattccaaagaagccaaatgcggagcttccaacctggacactgaagatagttgggaggatattggaggatggtgtagaccctgatcagccaggagtagttcagaagtcgtctcctttgtatccaaagttttcagcttttttcaaaagagtaactatttccttggatcagagactgtatcccgataatcatattattatgtgggagaatgctcgatcacctgctccacatgaaggttttgaagtaaagaggaaaggggataaagaatttacagtgaacatacggctggaaatgaattatgtgccagagaagtttaagctttcaccagctttgacagaagttcttggtattgaggttgatacccgcccgagaattgttgctgcaatctggcactatgtgaaggctaggaaattgcaaaacccaaatgacccttcctactttcactgtgatcagcctcttctgaaagtatttggagaagaaaagatgaagtttacaatggtttcacagaaaatatcatcgcatttgttccccccacagcctatacttttggagcataagatcaagctctcgggaaacaatcctgctggtactgcttgttatgatgtgatggttgatgttccttttcctattcagagggagttgtctgccttattggctaacgtggaaaagaacaaagagattgagacatgtgatgaagcaatatgtggaatcattagaaaaatccatgagcaccgtaggagacgggcattttttcttggttttagtcaatcgccagtagaatttattaatgcattgattgaatctcaaagcaaggatctgaaacttgtatccggagaacctagtcgcaatgcagaaaaagagcgtcgttcagatttcttcaaccaaccatgggttgaagatgctgttattcgttacctgaatcgcaaaccagctgtgggaagtgatgctccaggaagcacatgacaccagttcatattttaatcattcatcatcatttaaat

SEQ ID NO: 43 - DNA, 953 bp, Glycine max
ttaattaatgtgaacagtgaaagaaacaaaaaaaacaccatgatgctgaaggcggcaccgcgtgcagtaatctactacctctcggagcacccggctatcgtggggttccggtggagccacgcccaatcatggggcgccacgtggtccttcctcttctcctcaattgcctcctacctcttcctctcagtcttcctatacttctctctttctctcctcttccgccgccgtcaaatccctctcggcccccttcccgccgtccacagcctctccatgtccctcatctccgccacgatcttcgccggcatcctcctctctgccgccgccgagatcagcgacacgcggtggttctggcggcgctccaaaacccccctacagtggctcctctgcttccccttgggcacgcgcccctcggggcgcgtcttcttctggtcctacgtctactacctctcccgcttcctccacatgctccgcaccctcctcagaatcctacgccaccgcaggctatcattttttcatctgttgagtaactcaatctccgcactcgcctccttcctctggctcgagttctcgcagtcctttcaagtcctcgcaattctcttcgccacgctcgtgtacgcagccgtctacggctaccgcttctggaccgccatcggcctccgcggcgcgtgcttccccttcgtcctcagctgccagatcgtgctcctcgcctgcaatgttgcctgccacgtcgccgtcttcttcctccacttcttcctcaagggcgggtgcaatgggatcggcgcgtgggtcttcaactcaatcctcaacctcgctcttcttatgctctctcttaacttctacgtgagaatgcacgttcacaagaggaggaggaaagttagggatgttactgttactgttgctactgcactgtcttaacgagcgcgtgagtgcaacaaatattgaagtatttaaat

SEQ ID NO: 44 - DNA, 1144 bp, Glycine max
ttaattaagcaactcaatgaatgcggaatcaccgccggggctcctcatgtcggtttcctgcctctccgactacgacctcctctgcggcgaggactcctccggaatcctctccggagagtcgccggagtgctccttctccgacatcgactcctcacctcctccgccgtcgccgacgacagaggattgttattcgatcgcgagcttcatcgagcacgagcgcaacttcgttccgggattcgagtacctgtcgcggttccaatctcgctccctggacgccaacgccagagaagaatcagttggatggattctcaaggtacacgcgtactatggctttcagcctttgacggcgtacctcgccgtcaactatatggatcggtttttggattctcgccggttgccggaaacaaatgggtggcctctgcaacttgtatctgttgcatgcttgtctttggcagcaaagatggaagaacctcttgttccatctctcttggaccttcagatagaaggtgccaagtacatatttgagccgagaacaattcgtaggatggagctacttgttctcggtgtcttagattggaggctaagatcagtaacaccactttgcttcctcgctttctttgcgtgcaaagtagattcaactggaacttttatccggttccttatttccagggcaacagaaatcatcgtatctaatatccaagaggctagctttcttgcttactggccttcatgcattgctgctgcagccatactcactgcagctaatgaaattcctaattggtctgtggttaagcccgaaaatgctgagtcatggtgcgagggactaagaaaagaaaaagtaatagggtgctaccagttgatgcaagagcttgtgattaacaataaccaacggaaactccctactaaagtgttgccgcagctgcgagtaacaactcggacccgaatgaggtcaagtactgtatcatcattctcatcatcctcttcaacctccttctccttgtcttgtaagaggaggaaattaaataaccgtttgtgggtagatgacaaaggaaactccgagtgaagagaaaacgaacaacaataataaaagaagggaagaaaaagagagggaataaggtgggccaagttgtctagaaatttaaat

SEQ ID NO: 45 - DNA, 587 bp, Glycine max
ttaattaatactactccctcactttgtgttagaatcatcatgggtttgcaaaaccaattaaacgacgtgtcgtcgggttcgattccgcttctggtgttggcgcagatagccacctgcgtcaactacctccgctccatgcttttcgcgcttttgcaaaccctaggtctcagccgattccactccgaccagatcgtcgacgagcgcttcctcgccgccgtcggatccggcctcgccggacttatcatgctctccgatcagctcaccctcagcagccaattcttccaccatcaccacggcaccgccgccggccacgaccacgaccacgaccaccacccctgcgtcgtgtgccaggccaccttcgaggacggcgaccaggtccgcatgctctcctgccgccacgtcttccaccgccgatgcttcgacggctggctccaccactacaagttcaactgcccactctgccgctctccgctcttctccgacgagcgcgtggcactcacggagcgccgcctcggccagcaactcatctcttggttctccctacactgatgcggccacgtttcgttttctgaacctccaatttaaat

SEQ ID NO: 46 - DNA, 1655 bp, Glycine max
ttaattaacacataccaaaccccaagatcacttataaatacacagaaagagagtgaggaagttgccccagttgagtagtaagtgatgatggagatggattccatgtgtatgtgggtggtccttgtggccattgctggtgctcttttagtcctaagatctatgctcaagaatgtaaattggtggctctatgaatccaaattgggtgtgaaacagtactctttgcccccaggtgacatgggatggcccttcattggcaacatgtggtccttcctcagagctttcaagtccaaggaccctgattccttcatctcctcctttgtctccagatatggaagaactggaatgtacaagaccttgatgtttggaaatccaagtgtaattgtgacaacacctgaaacatgcaaaagggtgcttacagacgatgataaattcacaactggttggcctcaatctactatagagctcattggaaagaggtcatttatttcaatgtcttatgaagaacataaacgccttaggcgtttgacatcctcttcaatcaatggcatggaatcactgtccctctacttgacatatattgaagaaaatgtgaaaaattcattggagaaatgggccaacatgggacaaattgagttcttaactgagatcaggaagcttactttcaaaatcatcatgcatattttccttagctcagaaagtgaacctgttatggaggctttggagagggaatacacagcacttaatcatggagttagagccatgtgtattaatattcccggatttgcataccacaaagcattcaaggcaaggaaaaatctagtggccatatttcaatctattgtggatgagagaagaaacttaaggaagggatatctgccaggaaaagccaaagatatgatggatgctctgatagatgttgaagatgatgatggaagaaagttgagtgatgaggacatcattgacattatgttgatgtacttgaatgcgggccatgagtcttcaggacatattaccatgtgggcaacctttttcctgcagaagcacccagaatatctccaaaaggctaaggcagaacaagaagaaataataaggagaaggcctccaacacagaaagggttaacacttaaggaagtccgggagatggattttctttacaaggtgattgatgaaacattgcgtgtgattacattctcactagtggtctttcgggaggcaaaatctgatgtcaatatcaatggatacacaattccaaaaggttggaaagcgcttgtgtggttcagatcagttcaccttgatcctgaaatatatcctaatccaaaggaatttaacccttatagatggaataaagaacacaaggccggagaattccttccctttggaggaggaagtagattgtgtccggggaacgatcttgccaagatggaaatagcagtttttcttcaccatttccttctgaattaccgatttgaacagcataatcctaattgccctgtgagatacttaccacatacaaggcccatggacaattgcttgggaagggtcaggaaatgttcatctacaacaacctaagagcacatgtctatggctatttttaatttgaaaatccatctccatgttttccctcagctaaatgcttccagggccactatttaaat

SEQ ID NO: 47 - DNA, 1147 bp, Glycine max
ttaattaatgccgataaaaaatgccgccgaagcagcagcaatcgaaagctgatttagcgaagaagcagaagattgtagaggacaaaaccttcggtctcaagaacaagaacaagagcaaaaatgttcagaagtatgtccagaacctcaagcaatccgtgcagcccaggcccgatgccgccaaagtcgatgccaagaaaaagaaggaggaagataaggccaaggagaaggagctgaatgagttgttcaaaatcgctgttactcagcccaaagtgccagttggtgttgatcccaagtccatattatgtgagttttttaaagtggggcagtgtgccaagggcttcaaatgcaagttctcgcatgatttgaatgttcagaggaaaggggagaagattgacatttacagtgataagcgtgacgaggaaacaatggaggattgggatcaggagaccttggagaaggtggtggagtcgaagaaaaccgagtataatcagaataaaccaactgacattgtctgtaaatactttttggatgcagtagaaaagaagcaatatggttggttttgggcctgccccaatggtggtaagaattgccattatagacatgctcttccacctggttatgttttgaaatctcaaatgaaggctttgttagaggaagaaagtgaaaaaatatcaattgaagaggagattgaaaaccagcgtgccaaagtggcaactacaactcctatgactcctgagttattctttgaatggaagaagaagaagatagaagagagagatgccaatatagctgcacaacaggcagagagggctaagaatgatcgcatgagtggtcgggagctatttttgtcaaatgctagcttgtttgtggatgatgcagaagcatatgacgtgtaccagagagaaccagaatcttatgaaactgaacagaatgggaataggaatgctgctgaagatggcccctgctcctcagcaacagctgcttctgatggtgaagatcttgatgacatagatgacgatgatgagttagacatggatgagttagatgaattggaagcaagcttatccaagacatcaatccaaataaaggaaacaggagctgaagcttaatccggagaatttttcgcaatcttcatgtgaatttaaat

SEQ ID NO: 48 - DNA, 1754 bp, Arabidopsis thaliana
ttaattaaaaaataatgcaatctcttaccttaactcggtacccaactccaatttccccgccaagactcaatctttacccgctaagacaaatcgcagcttctgttctctctgctccgaccgccggtattaaccgtcgcgatatggcgtctcgccatcagtcaacttcctttaagccccttgccgttggtcggaatttgaccggagatgatgatgatggttactgtactcttatagactttgcaggtaacaaactgctctgtctgaacgaacttagcactgtctcgataattcaagttaatgtgttgtctgtcatccattgtcaatctatgtccgaaaatccgtaactttagtggaaataccctgaatttagcatctaaaatgtgcttaattgagtaagacaaatcttggaaactctcttagacgaacaatggttgggttttgacttttgacggttcctctgtataagcagtttgattgaagtcttaaatttattattattttaagttgttctatgaaattttctgataggtagtggaggaggagaagggaaaaatgtaggagaggatcttgtggtgttgctttaccacttacaacatgcttgcaaaagaatcgcttctcttgtcgcctctcctttcaattcttcactcggaaagctctctgttaactcctctagtgggtcagaccgagatgcgcctaagccgctcgatattgtctcggtctgtatcttattactctcttttttatcatgattcatatcaagattcaatcttacaattcatgtttccgttttgcagaacgatatcgtcttgtcctctcttagaaactcagggaaagtagcagtaatggcttctgaagaaaacgatagtccaacttggatcaaagatgatggtccttacgttgtggttgtagatcctctagatggatcacggaacatcgatgcttcgattcccacgggaactatatttggaatttacaatcgtctcgttgagcttgatcatttacctgttgaagagaaagctgagctcaattctttgcagagaggcagcaggcttgtagcttccggttatgtgctatactcttcagccactatcttctgtgttacacttggatcgggaacacacgccttcacgctagaccattccacaggagaatttgttcttacccatcaaaacatcaagatcccaactcggggtaaaaagcgtctaatgacacatatgacttgatccattgcgacattcctattcatggctctgaacaacctgcattaatcgttgttttttgtatgatcaacaataggacaaatctactcagtgaacgatgcgaggtactttgattggccagaaggtttaaggaagtacattgacacagtgagacaaggcaaaggtcaaaacccgaaaaaatactctgcgcgttatatttgttctctagtagctgatcttcacaggactctcttatacggtggagtggctatgaatccaagagaccatcttcgtttagtctatgaaggtaaccctttggcttttctcgtggagcaagctggtggcaaatcctctgatggaaaaagagggatactttcgatacaacccgtgaagcttcaccaaagattgcctctgtttcttgggagcttagaggatgttgctgagctagagagctatggagatgtgcagcagactgtgaaccctggctatgaagtttaaacaactcctctgtttcatattatctgtaaaaacaataaatgaatcgatgtggcgcgc

SEQ ID NO: 49 - DNA, 289 bp, Arabidopsis thaliana
ttaattaaatgagttctacaagcaaagcatggacagtggcagtgagcatcggagccgtagaggcattaaaagaccaactaggtctttgtcggtggaactacatactccggtcggttaatcaacatctccggaacaacgttagatctgtttctcaagggaaaaggttctcttcgtcttctgtctccgcagccgttacctcctctggtgagagcgagaaggctaagaaggctgaagaatctcttagaacagtcatgtacttgagctgttggggtcctaattaaggcgcgcc

SEQ ID NO: 50 - DNA, 358 bp, Arabidopsis thaliana
ttaattaagtgtttgagagagagagagagagatggtgacgaaggagcaagtcgaagcttcattgacttcgaaacttaagccaattcatctcgaagtcattgacatatctggaggttgtggttcgagttttgaagtggaggttgtctctgaacaattcgaagggaagagattgctggagaggcatcgtatggtgaatgctgcgctagaagaagaaatgaaagagattcatgctctctctattaagaaagctcagactccacaacaatggaagccaccatcacaagactctgcaaccttaaccaaagatgcctgaatttctgttttttaaaagccttgtgacaaagaacagaggcgcgcc

SEQ ID NO: 51 - DNA, 1909 bp, Arabidopsis thaliana
ttaattaaatggcattttcatcttcgtgttcgtccgtcaaagccgtcaactcacggtggacgtctccgtctccgtcaccgtcttctagattcgccgtcctccctgctttccttcaccgccgttacgcaacaagcgtcaaactaacggccataagcgccgccttaaaaaccgtcgagcaaacgacgttaacagaggataacagattctcaaccgtcggatctgactctgatgaatacaatccaactcttccaaagccgaggatcctcgtcaccgagaaactgggagaagccggcgtgaatctcctcagggaattcggcgacgttgactgctcttacgatctttcgccggaagatctgaagaagaaagtggcggagagtgacgctctgatcgtgagaagcggaactaaagtgacgagggaagtgtttgaggcggcgaaggggaggttgaaagtggtcggaagagccggagttgggattgacaatgttgatctgcaggcggcgacggagcacgggtgtttggtggttaatgctccaacggctaatacggtggctgctgccgaacatggaattgctttgcttgcttctatggcacgtaacgttgctcaggccgacgcttctattaaagccggaaaatgggagaggagcaagtacgtcggtgtatctctcgtcggaaaaaccttggccgtgatgggtttcgggaaagttgggacggaggtggcgagaagagccaaaggtctaggcatgaccgttatctcccacgacccttacgcgccagctgacagagccagagctctcggtgtcgatcttgtttcattcgatcaagctatctccaccgccgatttcgtctccctgcacatgcctttaactccggccaccaaaaaggtcttcaacgacgaaactttctctaagatgaagaaaggtgtgcgtctcattaatgtcgctagaggtggcgtcatcgacgaggatgcactcgttagagctctcgatgccggaatcgttgctcaggcagcattagatgtgttctgtgaggaaccaccatcgaaagatagcagactaattcagcatgaaaatgttactgtgacacctcatcttggagctagcacaaaagaagctcaggaaggtgtagccattgagatagcagaggctgtagcaggggcattgaaaggagagttatcagctactgccgtcaatgctccaatggtggctcctgaggtcttgtctgagttgactccttatattgtcttagctgagaagcttgggaggttagctgtgcagttagcatctggaggtaaaggagtacagtccattagggtggtctatcggtcagctcgtgaccgagatgatttggatactagactacttcgtgcaatgatcacaaagggaatcattgaaccgatctcagattcatatgtcaacttggtgaatgctgatttcatagctaaacaaaagggtcttcgtattagtgaggaacgaatggttgttgattcatcaccagagtaccctgttgattccatccaagttcagattttgaatgtggagtcaaatttcgctggtgctgtctctgatgctggtgatataagtattgaagggaaggtgaagtacggagttccgcatttaacttgtgtcggatcatttggtgtggatgtgagccttgaagggaatctgatactgtgcaggcaagtggatcaaccagggatgattggacaggttggtaacatacttggagaacaaaacgtgaatgtgaatttcatgagtgttggaagaacagtgttgaggaaacaagcgataatggcgattggagttgatgaagaaccagacaacaaaacacttgagaggattgggggtgtttctgcgattgaagagtttgtgtttcttaaactataaagtttgagatggagttgcatttaaat

SEQ ID NO: 52 - DNA, 1367 bp, Arabidopsis thaliana
ttaattaaatggcttcaatagggctatatgaagcattcataggtttcctctgctttctcatctccttttacttccttgtcaagaaacctttcaggtacttactcatcaagaaaactcatcaaagctacccttggaactggccggttcttggaatgcttcccggtattctcttgaggctccagcgcatctatgactacagcgtcgagttcctcgagaactccaacatgacgtttcaattcaagggcccatggttcgttggaatggatatattagccacggctgatccaacaaatattcattatataatgagctcaaacttctcaaattacatcaaaggtcctatattccacgaaatttttgaagcttttggagatgggatcattaatacggacgcggagctatggagggattggaggaacgcatctcagcttatatttaatcatcaaaggtaccaaaacttctcagcaagtaccacgaaaagtaaagtcaatgatgggcttgtacctcttttcaattgtggacttgcaagatgtgttccagagattcatgttcgatataaccttcattttcctaaccgggaccgatcctagaagtctctccattgaaatgccagagattgagtttgccaaagctcttgatgatgtgggagatgtgattgtgtataggcatattacaccaaggttcgtgtggaagttacaaaaatggattggaatcggaacagagaagaagatgtcgaaagctaatgccactcttgatcgtgtttgtgaaaaacttatagcagccaagagagaagagctaagatcacaagggattattgacaatgcgaatggagacagtgaggatcttttgacatcccacataatgcttgatgcaaccaagtacgagcttttgaaccctaatgatgataagttcctcagagacttcacagtaagtttcatggcagctgggagagattccacgtcctcagcactcacttggttcttttggaatttaactgaaaaccctaacgtcttaagcaagattcttcaagagatcaacacaaatctaccaagaaccggaagtgaccaagacatgtcatcgtacttgaacaagttggtgtacttacatggtgcattgaatgaatcaatgaggctctacccaccaataccattcgaacgcaagtctccaatcaaagacgatgtgctgccaagtggacacaaagtcaaatcaaatctcaatattatgatctttatctacgccatggggagaatgaaaaccatatggggagaagacgcaatggagttcaagccagagagatggatttcagagacaggagggttgagacatgagccttcttacaagttctgggttgagacatgaggcgcgcc

SEQ ID NO: 53 - DNA, 2154 bp, Arabidopsis thaliana
ttaattaaatggcggaatctgcaggagaatcctataggcttctctctgtttcttcatcaaccacatttcttgccttcataatcatcttcttacttgcgggtatagcaagaagaaagagaagagcgcctcacaggctgcctccgggaagcagaggatggcctttgatcggagataccttcgcttggctcaacgccgtcgctggttctcatccttcaagcttcgtcgagaaacaaataaaaaagttcgtctctttgctatgctctgttttgttattaatactcaagaggcctgataatagtggttttaatgaaattaggtatgggaggatattctcgtgtagcttgtttgggaaatgggcagtggtatcagcagacccggattttaaccggtttataatgcagaacgaaggaaagctatttcagtcaagttatccaaagtctttcagggatttggttgggaaagatggagtgatcacagtgcatggtgatcagcagagacggcttcactcgattgcatcgagcatgatgcgtcatgaccagctcaagactcattttcttgaggttattcccgtcgttatgctccagacactgagtaatttcaaggacggtgaagtcgtgcttctccaagatatctgcagaaaggtaagtgattgaatatgaagagtaagaagaagaaaccttttcggagatttttcttgatttctgatctttgtttggttctgttttaggttgccattcatcttatggttaaccaacttctcggtgtgtcgagcgaatcagaagtcgatgaaatgtctcagcttttctctgattttgttgatggatgtctctctgttcctattgacttgcctggtttcacatacaacaaagcaatgaaggtaagtttcaaacatctgagtcaattattgatttgtggctttggagcttgtttgctgagattttgtttgtttcttattcaggcacgaaaggagatcataaggaagataaacaagacgatagaaaagcggttgcaaaacaaagcagcatcagatactgctggtaatggtgtacttggaagattgcttgaagaagaaagtttaccaaacgaatcaatggcagattttatcatcaatctactgtttgccggaaatgaaacaacctcaaaaacaatgctgtttgcggtttacttcctcactcattgtcctaaggccatgacccaactcctggtacatataaggcctcttgaatgataagtaaattagttcctcttgcttctctgttgtgtttatcttctgaaacgttctgcaaatgagcaggaggaacatgataggctcgcgggtggaatgttaacatggcaagattacaagacaatggacttcactcaatgcgtaagtaaattaagaagctcaagaaactactctgcttctgatcttagatgataaaccttcactaaatgctttcttgatttctcaacaggtaatagatgaaacactcaggcttggtggaattgcgatatggcttatgagagaggccaaagaagatgtctcatatcaaggtacgttattgcgtctttgattattggtacatatattgaggcagatacatggtctaaaaatcaacttttttcggttcttatgcagattatgtcattcccaagggatgcttcgtagttccgtttctctcggcagtgcacttagacgagagctattacaaagaaagtctctccttcaatccatggcgatggcttgaccctgaaactcaggttttacttttcgtttgacattgtaacataatttcctaaaccttgtatcaatctagaggttaacattcattgatgtgaatgcagcaaaagaggaattggagaacgagccctttttattgcccatttggtggaggaactcggttttgcccaggagcagaactggctcgccttcaaattgctctctttctgcattacttcatcaccacatataagtcagtacatgttatgcttctgaagtatgtttgtctaagactctaaattaactaaaatctgattcattcttattgcctgttttaggtggacacaacttaaggaagatcgtatctccttcttcccttcggctcgtctagtgaatggcttcaaaatccagttgaacagacgagacagtgatcctccgaatcaataaggcgcgcc

SEQ ID NO: 54 - DNA, 1325 bp, Arabidopsis thaliana
ttaattaattttgatctgttgctctgtttcactgtgcgtgatcgggaagaagaagaaaatgttggcgattttcgacaagaacgtggcgaaaacacccgaggctcttcagggtcaagagggtggatcggtttgtgctcttaaagataggttcttgccgaaccatttctcctctgtttatcctggtgctgtcaccatcaatctcggatcttctggtttcattgcttgctctctcgagaaacagaaccctcttcttcccaggttttgtacaatagtttattcctcaggatgatgttttcttcttctgtcctagatatgagagatttgctatcttaatgtttcactggcttgcaaagatagtttaggatatgtttcactgaatctgagagattgagatatcgatctgttgttatgttttgatggaataatgaagttatatatctactttgttgtgatgtttaaaatgtgttgaaactggaaggatgtgattagataagtggtggtgattttttcaaaacaattttgtgtgtgtgacagattgtttgctgtggtggatgatatgttctgcatattccaaggacatatagagaacgttccaattcttaagcaacaatatggactaaccaaaacagctacagaggttaccattgtgattgaagcctacagaactctaagagatcgtggtccgtattcagctgaacaagttgttagagattttcaaggcaaattcgggtttatgctctatgactgctccacacaaaatgtcttccttgccggggtaagtttgaattctgcttctttactatttgacacttatttctgcatattgtaatgctgaggttattattattatacgcgtttcaggatgtagatgggagtgttcctctctactggggaaccgatgctgaaggacatcttgttgtttctgatgatgttgagactgtcaagaagggttgtggtaaatcctttgcgccattccctaaaggtatgtagcaagccgtttttcgggttttgaagacatctcactgttctttgatctagtgcaaatatgaattaggatgtggttgtgtgtatgcataatgcaggatgtttctttacctcatctggaggtttgaggagctatgagcatccatcaaatgagttaaagccggtaccaagggtagacagttcgggtgaggtttgcggtgtaacgtttaaagtggattctgaggccaagaaagaagcgatgcctagggttgggagtgttcagaattggtctaaacaaatctgaactagctgaaaaaggcttgttttattttttacttgttggactcctgtggcggcgcgcc

SEQ ID NO: 55 - DNA, 407 bp, Arabidopsis thaliana
ttaattaaaaatctcccttcttactcatttgcattagtcctcaaagatgggtatccaattgatcggactctctcaggcaaagcaaaagcttcaaagaagcttatcagcgagaatcgcaagcctcttggctacgtcgggtactaataatgtcccaaagggtcatgtggccgtctatgtgggagagacttatcacaggaagagatttgtgatacctatatcgtatttaaaccacccattgttccaaggtttgttgaacctcgcggaagaagagttcgggttcgaccatcccatgggaggtctcaccatcccttgcactgaagattacttcaccgctctagcttctattctaagtggttcatgataagggagctcattgatcatcacaacattcattaagttggcgcgcc

SEQ ID NO: 56 - DNA, 1186 bp, Arabidopsis thaliana
ttaattaaatgtctccgtcttggctccgcccaaccgccgatcacaatcatcctccaccgcaaccgccgtcgcaatcaccgtcccctctatcttccggtgatccgaatctcacaacatgtctctaccaaacagatcacggcgtcttctatctaacatggtcccgaactttcttaggaggccactctgtgaatctcttcctccattcacaagattactacaaccactcttcgccactctctttctcctccgctgatctctctctttcctccgccgtctctttccatctcaacttaaacacattagctttctggaaaaaacgtggatccagattcgtttctcccaaaatccaagtcttctgggacttaagcaaagccaaattcgactctggatccgaacctagatccggattctacatcgctgtagttgttgacggagagatgggactattagtcggagattcagtcaaagaagcttacgctcgtgctaaatcggcgaaacctccgacgaatccgcaagctcttctgttgaggaaagagcacgtgtttggagctagggttttcacaacgaaagcgagatttggagggaagaacagagagatttctattgattgtcgtgttgatgaagacgctaagctctgttttagcgttgattcgaaacaggttctgcagatcaagagacttagatggaaatttagaggaaatgagaaagttgaaatcgatggagttcatgttcagatctcttgggatgtatacaattggttgtttcagagtaaaagttccggtgacggcggaggaggaggaggacacgccgtgtttatgtttagattcgagagtgatccagaagcagaggaggtttgtgaaacgaagaggaaagaagaagaagatgagaaaaatcgaaacggtatcgttttatggaagccgaagaagcaatgtggaaatagttttgggattaaagggattgttgagtggaggaagatgaggaagagatttgttaagagtaagagaagttcttcgtcgtcttcgatttcgatgtcgtcggcttcttcggcgtgtagctcgtcggttatggaatgggctagtagtgctgatgaggcggagtacggcggaggaggttgttctggttccggttccggcaatggtcttggattctcattactggtttacgcttggattaagtgaggcgcgcc

SEQ ID NO: 57 - DNA, 828 bp, Arabidopsis thaliana
ttaattaagtgtagatttgagtagtgtaagcgtcgatgaagaaggttacatcgtctaagattccggccaaggatgattgggtggctgtagcgataactgacgacgatttggtcgttgagcttcttttacggctgaagcatgccggaacggtagtgtcggataatccggcggtgattctccctccgttgcggtggggaatccgtcaacgacggtctcgttcctcaagatttggtggcggcggcggcgttctcgtttccttgaagaaagatgtcgattccgttagagccagtccgaagactcctctctcgtggagcggcggatctggaagtggtggcggctctgcttctccttccgccgatggattcgaggataacagtcgccaagctagctgctctacatctacaggatctggatctaaggtttttcccacaaacgaaatcaccagttgtttctccaagagattgaagaagaggaagtcatcttttgagcttaaaaatgaagagaacttgaagttgaaggagagacttgaccttgaaaaggagattgcaagtctccgagcaacattcgatgaacaaaaccttaggaaccaaaagctgaagaggattaagcttgacttaaactcaggccgtgtcacaaacaagaaacctgttgatttgattcgtaaatcacaactcgagcggctacagggatcaaaatcttgcaaaaccagtgactcgcaaaatcaggggagtttcttcgtcctccctgatctcaacatggcgccatccgaggaagagatattgtacggaactagctaaaaactggcctatatgaagatttgggcgcgcc

SEQ ID NO: 58 - DNA, 1105 bp, Arabidopsis thaliana
ttaattaacaggtgacaatgcaaggaggatcatcgggtattggatacggtttgaagtatcagtctagatgtatatcggatgtgaaagccgatacggattacacaagctttctcactggaactcttagtttaaaagaagaaaatgaggttcatcttcttcgtttgtcatctggtggatctgagcttatatgtgagggtttgttctctcatcctaatgagatttgggaccttgcttcttgcccttttgatcaacgcattttctccaccgtcttctccactggtgaatcgtttggagcagcgatatggcaaattcctgagttatatggtcaactgaattctccacaattggagcgtgttgcttctcttgatgctcatgttggtaagattaattgtgttctttggtggccttctggaagatgtgacaagttaatcagcattgatgaacaaaatattttcttgtggagcttagactgttcgaaaaagtctgctgaggttctatctaaggattcagctgggatgttgcattctttatctggtggagcatgggatccacatgatgtaaatgctgttgcagcaacgggtgaatcatctgttcagttctgggacttgcgtactatgaagaaggttaactcaattgaacatgctcatgtacgcggtgttgattacaatcccaagagagaacatatacttgtaactgcagaggatgaatctggcatacatgtctgggatctccggaaggccaaggttcctgtccaagagcttcctggtcatacacattggacttgggctgtcaggtgtaaccctgagtatgatggactgattctgagcgctggaacagattcggttgtcaacctgtggtatgcttcagcaacatccagtgatgacaaaacctcagaaagtcctgtggaatccacacgacagcgtgtgaacccgttgctcaactcatacactgactatgaagacagtgtctatggccttgcttggagttcacgtgagccttgggtttttgcatcattatcatatgacggaagagtcatcatcgaatccgtcaagcctttccttccaagaatatagtaaaaacccagcatctcttttgctggcgcgcc

SEQ ID NO: 59 - DNA, 1078 bp, Arabidopsis thaliana
ttaattaaatggagatcgatttgggagctaacgcgtttggtatcgacttccatccatcgacgaatctagtagctgctggtctcatcgatggccacttgcatctataccgatacgactcagattcttcacttgtcagggaacgtaaagttcgtgcccataaggagtcttgtagagctgttcggttcattgatgatggccaaagaatcgtcactgcttcagctgattgttcaattctagcaactgatgtagagactggtgcgcaggttgcacatcttgagaatgctcacgaggatgctgttaatactttgattaatgttactgagacaactatcgcttcaggagatgataaaggctgcgttaagatttgggatacaagacagcgctcttgctctcatgagtttaatgcacacgaggattacatttctggcatgacctttgcatctgattcaatgaagctagtggtaacaagtggagacgggactttgtctgtctgtaatcttagaacgagtaaggtccaatctcagtccgaattttctgaagatgaactactttctgttgttataatgaagaatggccgtaaagttatctgtggaactcagaatggtactctcttgttgtattcatggggatttttcaaggattgcagcgatcggtttgttgatctcgctccaaattccgttgatgctctactgaagctcgatgaggacagacttatcactggatgtgataatggaataattagccttgttggaatactgcccaacagaatcatacagccgattgggtcacacgactaccctatcgaagatctcgctctctcgcatgataagaaatttctcggtagcacagctcatgacagtatgctgaagttgtggaacctagaagagattctagaaggttctaatgtcaactctgggaatgcatctggagctgcagaagacagtgacagcgacaatgatgggatggaccttgacaatgatccttccaagtcttccaaaggcagcaagaggaaaacaaaaagtaaagcgaatacgctgaacgctacaaataatttctttgcagacttatagggcgcgcc

SEQ ID NO: 60 - DNA, 1367 bp, Arabidopsis thaliana
ttaattaaatctctctcacttccacaaaactcaaaaaaatgtctcccattccaaaaccactcttcttcttcttcttcctcaactatgtgtctctctcaacctcactctctcttcacctcccactcacatctctccctatctccaccaccacaaactctcaccgcttcaccacctccctcctctcccggaaaaacccatctccgtcgtctccaccatacaacttccgatcaagattcaaatactcaatggctctaatcatctcactccccataggaacaccaccacaagctcaacaaatggttcttgacactggaagccaactttcttggatccaatgtcatcgtaaaaagcttcctccaaaaccaaaaacatcatttgatccatctctttcttcttctttctcaactttgccttgctcacatcctctttgtaaaccgagaattcccgattttacccttcctacttcttgtgactccaacaggttatgtcactactcttacttctacgctgatggaaccttcgctgagggtaatctcgttaaagaaaaaatcactttctcaaataccgaaattacccctcctttgattcttggttgtgctactgagtcttctgatgataggggcattttgggaatgaaccgtggtcgtctctcttttgtttctcaagctaagatttcgaagttctcttattgcatccctcccaaatcaaaccggcccggttttactccaaccggttcgttttaccttggtgataacccgaattcacacggtttcaaatacgtttctttgttgacttttcctgaaagtcaacgaatgccgaatcttgatcctcttgcttacactgttcctatgattgggattagatttggtttgaagaagcttaacatttccggttcggttttcagacccgatgcaggcgggtcgggtcaaacaatggttgattcgggatccgagtttactcatttagtagacgcagcttacgataaagtaagagcagagataatgacacgtgtaggacgaagattaaagaagggttacgtctacggtggaacagctgacatgtgtttcgatggaaacgtggcgatgatcccacggttgataggagatcttgtgtttgtgttcactagaggagttgagatacttgttccgaaagagagggttttggttaacgtaggaggtgggattcattgcgttggaatcggacggtcgagtatgcttggagctgctagtaatataatcgggaacgttcatcagcaaaatctttgggttgagttcgatgtgaccaatagaagagtgggtttcgctaaagctgattgtagcagagtagtgtgaggaaaagggttctgctacggttacaaacggcgcgcc

SEQ ID NO: 61 - DNA, 553 bp, Arabidopsis thaliana
ttaattaattagagatcatcgagagggcaagagagaaaaatgggaaaggcacgtacggtgggagtgggaatggactattctccgacgagcaaattagctctccggtgggcggcggagaatctccttgaagacggcgacaccgtcatcttgattcacgtccaaccacaaaacgccgatcatacccgcaaaatcctcttcgaggaaaccggttcaccgctaattcctttggaggaatttagagaggttaatttgtctaaacagtatggacttgcttacgatcctgaggttcttgatgttcttgatactctctctagggctaaaaaggtgaaggttgtagcaaaggtgtattggggagatccaagggagaaactttgtgatgctgtcgaaaatctaaaactcgattccattgttcttggcagtcgaggtttgggttctctcaaaaggatcttgctgggtagtgtgagcaatcatgtggtgacaaatgcaacatgtcctgtcacagttgttaaggctaattaaagtgtctcttgttctttaattggaccggcgcgcc

SEQ ID NO: 62 - DNA, 947 bp, Arabidopsis thaliana
ttaattaactctgtcctttcaacaattcaatggcagacccaagagttgcagttgttactggttccaacaaagggattgggtttgagatttgcaggcaactagctaacaatgggataactgtggttttaactgcgagagatgaaaacaagggtcttgctgctgtccaaaagctcaagactgagaatggtttttctgatcaagccatctcctttcaccctcttgatgtctccaacccagacaccatcgcttctcttgctgcttttgtcaagacccgcttcggcaaactcgatattctggttaataatgccggagttggaggggcgaatgttaatgttgatgttctcaaagctcagattgctgaggctggtgcgccaactgatatttccaagataatgagtgatacatatgagatagtcgaggagtgtgttaaaacaaactactacggcgttaagcgaatgtgcgaggccatgattcctctccttcaatcttctgattccccaagaatcgtcagcatcgcttccaccatgggaaagttagagaatgtttcaaatgaatgggcaaaaggagtgctgagtgatgctgagaacctaacagaagagaaaatagatgaagtgatcaatgagtacctcaaggattacaaagaaggtgcattacaagtcaaaggttggccaacagtgatgtctggatacatactatcgaaagctgcagtgatcgcattgacacgagtattggctaagcgacacaaatcgttcatcatcaacagtgtttgtcctggtttcgtaaacacagaaatcaatttcaacactgggatcttgagcgttgaagaaggtgcagcgagtccagtgaaactggctttggtccctaatggagacccatctggtcttttctttgatcgcgccaatgtctccaacttttgattcttcaatcttatgtgtcggtggcgcgcc

SEQ ID NO: 63 - DNA, 1055 bp, Arabidopsis thaliana
ttaattaagacttctttcctctcatcttctccagcagaaacaaaaaaagctgaaagatgtggttttttggatcgaaaggagcatctggattctcgtctcgttcaactgcagaggaagtcacacatggtgttgatgggactggtctcactgccatagtcacaggagcatcaagtggtataggagtagagacagcgcgtgttctttcactgcgtggtgtgcatgtggttatggcggtgaggaacactgactctggtgctaaagttaaggaagatattgtcaagcaagtccctggagctaaactcgatgtcatggagttagatctcagctcaatgcaatctgtcaggaaatttgcgtctgagtacaaatctactggtcttccactcaacctcttgatcaacaatgccgggattatggcatgtccttttatgctctctaaggacaacatcgagctgcaattcgcaaccaatcatttaggtcattttctgttgactaaacttctgctagatacaatgaagagcacatcacgtgaaagcaaacgagaaggaagaattgttaacctatcatcagaagctcatcggttctcgtatccagaaggagttcgttttgataagatcaatgacaagtcaagttacagtagtatgcgagcttatggacaatctaaactctgcaatgtgttgcacgccaacgagcttacaaagcaactgaaggaagatggagtcaatataacagcaaattcgcttcatccaggagccattatgactaacctcgggcgctacttcaacccctatttggctgtagcggttggtgcagtggctaaatatatactcaagtctgttccacagggagcggcaacaacttgctatgtggcattgaatcctcaagttgcaggagtttcaggggaatacttccaagatagcaacattgctaaaccattaccacttgtcaaagatacagaattggccaagaaggtttgggatttcagcaccaagcttaccgattcacaatcaggagaaagcagttcttgaaagtaatgatgttcagtgaatcggcgcgcc

SEQ ID NO: 64 - DNA, 2454 bp, Arabidopsis thaliana
ttaattaacatggcttctacttcaataatgctttcttccttcttctccttcttcttcttgactttttttgtcacttatgctcagcaaaacgtcaccgttcacacaatttgctactacgatggaggtaacttcacatccaacacttcatattcccttaatctcaaccgtctgatctcgtctttacctgatctaactccaaccatcaacggcttctacaatatctccatcaatggagaagtcaacgccatagctttatgcagaggagatgtcaagccaaatcaagattgcatcagttgcatcaccaccgccgcaaagcagctcgtagagagctgtccaaacatcatcgaagccaatatttggcttgagaaatgcatgtttcgttacacaagtcgaattatcttaggtcaaatggagccggttcctttttcttatacatcaagtaatgttagtgtgacagacaaggaaggtttcagcaagggtttaggtgacctattggattcattaggagcaaaaatcgatgctgcgaatgagaccaaagaggttaagtttgcagcaggagtgaaaggaacgatctacgcgttggctcagtgtacaccagatttgtctgaatcagattgtagaatctgtcttgctcagatctttgctggagttcccacttgttgtgatggaaagacaggtggatggtggactaatccaagttgctatttcaggtttgaagtgtatccgtttttcgatctttcagttacttcagaacagaagcaacctctttcttctcataataataacaccagaagaagtgatcaaggtatattacaagttaagctaatatcatcaaattgattaggaatttagaatctaccttttgattctctgttgttatttgcaggaaaaagtaaagaccggtctaaaactctcatctttgcggtggttcccattgtggcgatcatattaggtcttgtgtttctctttatctacttaaagaggaggaggaaaaagaagaccctgaaggaaaatgctgaaagtaagtttttggagctgattgagataactaatgatgctaaaccctattcttctaccttattatgaaagtttgcgctggctaattttgatctgcagatgaatttgagagtacagactcattgcattttgattttgagaccataagagtagcaacagatgatttttccttaacgaataagatcggtgaaggtggttttggcgttgtctacaaggtaaactcatcctactatactcttttttaccctaatcttaatctacagattaactttactcactgtgattcaataagcctgtcataaaatccatcagggtcatctcccagatggactagagatagctgtgaaaaggttatccatacattcaggacaaggcaatgcagagtttaagacagaagtactcttaatgactaagctgcaacacaagaatcttgttaaactctttggtttctccatcaaagaatctgaaagacttcttgtatatgagtttatcccaaatacaagtcttgatcggttcttgttcggtatatatagtctctcattcgatcttttctccttccgatgattagcttttctctgtttcatttctttcctctgctaatgaatctagatcctatcaagcagaagcaactagactgggaaaaacggtacaatatcatcgtaggagtttcccggggattgctttacctacacgaaggctcggagtttccgataatccaccgtgatctcaaatcctccaatgtgcttttagatgaacaaatgctacctaagatctcagattttggaatggcaagacaattcgatttcgataatactcaagcagtaacaagaagagttgttggaacttagtaagtctagttattcaaaactaacaccagaatcaatctcaatgtctcatctgtctttgttttctgtagtggatatatggctccagagtatgcaatgcacggaagattctcagtgaaaacagatgtttatagctttggagttcttgtacttgagatcattacaggtaaaagaaacagtggattaggtcttggtgaaggaacagatctccccacatttgtaagtaaacaacaagaaacaacacacaaccacagacaaacacacaagaatcaatctcaatctctcatctttgttgcaggcttggcaaaattggattgaaggaacatcaatggaactaatagatcctgttcttctgcaaactcacgacaagaaagaatcaatgcaatgcttagaaattgctctgtcttgtgttcaagagaatcctacaaaaagaccaactatggattcagttgtttcaatgcttagctctgattctgagtctcgtcagcttccaaaaccatcgcagcctggtttcttcagaagatcagcgtcgttttcgatttctttaaatgatgtttctctcacagatttgtctgcacgttaggggcgcgcc

SEQ ID NO: 65 - DNA, 1027 bp, Arabidopsis thaliana
ttaattaaatgagcaattatgcagccggactcggtaagcctggctcaggtaaaaggagaatcagagatcttttaaatcaacctgataaccgagtctgcgctgattgtggcgcttctgatcctaaatgggcatcagcaaatatcggagtattcatttgcttaaaatgttgcggtgtgcacaggagcctcggcactcatatttcaaaggttttgtctgtgacactagatgaatggtcagatgaggaagtcgattccatgattgaaattggaggaaatgcgtctgctaattcaatttatgaagcttttttacctgacacgtgctctaagcctggacctgatgttaatcatgaccagcgtatgagattcattagggcaaaatatgaactgcaagagtttctgaaaccaagcttgcggattacatccgggaaaggctcaacaaagagttcagcttttcttacatcaagtctttctagaaagatcatggatagttttcgcacaaattcatcatcgcagacgatgtttcaggaaggaatggtagagtttattggattgttgaaggtgactattaagaagggaactaacttagcaatcagagacatgatgtcaagtgatccatatgttgtgttgaatctagggaagcaaaaacttcagacaactgttatgaatagtaatttgaacccggtatggaatcaagaactcatgctgtctgttcctgagagctatggccctgtgaaattgcaagtgtatgattatgatacattttctgctgatgacataatgggagaagcagatattgatatacaacctttgataacatctgcaatggcttttggggatccagaaatgtttggggatatgcagattgggaaatggctaaaatcgcatgataacccattaatagatgacagtatcattaacattgttgatgggaaagtgaaacaggaggttcagatcaagcttcagaatgtagagtctggagaattagagctagaaatggaatggctgccacttgaccaataaggcgcgcc

SEQ ID NO: 66 - DNA, 2082 bp, Arabidopsis thaliana
ttaattaagtttctttgttccttctttgtcactatgaatcttagtttttcttcttataatctcacggctactgccgtgtcctcttcttgtttcggaagcgacgaacttctggtttcaaggaggctgttttccctgagagatgttcagattcttgagctctttattgcctttttcgtgtttgcgacaatacattccttgcgccagaagaaacaccaagggatgcccgtttggccgttggttggcatgcttccttcgttgatatccgcggtacgaagcaacatatacgaatggctgtctgatgttcttatcagccaaaacgggacattccggtttagaggtccttggtttagcaccctcaactgcgttgttacctgcgacccaagaaacgttgagcatcttctcaagacccgtttctctatctacccaaagggttcttacttccgtgagaccatgcaagatctactcggagacgggattttcaacaccgatgacggaacgtggcaacgacaaaggaaagcagcaagtgtcgaattccattcggctaaattcagacaattaaccagtcaatcattgcacgaactcgtgcataatcgacttttgccggttctagaaacttccggaaagattgatcttcaggacattttgttaagactaacgttcgacaatgtatgcatgattgctttcggggtcgatccaggctgtcttagtccaaaactacccgaaattccttttgcaaaagccttcgaggacgcaacagaagcaacagttgtgagatttgtgatgcctaaattcgtgtggaagctcatgaggtctcttaatttaggaacggagaagaagctaaaggaatcaataaatggtgtggatgatttcgctgaagaagtaatccggacgaggaagaaagagatgtctctagagactgaaatcgcgaagagacctgatctcttgactatttttatgggtctacgagacgaaaatggacagaaattttcagataagttcttgcgtgatatttgtgtgaacttcatacttgctgggagagacacttcctctgtggctctaagctggtttttctggttaatcgagaagaatccggaagtggaggagaaaattatgatgggaatttgcaagattcttgagcagagggttgatcatggagatacaaagaagaacatggaatatgagcccgtcttcagaccagaagagatcaagaaaatggattatctacaagctgctttgtctgagactcttagattgtatccctctgttccagtcgatcacaaagaggtatctgctctgtttcatttacttgtctcccaagaagtcattaagaatatgatttttggttctttttttttcagctatccggaattttttttagtcctttttgtgaaaattttggctcgcttctagttttagccttttaggtacaattcgaattttgagacgaactattatccataagtaaataattagttttaatcaatatagtaaaacctagttctgatatatagttaaaagtgaatttgttaggaatatttgatatattggtgtggttgactgcttgggttacataagattctcttttattcgatttcggttattgacatatagttttcatgaggtttacaagagtaaaataatttgtaggtacttgaagacgatgtatttccagatgggacgaaattaaaaaaaggagaaaaggttatatatgcaatatacgcgatgggacgtatggaaacaatttgggggaaagactgtcgtgagttcaagccagaaaggtggttaagagacggcaggtacatgagtgagtcggcctataagttcacggccttcaatggtggtcctcggctatgtctaggcaaggattttgcgtattaccaaatgagatatgtagcggccgccattatttaccggtataaggttagggttgatgataagggtggtcataaggttgagccaaagatggctctaactatgtacatgaagcatggcttgaaggtgaatatggtcaagaggagtgtctctgagatagaccactactactgctgagtgcctgacataagggtataaaattggcgcgcc

SEQ ID NO: 67 - DNA, 1537 bp, Arabidopsis thaliana
ttaattaaatggcatttcttctgagttttttgatactagcgtttcttataaccatcatcttctttttatcttcatcttcaactaaaaaagtccaagaaaacaccacatatggaccaccatcgtatccactcattggctccatactctctttcaacaaaaaccgtcatcgtcttcttcaatggtacaccgagcttctccgtctctctccgtctcaaaccatcttagttcctctcctcggcaaccgtcgcaccatcatcacaacaaacccattaaacgtcgagtacattctcaaaacaaacttctttaacttccctaaaggtaaaccttttactgatcttcttggtgatcttctcggtggaggcatattcaatgtcgacggtcactcatggagctcgcagcgcaaactcgctagccacgagttctccactcgctcgcttaggagttttgcttttgaggttcttaaagacgaagtggagaaccgtctagtcccggttttatccacggcggctgatgttggtacgaccgtggatttgcaagatgttttgaaacgttttgcttttgatgttgtttgtaaagtctcgttgggttgggatccggattgtttggatctaacccgacccgttaatccacttgtggaggcttttgacaccgctgctgagattagtgctcgccgtgccacggagcctatttacgctgtttggaaaacgaagcgtgtgttgaacgtgggaagcgagaggaagcttagggaagcgatcaggaccgtgcacgtgttggtctctgagattgtcagagctaagaagaagagtcttgagatcggaaccggagcagaagcaaagcaagatcttttgtcgaggtttctagccgccggccacaacggcgaagcagtgagggacatggttattagttttatcatggcgggaagagatacaacgtcagcagcgatgacgtggctgttttggttgttgactgagaacgatgacgtggagcggaagattttagaagaagtggacccgttggtgagtttagggttagggtttgaggatttgaaagagatggcttacacgaaggcttgtctatgtgaagccatgaggctatatcctccagtttcgtgggactctaaacatgctgcaaacgacgacgttttgcctgatgggacacgtgtcaagagaggagacaaagtgacctatttcccatacggtatggggaggatggagacgctatggggtacggattcagaagagtttaacccgaaccggtggtttgattctgaaccggggagtacacgaccggttttgaaacctattagtccctacaaatttccggtttttcaagccgggccgagggtttgtgtagggaaagagatggcatttatgcagatgaaatacgtcgttggttctgttttgagtcggtttgagattgtgccggttaacaaagaccggccggtttttgttcctcttttaacggctcatatggctggtgggcttaaggtgaagatcaagagaagaagtcacatccttaacaacgtttaaggcgcgcc

SEQ ID NO: 68 - DNA, 967 bp, Arabidopsis thaliana
ttaattaaatggggtttctccgttgtctccagctgctgctgcttctgtttctatctcttcgtctacaaaagctctctgctcaatcttcttcacccaatgcttcttcttcttcttcactcgatgctcttcttcaagattactcttttagagccttgcttcgtcctcgtaccggcattctctacgaggctactactgttccttccaatttgactgggatcaaactcgctgctatgagactcagaagcggaagctttagaaaacgtggagtcactccttttaatgagttctcaattcccagcggcgttatcgtcaagccgtatgtgacaaggcttgttttggtttatcaaaacctagctaatttctctcacttgtattaccctttgtctggttatgattatgtcgctcctgtcttgggtcttctcgcttacgatgctaagaatctctctgcgcttaatttgcctcagcttgatttaagggtgtctaatgatcctatcagaatcgatttctctgatctggaacgaatcccgcaagggtctagtgctaagtgtgttagattcgattctaaaggtgaagcgagtttcagcgattcgattcagcctggaaacacatgcgagactgagcatcagggacatttctctgtggtggtgaaatctgtggcttctgctccgagtctagctcctcctgggattgagagtaagaagaagaagaagagctctgattccaattccaagacttggatcattgttgggtcggtggttggtggattgatactgttggggcttttactgtttctggttttgagatgtcgaaattacaagaagcaagagaaaatgagggagatggagagagctggagagacaggggaagctctgaggatgactcaggttggtgaaacaagagcaccaactgctactacgactcgtacacaaccaatgcttgaaaccgaatacgcagcttagggcgcgcc

SEQ ID NO: 69 - DNA, 343 bp, Arabidopsis thaliana
ttaattaaaagcgacggtggtctgttattaaagccggagggagaattttaccgacgatgatcgggcgacgtgctggaactaatcgagtcggtatgaggagagacgactctcttctgactcggtttgttgactcagtgttctatttcttccgattagctgagtttgagatcctgtttgtgctcttcatgcttattacctacgttattttcaaagatctgacgtcgaggccggagtataatcggattcttgtggagaaacccggtggatctgacatctggccgttttaaatgataagaagaagattttgtgttgaatggttagttcttggtttctgaggcgcgcc

SEQ ID NO: 70 - DNA, 820 bp, Arabidopsis thaliana
ttaattaaaaagtcgagtgagtgctttcatcttcttcttaagcatctatggccgcgtctctaacatctcttccgaccggtttttgtcttagccatggtgatgaatgttgcaaccgttcacctaccaaatcaccatttccaggccatcatcctctggctgggaggaggaagggtcacttgctccattacgaacgtagtacagtgaggagattggttgtgacggcggcgacggagggatctaaaaaatctaaagaaagtgaaccgtcttgggcgaatcctgactcagatgagccacctccttgggctagaaacgaaggtcgttcttctacgtcccaagagagctttgaggttcctttctttgtttatctgctagcttccgcgattactgccattgctgctgtatgcttcttcttctctctctttcactccttttgttgtttgcattgctgattctcatatcaaagatgttatcttaattatgcatcgtttggtcactgtagattggttctgttttcgagtacacaagcaagaatccagttttcgggatcttggaatctgacagcatcttttatactcctgtgcttggattctttgctcttactggaatccccacttctgtgagttccttgtctctctcttttcgtttttatccatttgatctgtatcagctgaaaaaatggtttttttgcgttcaggtgttcctatggttcaaatccgttgaagctgctaataaggaagctcaagaacaagataaaagagatggctttctttaaaatccttttgtgtgattctgcaactcatacagtgatgattggcgcgcc

SEQ ID NO: 71 - DNA, 1587 bp, Arabidopsis thaliana
gtttgttgattaacccttaataaaatggcgatgatcataggcttacttgaaatcttcatcgcattcattttcttctttgtctaccagtgtttctcgctccacaagaaaactccaaagcatatggtcatgaactggccggtccttgggatgcttccgggtgtgctcttccaaatccctcgtatctacgactttgttacggaggctcttgaggcagaaaatatgacgggttgtttcatagggccatggcttagtggaacagacatattgctcactgttgacccggtgaatatccagtatattctaagttcaaacttcgtgaattaccccaaagggaagaagtttaacaagatctttgaattcttgggagatgggattttcaacgttgactcgggcttgtgggaggatatgagaaactcgtctcatgcgattttcagccatcaagatttccaaagtttttcggtgagtacaagcgtaagcaaattaagtcaagggcttgttcctattcttgataacgctgttgagaaacacattcttgtcgacttgcaagatttgttccagagattcttgtttgacacatcttctactttgatggctgggtatgatccaaaatctctctccgttgaaatgcctaaggttgagttcgctgatgcgatggatggagttgcagatgccatgttctatagacatctcaagccggctttcctgtggagtatccaatcttggatcggtgtaggaatagagaagaagatgagaagaggtctcgacgttttcgatcaaatgctagggaagatcatatcagctaaacgagaggagatcaaaaatcatgggattcatgactcaaaaggagaggccatggacgttttaacatattacatgactatagacacgaccaaatataaacacttgaaaccgagtaacgataaattcatcagagacactattttgggtcttgtgatagcggcaagagacacaaccagctcagctctcacttggtttttctggcttctctctaagaaccctgaagcaatgaccaagatccgacaagagattaacaagaagatgccaaagtttgatccggcagatttagacaagctcgtgtacctagacggtgccgtgtgtgagacgctaaggctatacccatcagtcccattcaaccacaagtcaccggcaaagccagacgtgcttccaagtggtcataaagttgataagaattggagggtagtaatccctatttattcattaggcaggatgaaatctgtttggggagatgacgcagaagattttcgaccagagagatggatttcagacagtggaatgttgagacaagagtcttcatataagtttttggcgtttaacgctggtccaagaacttgcttggggaaaagattaacattcttgcagatgaagacagtagcggtcgaaatcattagaaactatgacattaaggtcgttgaagggcacaaaccaaaaccagttccttccgttcttcttcgcatgcaacatggtctcaaagttagtgtcactaagatttagatttaaatacccagctttctaaattggagctctgcagagctttcgttcgtatca

SEQ ID NO: 72 - DNA, 1394 bp, Saccharomyces cerevisiae
aactctttgtttcttgtttgttgattaacccttaattaagatgtctctgccaggttcgaaattagaagaggccaggagactggttaatgaaaaacagtataatgaggcagaacaagtctatttgagcctgctggataaagacagctcacagagcagcgccgctgccggtgccagtgtggatgacaagcgtagaaatgaacaggagacaagcatattggaattaggacagttatacgtgactatgggtgcaaaggacaaattgcgcgagtttattcctcattctacggagtatatgatgcaatttgccaaatccaaaacggtaaaggtattgaaaacgttgattgaaaaattcgagcaagtgccggactccttggacgatcagatctttgtgtgtgagaaaagcatcgaatttgccaagagagaaaaaagggtgtttttgaagcattcactctcgatcaaattggccaccttacattaccaaaagaaacagtacaaggactcattagcattgattaacgatcttttgagggagttcaaaaagctggacgacaagccctctttggttgatgtacatctattggaaagtaaagtttaccataaactgaggaatctagccaagtccaaggcctcgttgactgcagcaaggacggccgctaactccatatactgtcctacacaaacagttgcggagctggacttgatgagtggtatcctgcactgtgaagataaagactacaaaactgcattttcgtatttcttcgaaagttttgaaagctaccacaatttgactacgcataattcctacgaaaaggcatgtcaagtgttgaaatacatgctattgtctaagatcatgctgaaccttattgatgacgtaaaaaacatcctaaacgcaaaatacacaaaggaaacgtaccagtcccgaggcattgatgccatgaaagctgtcgctgaggcttataacaacagatcgcttttagacttcaatacggcgctaaagcaatacgagaaggaactaatgggcgatgaactaacaagatcccatttcaatgcattatacgacacgttattagagtccaatttgtgtaagattattgagccatttgaatgtgtggaaatatcccacatttccaaaataatcggtctggatactcaacaagttgaaggaaagctctcccaaatgatactagataagatattctacggtgttctggatcaaggtaatggttggctctacgtttacgaaactccgaatcaggatgccacgtacgactctgcattggaattagtcgggcaactaaataaagtcgtcgatcaactatttgaaaaggcaagtgtcttgtattagatttaaataccccgaaattggagctctgcagagctttcgttcgtatcat

SEQ ID NO: 73 - DNA, 1758 bp, Arabidopsis thaliana
ttaattaagaaataatagaatgggaaaacaacaagattggtccgtgaccgcttgtattttcctatcgttgtctctagcatcacaaatccattgtagtagccaaacacattttccaagccacaagggaggagctggtttgtcaggtgacacaagccacttcaattctgttagtcgcgaaaatgtgctttcgcttaaggagaaagatctaatcgagaagctccccggacaaccttccggcattagtttcagacagtacggtggttatgtggccgtaaacgaaccagccactcggtttttgtactattattttgtggaagccatcaaacctagtaaatctactcctcttgtgctctggttcaacggaggtacctctagaaaatatatatcccctatacaaactctctttattggtattacttatagattttttaaaatacaattagactcttctaacaagaacaaactttttataaaaatgtacaggaccggggtgctcatctgtaggatttggggcatttgaagagcttggtccatttcgcgtacatagcgatggcaaaacgctttaccgcaatccttattcatggaacaacggtacgtataccttttaaaaaaatatgataattagaaattttagtctacgttatttataagttgtaatgagatcaatgagaaatgcgattgcgtgtggatttgcagaggcgaacatgttgttcttcgaagggccaataagtgtaggattctcgtactcgagtactccttttgattgggagatatttggggaacaagcggataagctaacagcagaggataactacatgttcttggtgaattggcttgaaaggtttccggaatataaaggacgagacgtttacatctccggtcagagttacgctggccactatattccccaactggcccagatcatccttcaccgtaacaaccaaaccttcatcaatctacgaggcatttcgatcggtaatccaggtctcgatttacttatcgaggctgataatgagaataaatttattttaagtcatggtttggtttcccaaaaagattttgaagagtacagtaaagtctgcgattttgccaactatgatatggacgaatgcccaaagataatgcctaaatttagtattgaacataacaaacacttggacgtttacaacatatacgctcccgtgtgcctaaactccacgttaagcagcgaacccaagaaatgcaccacaataatggaggttgatccgtgccgttccaactacgtgaaggcttatcttaacagcgaaaatgttcaagaagcgatgcatgccaacaccacaaaattaccgtacgagtggaaggcttgcaatcactacttgaattccgtatggatcgacgctgataaagatgcctcaatggttcctatccttcacgacctgatgggtgagggtgtccgagtattggtgtatagtggggacgtggatgcggctattccgtttacagctacaatggccgtgctgaagacgatgaatctaacggttgtaaacgaatggcgtccgtggtttaccggaggacaactgggagggttcacagaggattacgaacggaacttaacgtatgcaactgtgaaaggatcaggtcattctgttcctttggaccaacctgtacatgctcttaatctatttaccagtttcatccgtaacactcctctccctcaaacaccctgatttgtaacatgtaccacctctattgactgatcaagatactttggggcgcgcc

SEQ ID NO: 74 - DNA, 977 bp, Arabidopsis thaliana
ttaattaagctatctctcttcttcttccttctcctaacaacttatataccatgagtctcttcaacactgaaaacacatgggcctttgtctttggcttgctcggcaaccttatctcctttgccgtgttcctatctcctgtgccaacgttctataggatttggaagaagaagacaacagaagggtttcagtctattccttatgttgtggcgctcttcagtgcgacgctttggctttactatgcgacacagaagaaagatgtcttcctcctcgtaaccattaacgcctttggttgcttcatcgaaaccatctacatctctatgttccttgcctacgctcccaagccagctcggatgttgacagtgaagatgctacttcttatgaactttggaggattctgtgcgattctccttctttgccaattcttggtaaaaggagccacacgtgctaagattatcggaggaatctgtgtcggattctctgtttgtgttttcgctgctcctctaagcataatcaggacggtaataaagacaagaagtgtggagtacatgccctttagcttatccttaacccttaccatcagtgctgtcatatggctcctttatggtcttgctctcaaggacatctatgttgctttcccgaatgtgcttggttttgctctcggtgcactccaaatgatactctacgttgtctacaaatactgtaaaacgtcgccgcatctaggagagaaagaagtcgaagctgctaagttaccggaggtgagcctcgatatgttgaagctaggcacagtttcatcccctgagccaatctcagtggttcgtcaagcgaacaagtgtacctgcggaaatgatcgaagggctgagattgaagatggacaaacccctaaacatggcaagcagtcctcttccgcagcagctacatgaataaaaatacgttaatgttgactttaccccaacttgatataccaaccacggcgcgcc

SEQ ID NO: 75 - DNA, 896 bp, Saccharomyces cerevisiae
aactctttgtttcttgtttgttgattaacccttaattaagatgcctcaaaacgattatatcgagcgtcacatcaaacagcatggtaaaagattagatcacgaagaaaggaaacgtaagagagaggcaagagagtctcataagatttctgaacgggcccagaagttgactggttggaagggtaagcaatttgctaagaagagatatgctgaaaaggtatcaatgagaaagaagattaaggcacatgaacaatctaaggtcaagggttcatccaaaccattggataccgatggtgatgctttgccgacatatctattggacagagaacaaaataacacagccaaagctatttcttcatcgatcaaacaaaagaggttggaaaaagctgataagttttcagttccgttaccaaaggttcgtggtataagtgaagaagaaatgttcaaagttattaaaacaggtaaatctagatccaagtcatggaagagaatgataacgaaacacacttttgtgggtgaaggtttcactagaagaccagttaaaatggaaagaatcatcagaccaagtgcgttgagacagaaaaaggcaaacgtcactcatccggaattaggtgtaactgtcttcttgccaattttggcagttaagaagaatccacaatctccaatgtacactcagttaggtgttttgactaaaggtaccattattgaagttaacgtttcggaattggggatggttactgctggtggtaaagttgtctggggtaagtatgctcaggtcacaaacgaaccagacagagacggctgtgtcaatgcggttttgcttgtatgaatttaaatacccagcaaattggagctctgcagagctttcgttcgtatcatcggtttcgacaacgttcgtc

SEQ ID NO: 76 - DNA, 2266 bp, Saccharomyces cerevisiae
tcatttatttgtcagctttcaaactctttgtttcttgtttgttgattaacccttaattaagatgactgccagcgtttcgaatacgcagaataagctgaatgagcttctcgatgccatcagacaggagtttctccaagtctcacaagaggcaaatacctaccgtcttcaaaaccaaaaggattacgatttcaaaatgaaccagcagctggctgagatgcagcagataagaaacaccgtctacgaactggaactaactcacaggaaaatgaaggacgcgtacgaagaagagatcaagcacttgaaactagggctggagcaaagagaccatcaaattgcatctttgaccgtccagcaacagcggcaacagcaacagcagcaacaggtccagcagcatttacaacagcaacagcagcagctagccgctgcatctgcatctgttccagttgcgcaacaaccaccggctactacttcggccaccgccactccagcagcaaacacaactactggttcgccatcggccttcccagtacaagctagccgtcctaatctggttggctcacagttgcctaccaccactttgcctgtggtgtcctcaaacgcccaacaacaactaccacaacagcaactgcaacagcagcaacttcaacaacagcaaccacctccccaggtttccgtggcaccattgagtaacacagccatcaacggatctcctacttctaaagagaccactactttaccctctgtcaaggcacctgaatctacgttgaaagaaactgaaccggaaaataataatacctcgaagataaatgacaccggatccgccaccacggccaccactaccaccgcaactgaaactgaaatcaaacctaaggaggaagacgccaccccggctagtttgcaccaggatcactacttagtcccttataatcaaagagcaaaccactctaaacctatcccacctttccttttggatctagattcccagtctgttcccgatgctctgaagaagcaaacaaatgattattatattttatacaacccggcactaccaagagaaattgacgttgagttacacaaatctttggatcatacttcagttgtttgttgcgtgaagttcagtaacgatggtgaatacctagccacaggctgcaacaaaactactcaagtgtatcgcgtttcagatggttctctggtggcccgtctatctgacgattctgctgccaataaccatcgaaattcgatcactgaaaataacaccaccacgtccacggataacaatacaatgacaaccactactaccaccacaattactaccacagcgatgacttcggcagcagaattggcaaaagatgtggaaaacctgaacacttcgtcttccccatcatccgacttgtatatccgttcagtgtgtttttctccagatgggaaatttttggcaacaggtgctgaagacagactgattagaatttgggatattgaaaatagaaagattgttatgattcttcaaggccacgaacaagatatttattcattggactactttccctcaggtgacaaattagtctccggttctggtgaccgtaccgttcgtatttgggacttacgtacaggccagtgttcattgactttatccattgaagatggtgttaccaccgtcgctgtatcaccaggtgatggtaaatacatcgctgctggttctctagatcgtgctgtgagagtttgggattccgagaccggattcttggtggaaagactagattcggaaaacgaatccggtacaggccacaaggactctgtttatagcgttgtcttcactagagatggacaaagcgttgtatccggctcattagatagatctgttaagctctggaatttgcagaatgcaaacaacaagagcgattcgaaaactccaaattccggcacttgtgaagttacgtatatcgggcataaagactttgtattgtccgtggccaccacacaaaatgatgagtacatcttgtccggttccaaagatcgtggtgtcctgttttgggataagaaatccggcaatccgttattgatgttgcaaggtcataggaattcagttatatctgtggctgtggcaaacgggtctccgctgggtccagaatataacgtttttgctactggtagcggtgattgtaaagcaaggatttggaagtataaaaaaatagcgccaaattaaatttaaatacccagcaaattggagctctgcagagctttcgttcgtatcatcggtttcgacaac

SEQ ID NO: 77 - DNA, 816 bp, Saccharomyces cerevisiae
aactctttgtttcttgtttgttgattaacccttaattaagatgtggtcatcactttttggttggacatcaagtaatgccaagaataaagagtcaccaacaaaggccatagtgcggttgagggagcatatcaaccttctatccaaaaagcaatcgcatttacgtactcaaattacaaatcaagagaatgaagctagaatctttttgacgaagggcaataaagtaatggcgaagaatgcacttaaaaagaagaagacaatcgaacaacttttaagtaaggtagaaggcacaatggagtctatggaacagcagctattctctatagaaagtgcaaacttaaatctagagacaatgagggctatgcaggaaggtgctaaggcaatgaaaactattcacagtggccttgacatagataaagtggatgaaactatggacgagataagggagcaagtcgaattaggagatgaaataagcgacgctatatccaggcctttaattactggggcaaacgaggtggatgaagatgagctggacgaggaattggacatgctggctcaagaaaatgctaaccaagaaacgtccaagatcgttaataataatgttaatgcggcgcctatctcagagaacaaagtctcactacctagtgttccaagtaataaaattaaacaaagtgagaactctgtgaaggacggggaagaggaagaggatgaagaagatgaagatgaaaaagcattaagagaactacaagcagaaatggggctttgaatttaaatacccagcaaattggagctctgcagagctttcgttcgtatcatcgg

SEQ ID NO: 78 - DNA, 1760 bp, Saccharomyces cerevisiae
aatattattcatttatttgtcagctttcaaactctttgtttcttgtttgttgattaacccttaattaagatggaaccgctgctttttaatagtgggaaagcaaatccctctcaagatgttttcatagatgtggaagttggtgatattaccacaaaatatggttccacaaatactggatcattcagttcgatggatactgtggaagcgcaggcgataaaggcagagacggcaagattcatggaagttccacagggaagacatttaggtgtgttctccacggttgtgttatttgtttcgaggataatggggtcaggtatatttgcagtacccagtgtgattttactgaatacaggtggtaataagctgatatattttgcgatctgggtttttagcgctgcgatcgcttttgcaggattgtatctttttctagaatttggttcctggataccgaaatcaggtggacgtaaaaacttcctcgaacggagttttgaaagacccagactattaattagtgtggtgttttcgtgttacagtgttttaactggctatgcattgacgggatctatcgtcttcggtaaatacgtgttgagcgcatttggagtcacggatgattcgtggtccaagtacgtcagcatatcatttataatatttgccgttctcattcacggtgtctctgtaaggcacggagtgtttatacagaacgcacttggtggtttgaagttgatcatgattgtcttgatgtgctttgccgggctatacacgcttttcttttataaaagcaccggtcaagttgcctgggacctcccagtaacccaagttgagaaagattctctcctgtcggtgtcctctattgctactgcctttatcagctcattcttttgtttttctggatgggatacagttcacacagttacatcagaaattaagaatcccgttaagacgttgaaggtgtcaggtcccttatcgttgataatttgttttgtctgctacacaatgatgaatgtggcatacttgaaagttttgacatatgaggaaattgttagtgcaggccccctggttggttccgtgttgtttaccaaacttttcggacccagagttggtggcaaattcattgctttttctatcgccatttctgcagcatctaatattctggttgtcatttacagtatatcaagagttaaccaggaaatattcaaagaaggttatttaccattcagtattcatatgtccaaaaattggccatttgatgcacctctaccatctatttctttatgtggctttataaccattgcttggatattgattttacccaaagagggcgaatccttcaattacctggtatcgatggatggttatggtaatcagtttttcttattattggtcgctattgggctctttatttggaggttcaaacacaagaacgaagtcccagagattcgtgcatctacttttggagtattagccattattacattatcattatacatgttgatggcaccattctttgccgaccctagcctaaacagagttgggttcctgccgccctaccaaatcatgtcattactggtaatagttgcatgcttctttttctggttagttaaattcgttttactacctaaattcttccattataaacttttacccaaaatcacttatttgcatgatgggctcattgtcacagaatgggtgaaaaagccatgtctatgttagatttaaatacccagcaaattggagctctgcagagctttcgttcgtatcat

SEQ ID NO: 79 - DNA, 3242 bp, Arabidopsis thaliana
cccttaattaagaagccatggtaaaatctggtgctcgagccagtgattcattcatcaaacaacgttctgggtcgggttcgattctgaggatcaaagttgagaatttcatgtgccatagtaatctccagattgagtttggcgagtgggttaatttcatcaccggccaaaacggaagtggtaagagtgcaatactgactgcactatgtgttgcatttggatgtcgagcgagagggactcagcgtgctgccactctaaaggatttcattaaaactggatgcagctatgccgttgtccaagtagaaatgaaaaacagtggagaggatgcttttaagcctgaaatttatggtggcgttataattatcgaacgcaggataactgagtctgctacagctactgttctcaaagattatctaggaaaaaaagtaagtaacaaaagggacgagctacgggaacttgttgaacattttaatattgatgttgaaaatccgtgtgtggtaatgagtcaagacaaaagcagggagttcttacattctggaaatgacaaagataaattcaagttcttttttaaggcaacccttcttcagcaagtcaatgatcttctccaaagtatctacgaacacttgacaaaagcaactgctatagtcgatgaattggagaacacaattaaaccaatagaaaaggagatcagtgagttgcgtggaaagataaagaatatggaacaagttgaagaaatagctcaaaggttgcagcagttgaagaagaaactggcttggtcatgggtatatgatgtggataggcagctccaggaacagactgagaagattgtgaagcttaaagaacgtataccgacttgccaagctaaaatagattgggaactgggaaaagtggaatcattaagggatacgttgaccaagaagaaagctcaagttgcgtgtctgatggatgaatcaactgcaatgaagagagagatagagagttttcaccaatcagccaagacggctgtacgagaaaaaattgctctacaagaagaattcaatcataagtgcaattatgttcaaaagattaaggatcgtgttagaaggcttgaacggcaagttggagatatcaatgaacagacaatgaagaacacacaggctgaacaatctgaaatcgaggagaaactaaaatatttggagcaggaggttgagaaagttgaaacattgcgttccagattgaaagaggaagagaactgcttcttggaaaaagcgtttgaagggaggaaaaagatggaacacatcgaggatatgattaaaaaccatcaaaagaggcaaagattcataacctcgaacattaatgatctgaagaaacatcaaacaaataaggttactgcatttggaggggacagagtcattaatcttctgcaggctattgagagaaatcatcgtagatttagaaaaccaccaattggtcctattggctcccatgtgactttagtcaatggcaataaatgggcttcttcagttgaacaagctcttggaaccctattaaatgccttcattgtgactgatcacaaagattctctcactctaagaggctgtgcgaatgaagctaactatagaaatcttaagattatcatctatgacttttcgagaccaaggttaaatataccaaggcacatggtgcctcagacagaacacccaactatattctctgtcatagactctgataacccaaccgtccttaatgtcttggtggatcagagtggtgttgagaggcaagtgcttgcagaaaattatgaggagggaaaggcggttgcatttgggaaaaggctctcaaatctgaaggaggtttacactttagacggatacaaaatgttttttcgtgggccagttcagactactcttcctcctctttctcgtagaccttcgcgactctgtgcttcttttgatgaccagatcaaggatcttgaaatagaggcttcaaaagaacaaaacgagataaatcaatgcatgagacgtaagagggaggcagaggagaatcttgaggaacttgagttgaaagtgcgccaactgaagaagcaccgcagccaagcagagaaggttttgacgacaaaggaacttgagatgcacgatttgaagaatacagtcgctgctgagatcgaagcattaccttcttcaagtgttaatgagcttcaacgtgaaatcatgaaagacctagaagagatagatgagaaagaagctttccttgagaagctccaaaactgcttgaaagaagctgagctaaaggctaataaacttacagctttatttgagaacatgcgtgagtcagccaagggtgaaattgatgcctttgaggaagcagagaatgagctaaagaagattgagaaagaccttcagtctgccgaagcggagaaaatccattacgagaacataatgaaaaacaaggtcctacctgatattaagaatgctgaggctaactacgaggagcttaaaaataagcgaaaggaaagtgaccagaaggcctctgaaatttgtcctgagagtgagatagaatctttgggtccctgggatgggagtactcctgagcaactcagtgctcagattaccagaatgaatcagagacttcatcgagagaatcagcagttttctgaatcaattgatgaccttaggatgatgtatgagagcctagaacgaaagattgcaaagaagcgcaaatcctatcaagaccatcgagaaaaactcatggcctgcaaaaatgctctagattcacggtgggccaaatttcaaagaaatgcatctcttcttcggcgccagttaacatggcaattcaacgctcacttgggaaagaaaggtatcagcggacacatcaaagtcagttatgaaaataaaactttgtccatagaggttaaaatgcctcaagacgcaacaagcaatgtcgttcgagacaccaaaggtctttcaggcggagaacgttctttctcaactttatgttttgcactagctcttcacgagatgacagaagccccgtttcgagcaatggatgagtttgatgtgtttatggatgcagtcagtcggaaaattagcttggacgcactggtggattttgcaattggagaaggatcgcagtggatgttcatcacccctcatgatatcagcatggtgaagtcgcacgagaggataaagaaacagcaaatggctgctcctcgttcttgaaaacaaaaaaaaactctccttgtatagctccataaaggtacacatttaaat

SEQ ID NO: 80 - DNA, 803 bp, Arabidopsis thaliana
gtttgttgattaacccttaattaagtacgagtttcatggagaacatgtcgaatctaactagcaaatttttattaaacccgttgaatgttcataagcattgtgcagtttcagatgaaaatggtgatagaaaatctcatgttctgaaacaggtgtgttcatgtatctgctgttgcaacagaaggaacaagactcaagctaggagccagaaagggtcctactttataaaagggaaggtccatccggtaagtagaatggagaagtgggaggagaagatcacagaagctaatagtcatggcaaaattgtaagctcttcctcctatgatttgcctttctatgttgttttgcattcttcctctgtagatagctcgacatgatctgattctttgtaacatggaacagcttgtagtgaatttcaaggcttcgtggtgtttacctagtaaaacaatattaccaatataccaggagcttgcatccacatacacctcaatgatatttgtcactatagacgtcgaagagctcgctgtaagtaaccaatcaacttctgttacttagaatgattctttgtgaagatgagagatctcgaaactgagcgatttgggtgttaaaatatgtttgatacaggagtttagtcatgaatggaacgtggatgcaactccaacagtagtgttccttaaagatgggaggcaaatggataaacttgtaggtggagatgctgcagagcttcagaagaaaactgcagcagctgcaaatctccttcttagacaatcttaacgttttatttaaatacccagcaaatacccagc

SEQ ID NO: 81 - DNA, 503 bp, Arabidopsis thaliana
gttgattaacccttaattaagatggattccggaaccaaagtgaagaaaggagccgctggaagaagaagtggtggaggtcctaagaagaaaccggtttcccgttcggttaaatccggtctacagtttcctgtcggtaggatcggtcggtatcttaagaaaggtcgttattcgaagcgtgtcggaaccggagctccggtctatctcgccgccgtcctcgagtatcttgctgctgaggttctcgagcttgctggtaacgctgcaagagataacaaaaagaaccgtattataccacgccatgttctattagcggtgaggaacgacgaggagctagggacactactcaaaggcgtaaccattgcacacggcggtgttttaccaaacataaacccaatactcctcccaaagaagtctgagaaagcagcttcaactacaaaaacacccaaatcaccatcaaaggcaaccaaatcccctaagaaatcttagatttaaatacccacaaatac

SEQ ID NO: 82 - DNA, 1108 bp, Saccharomyces cerevisiae
aaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcaaagttagttttagttagacacggtcaatccgaatggaacgaaaagaacttattcaccggttgggttgatgttaaattgtctgccaagggtcaacaagaagccgctagagccggtgaattgttgaaggaaaagaaggtctacccagacgtcttgtacacttccaagttgtccagagctatccaaactgctaacattgctttggaaaaggctgacagattatggattccagtcaacagatcctggagattgaacgaaagacattacggtgacttacaaggtaaggacaaggctgaaactttgaagaagttcggtgaagaaaaattcaacacctacagaagatccttcgatgttccacctcccccaatcgacgcttcttctccattctctcaaaagggtgatgaaagatacaagtacgttgacccaaatgtcttgccagaaactgaatctttggctttggtcattgacagattgttgccatactggcaagatgtcattgccaaggacttgttgagtggtaagaccgtcatgatcgccgctcacggtaactccttgagaggtttggttaagcacttggaaggtatctctgatgctgacattgctaagttgaacatcccaactggtattccattggtcttcgaattggacgaaaacttgaagccatctaagccatcttactacttggacccagaagctgccgctgctggtgccgctgctgttgccaaccaaggtaagaaataaatttaaatacccagcaaattggagctctgcagagctttcgttcgtatcatcggtttc

SEQ ID NO: 83 - DNA, 1394 bp, Bacillus halodurans
aactctttgtttcttgtttgttgattaacccttaattaatccgggcgcgcctgatttatcacaagtttgtacaaaaaagcaggctcctgcaggaccatgaagttagctaagcgagtttctaccttgacaccgtcatcaacattggcgattacagcaaaggcaaaagagttaaaggagcaagggcacgatgtgatcggattaggagcaggggagccggattttaatactcctcaatacattattgatgctgcggtacgatccatggaagaagggcatacgaaatacaccccatctggaggcttaccaaagttaaaggaagctattattgaaaagtttaagcaagatcaagggcttacatatacagcgaaggaaattttcgtcggtacaggggcgaagcacgttctctatacactgttccaagcgttgttaaatgaaggtgatgaagtgattatcccatctccttactgggtgagctatccagagcaagtgaagcttgctggaggggaacctgtgttcgtggaagggaaagaatcgaacgactttaagttaacaccagctcagcttgagcctgttcttacagaccgaacgaaggcgattattattaattcaccgagtaatccaacaggctctttatatacgcaagaggagttagcagcgttaggggaagtgtgccttaagcataatgtccttatcatctcagatgaaatttatgaaaagcttgtatatgatggagcaaaacatacatcggttgcggaaatttccccacaattaaaggaaaacacagtcgtaattaacggtgtttccaaatctcactcgatgacaggctggcggatcgggtacgcggcaggaccggaggcgctcattcaagcgatgaccaatctcgcgagccacagtacatccaatccaacgaccagcgctcaatatggtgcgattgccgcttacactgaggatgatggatctgtcgagaagatgcgagtggcgttcgaggagcgacttcacacgatttacgataagcttgtggcgattcctggtgtatcgtgcgtaaaacctaagggagcattttatttattcccgaatgtagaggaagctgcagcattaacaggtcacgaaacggttgacgactttgtgaaagtcttgttagaggaagaaaaagtcgccctcgtacctggctcagggttcggtgcacctgacaatgttcgtttatcctatgcaacgtcactggagctattagaagcagcgatcgaccgaattttccgcttcgtcgaagcgaaacgcagcaaataacgaagaacgaccatgctcatggggtgtggtcgttttctcgagacccagctttcttgtacaaagtggtgataaattggagctctgcagagctttcgttcgtatcatcggtt

SEQ ID NO: 84 - DNA, 1736 bp, Bacillus halodurans
tcatttatttgtcagctttcaaactctttgtttcttgtttgttgattaacccttaattaatccgggcgcgcctgatttatcacaagtttgtacaaaaaagcaggctcctgcaggatcatgagcaagaaacccgttgcattgatcattttagatggctttgcgatgcgcgacgaggcgaaaggaaacgcggtggctcaagcgaataagccgaactttgatcgctattggaatcagtatccacacgcattattaaaggccgatggggaagcggttggcttaccggaagggcaaatggggaactccgaagtcggtcacttaaacatcggtgccggccggattgtttaccaaagcttaactcgtgtcaacctttccatccgcgaaggcgaatttttcgaaaatgaaacgtttttaaatgcgatgaaccacgtgaaggaaaaagggtctagtcttcacatttatggccttgtgtcagatggaggcattcatagtcacattaaccatctatatgcactgcttgaacttgcgaaaagagagcaggtggaacgggtgtacatccatggtttcttagatggtcgtgatgttggtccaacctcagcagaatcgtatctcgttgacctagaagcgaaaatgaaggagctcggtgtcggtgagcttgcgactctacatggccgttattatgcgatggatcgcgacaagcgctgggatcgtgtggaaaaatcgtatcgggcgatggtatatggcgaaggaccagcttattcatcagctcttgacgtcattaaggacagctatgaaaactcgattcacgatgagtttgttatcccttctgtcattacgaacgaagatggctctccagtagcgacgattgaagatgatgatgcaattattttcttcaacttccgtccagaccgggccatccaaatgtcacaagtgtttacgaataaagatttccgtggatttgatcgtggtgaaaaacttccgcaaaatgtatactatgtatgtctgactcatttcagcgagacggttcaaggagacgtggcatttaagccgaccaacttggataatacccttggtgaagtgttggcccagcaaaattacaaacaactgcggattgcggaaacggaaaaatatccgcacgtcaccttcttctttagcggtggacgagaggagccgttcccaggagaagagcgaattttaatcgattctccaaaagtggcaacctatgacttaaaaccggaaatgagtgcctatgaagtgacggacgctttgttaaacgaaattgaggcggacaagcacgatgtaatcattttaaactttgcgaatcctgatatggttgggcattctggtatgcttgagccgacaattaaagcggtagaagcagtcgatgagtgcttagggaaggtcgtggacgcgattctagctaaaggtggtgcagctgtcattaccgctgatcacggaaacgcagacgaggtcgtcacattggaagggaagccaatgacggcgcacacgacaaacaaagtgccggtcatcgtaacagaggaaggattgaacttgcgagaagatgggattttagccgatctttctccaacggttctcgacctccttggcggaaaacaaccagccgaaatgacaggaaaaacattaattaagtaactcgagacccactttcttgtacaaagtggtgataaattggagctctgcagagctttcgttcgtatcatcggtttcgacaacgttcg

SEQ ID NO: 85 - DNA, 1557 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatgacaaagtacactagagaagatatcgaaaaattagtaaaagaagaaaacgtgaagtatatccgccttcaatttactgacattcttggaacaatcaagaatgttgagattcctgtaagccagcttggaaaagcgcttgataataaagtcatgtttgacggttcttctattgagggattcgttcgtatcgaagagtcagacatgtacctgtatccagatctaaatacatttgttatcttcccatggacagctgaaaaaggtaaagtagcacgtttcatctgtgatatttacaatccggatggcacaccttttgaaggtgacccgcgaaacaacttaaaacggattctgaaagaaatggaagacctcggcttcagtgattttaaccttgggcctgagcctgaattcttcttattcaaattggacgaaaaaggcgagccgacgcttgaactaaacgacaaaggcggatatttcgacttagctccaactgatttaggagaaaactgccgccgcgatatcgtacttgagcttgaagagatgggctttgaaatcgaagcgtctcaccacgaagtagcacctggtcagcacgaaatcgactttaaatatgctggagcagtccgctcttgtgatgacatccaaacatttaaactagttgtcaaaacaattgcccgtaaacacggcctgcatgcgacatttatgccaaaaccattgttcggtgtaaacggttcaggtatgcactgcaatctatcactcttcaaaaatggtgttaacgcattctttgacgaaaacgcagatcttcagttaagtgaaacagcgaagcacttcattgcaggtatcgtgaagcacgcaacaagctttacagcagtaacaaacccgacagtaaactcttacaaacgtcttgttcctggctatgaagcaccttgttatgtagcatggagcgcgcaaaacagaagcccgcttatccgtatcccggcttctcgcggcatcagcacacgtgttgaagtacgcagtgtagacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttccagcaacacttgcggaagcactagaagaattcaaatcaaacgaagtcatggtcaaagcgctgggcgagcacctattcgaacacttcatcgaagcaaaagaaatcgaatgggatatgttccgcacgcaagtacatccttgggaacgcgaacagtatatgtctcagtattaatatctcaatcccttggcactaaaagtgtcaggggatttttctcgagacccagctttcttgtacaaagtggtgataaattggagctctgcagagctttcgttcgtatcatcggtttcgacaacgttc

SEQ ID NO: 86 - DNA, 1450 bp, Escherichia coli K12
aactctttgtttcttgtttgttgattaacccttaattaatccgggcgcgcctgatttatcacaagtttgtacaaaaaagcaggctcctgcaggaccatgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcaatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgaccatgagcgccatccgcctggcccgtggttttaccggtcgcgacaaaattattaaatttgaagggtgttaccatggtcacgctgactgcctgctggtgaaagccggttctggcgcactcacgttaggccagccaaactcgccgggcgttccggcagatttcgccaaatataccttaacctgtacttataatgatctggcttctgtacgcgccgcatttgagcaatacccgcaagagattgcctgtattatcgtcgagccggtggcaggcaatatgaactgtgttccgccgctgccagagttcctgccaggtctgcgcgcgctgtgcgacgaatttggcgcgttgctgatcatcgatgaagtgatgaccggtttccgcgtagcgctagctggcgcacaggattattacggcgtagtgccagatttaacctgcctcggcaaaatcatcggcggtggaatgccggtaggcgcattcggtggtcgtcgtgatgtaatggatgcgctggccccgacgggtccggtctatcaggcgggtacgctttccggtaacccgattgcgatggcagcgggtttcgcctgtctgaatgaagtcgcgcagccgggcgttcacgaaacgctggatgagctgacaacacgtctggcagaaggtctgctggaagcggcagaagaagccggaattccgctggtcgttaaccacgttggcggcatgttcggtattttctttaccgacgccgagtccgtgacgtgctatcaggatgtgatggcctgtgacgtggaacgctttaagcgtttcttccatatgatgctggacgaaggtgtttacctggcaccgtcagcgtttgaagcgggctttatgtccgtggcgcacagcatggaagatatcaataacaccatcgatgctgcacgtcgggtgtttgcgaagttgtgactcgagacccagctttcttgtacaaagtggtgataaattggagctctgcagagctttcgttcgtatcatcggt

SEQ ID NO: 87 - DNA, 1627 bp, Escherichia coli K12
aactctttgtttcttgtttgttgattaacccttaattaatccgggcgcgcctgatttatcacaagtttgtacaaaaaagcaggctcctgcaggaccatggaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaatattgcttttgtgaattaatttgtatatcgaagcgcctcgagacccagctttcttgtacaaagtggtgataaattggagctctgcagagctttcgttcgtatcatcggtttcgacaac

SEQ ID NO: 88 - DNA, 1251 bp, Sinorhizobium meliloti
ttatttgtcagctttcaaactctttgtttcttgtttgttgattaacccttaattaatccgggcgcgcctgatttatcacaagtttgtacaaaaaagcaggctcctgcaggatcatgagcgaaagactggaagacattgcggttgccatggtcgccaatggccggggcctgctcgctgcagacgagtcgaccgcaacgatcaagaagcgcttcgacagcatcggcctggagtccaccgagacgtcgcgccgcgactatcgcgagatgctgctgcgctcggacgatgcgatgcgcgagtatatctccggcgtcatcctctatgaggaaacactgttccagaaggctgccgacggcacgcccctcgccgacgtcatccgcaacgcgggctcgatcccggggatcaaggtcgacaccggtgccaagccgatggcccatttcccgaatgaaacgataaccgaaggcctcgacgggctcgccgcccgcctcgccagatatcacgaggccggcgcccgcttcgccaaatggcggggcgtgatcgcgatttccgacgctctcccgacctggggcgcgatcagggccaatgcccatgcgctcgcccgttatgccgcgctctgccaggaggcgaagatcgtaccgatcgtggagccggaagtgctgatggatggcgcccccggcgatcactcgatcgagcgctcggaagaagtcaccgaatgggtcctgcgcacagtcttcgaggaacttggcgagctccgcgtcaggctcgaaggcatgatcctgaagccgagcatggtgatcgacggcaaaaaagcgcgcaaagcgtccgtcgacgaggtcgccgaacgcaccatcaaggtgctgaagcgcaccgttccggcggctgttccgggcatcgccttcctctccggcggccaatcgaccgaagaggcgacggcccacctttcggccatgaacgcagcgcacgacctgccctggaagcttaccttctcctatggccgggcactgcagcaggaagcgctcaatgcctggggcggaaagtcggaaaacgtcgccgccggtcagcgcgccttcgcccatcgcgccaagatgtgcagcctcgccgccaagggaagctggacgaaggacttcgaaaaggcagcctaagcgccaaaatagtcagagggagagaggagaggcccggtctcgagacccagctttcttgtacaaagtggtgataaattggagctctgcagagctttcgttcgtatcatcggtt

SEQ ID NO: 89 - DNA, 937 bp, Xenorhabdus nematophila
aactctttgtttcttgtttgttgattaacccttaattaatccgggcgcgcctgatttatcacaagtttgtacaaaaaagcaggctcctgcaggaccatgggacatccattagttatgggaaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctgggtgcacaagatgttgacgttaacctttctggtgcattcaccggcgaaacatccgctgaaatgctgaaagatgtgggcgcgaaatatatcattatcggtcattctgagcgccggacttaccataaagaaagcgatgagctgattgcgaaaaaattcaccatcctgaaagaacaaggactgattcccgttctgtgcattggtgaaaccgaacaggaaaatgaagcaggccaaaccgaagccgtatgcgcacgccaaatcgatgctgttctgaatacactgggtgccgaagccttcaaagataccgttatcgcatacgagcccgtctgggcaattggtacgggtaaatcagcgactcctgcacaagcacaggctgttcataaatttatccgtgatcatatcgcgaagcaagatgcagctatcgctggacaggtcatcattcaatacggcggttccgtcaatgccggcaacgcggcagaactgttcacccagccagatatcgatggtgctctggttggtggtgcatccctgaaagccgatgctttcgccgttattgtgaaagccgctgccgaagcgaaaaaggcataactcgagacccagctttcttgtacaaagtggtgataaattggagctctgcagagctttcgttcgtatcatcggt

SEQ ID NO: 90 - DNA, 631 bp, Synechocystis sp. PCC 6803
ttgtcagctttcaaactctttgtttcttgtttgttgattaacccttaattaatccgggcgcgcctgatttatcacaagtttgtacaaaaaagcaggctcctgcaggaccatggaacgcacatttatcatgatcaagcccgatggggtacaacggcaattaattggggaaattgttggccgtttcgagaaaaaaggcttcaaattagtcgccatgaaggtgatgactgtctcccaagaattagccgaaaaacattacgaagctctcaacgacaaaccgttcttttccggcttggtgaacttcatttgttcctctcccgtggtggccatggtctgggaaggtaattccatcgtttctacttcccgccaaatgattggtgcaactgatccccatgctgccgcccctggtactatccggggagattacggtgtgtccgttggtcgcaacattatccatggttccgatgccattgaaaccgctaaacgggaaatttccctctggtttaaggatgaggaagtgaatgaatgggatgccacccttaacccttggttgtacgagtagctcgagacccagctttcttgtacaaagtggtgataaattggagctctgcagagctttcgttcgtatcatcgg

SEQ ID NO: 91 - DNA, 671 bp, Pseudomonas fluorescens PfO-1
ttcaaatattattcatttatttgtcagctttcaaactctttgtttcttgtttgttgattaacccttaattaatccgggcgcgcctgatttatcacaagtttgtacaaaaaagcaggctcctgcaggaccatggctgttcaacgtactttctccatcatcaagcctgacgccgttgctaaaaacgtgatcggcaagatcaccactcgcttcgaagacgctggcctgcgcgttgtagcttcgaaactgaagcaactgtcgaaagccgaagccgaaggcttctacgctgagcacagcgctcgtggtttcttcggcgaattggttgccttcatgacttcgggtcctgttgtcgttcaggttctggaaggcgaaaacgccatcgctcgcaaccgtgagctgatgggcgctaccaaccctaaagaagctgctccaggcaccatccgtgctgacttcgctgaatcgatcgacgccaacgccgttcacggttcggactccgaagccgctgctgctcgcgaaatcgcttacttcttcgcagctactgaagtaaccactcgctaagcattggcttaagagtgaaggtgaatccatgacgacatcgactgttaactcgagacccagctttcttgtacaaagtggtgataaattggagctctgcagagctttcgttcgtatca

SEQ ID NO: 92 - DNA, 829 bp, Xenorhabdus nematophila
caaactctttgtttcttgtttgttgattaacccttaattaatccgggcgcgcctgatttatcacaagtttgtacaaaaaagcaggctcctgcaggaccatgacacaggatgaactgaaaaaagcggtaggctgggcagcgctggaatatgttaaaccgggaacagttgtgggagttggcaccggttcaacggcatctcattttattgatgcgctggggacaatgaaagatcaaatcgaaggtgcggtatccagctcagaagcatcaactgagaaattgaaaagtcttggcatccctgtgtttgactgtaatgaagttgactctttagacatttatgttgacggagctgacgaaattaatgctcaaatgcagatgattaaaggtggtggtgcggcactgaccagagagaagatcattgctgcggtagcaaagaaattcatttgtattattgatgaatccaaacaggttgacgtgttgggtaaattcccgttacctgtggaagttatcccgatggctcgatcttacgttgcccgtgagctgctaaaactcggaggaactccggtttatcgtcagaatgttatcactgataatggtaacgttattttagatgttcataatcttgccattctgaatcctatcgagttagaaaataaaattaatgcgattgcaggagtagtaacggtaggcctgtttgctaatcgtggcgcgaatgtcgtgctggttggcagttctaacggagtgaaaacgattacagagtaactcgagacccagctttcttgtacaaagtggtgataaattggagctctgcagagctttcgttcgtatcatcg

SEQ ID NO: 93 - DNA, 2671 bp, Arabidopsis thaliana
catttatttgtcagctttcaaactctttgtttcttgtttgttgattaacccttaattaagacctcccagcgtctgacctatattaatctcactcccattgagccacttccaatggaaacatcatcaatcgaaatcaacgagcttccattagccaccaaaacccaaacacctcctgcttccgtcgagccaattccaatggagacatcatcaatcgacgagcttccatcgtccgattcgaatgcaacggataacattgaagctgttggtgagaaacggaaacgcgccgatgaagacgagaaaaccaatctcgaatcgtcagacacgaagattactactccttcaccgtggtggaagacgagtctctgttcttactttaggcgtgaggcttcgtgtagtcatggaaacgaatgtaaatacgctcacggtgaagcggagctccggatgaaaccggataatacttgggatccgacttctgagcgtggaaagaaagccaaggctatgaagatgtctgagcatgaagagaaagaagaagacgaggttttgtttactgagcagatgatggaatcaattgatggtgatgaaggaggtggtggtagtgttagtgttgttgatttgtcactaagtaaatgtttggtgcatttacctaataaatggcaatctgatgaattgaagaaatttttaggagaacagggagttctatataagtctgcaaagaaaagaagaggaatgattgttggttttgttacatttgagaatgcagaacaattgcagagtggcgtggagattttggatggaaaaactgttaatagcagtaatttgaagattgctgatgttcttccgcgtacatttgacaagaatgatgcaagaaaatcggttaaaagtgctcgtgacgctgtgactcccttggcttacttgtcttatgctgaccagcttgaacaaaaaaagacttctataggccaaatgctgaaaaaacttgcgaggaatgcgcgtaaagcttgtccaaatgggaattcacttccacaatgggtccttacatcgagagacagaggtggtcttgcatgcaacctcgagggcattatagaatcaccgattacaaatggctacaggaacaagtgtgagttctcggttggattatctcttcaggggaagccaactgttggattcagtctaggaagtttttgtgcgggtgtgacagcagtcgaggagcctgtggattgccccaacgtctccaaaattgcttctcaatatgcttcaatatttcagaagtttatagaaaattcaaaattccaagtttggaataggtttcaacatagtgggttctggcggcaattgacggttcgagaggggagaaaacccggcgtgttttcaaatgatgaagatgctattacaagaatcgcggaggttatgcttatggttcaggtttgtttaactggttctgatgaggcagaagtggccactgagtttgaagaattggcgaaagcgtttgctgaaggagctagagcaagctctcctactcttcctctgactgtattagttgttcagaatcactcaggaatatcaaatgttgcaccacctgatgctccactgcaagtgctggctattccaatttcagataatgggacagatcaggagcaaaccaccaatgtcttgactgaagctcggattcatgatcacattaacaaccttcggttcagcatatccccaacagcattttttcaggttaataccgtcaccgcagagaagttatactcaattgctggagactgggctgaccttggtcccgacactttgctcttcgatgtatgctgtggaactggaacaattgggcttacactggcacatcgtgttggcatggtaattggcatagaaatgaatgcttcggctgtagcagatgccgaacggaatgcaacgatcaatggcataagcaactgcaagttcatctgctcaaaggcagaggatgttatgagctctctacttaaacagtacctagatgtgactcaaatggaagaagctaagcctctaagtaatgctaacgatgatctcaacaaacaaattccctcaacagaagaaatgacaaactcagagcatgtagctgatcaaaacctacctccttcaaacactcaagtggaagaacttcaagacaatgagcagaaggattcctcgtccttagaaccggaaaaaactacaaaaccacagttcaaaaatgtggttgctatagtcgatccacctcgctctggacttcatccagctgtaatcaaagctctaagaacccatccccggttaaagagacttgtgtacatttcgtgcaaccctgaaacgctagtggcaaacgcgatagagctttgcacgccatcttttgatgaaccggatagaggaaacaaaaattacagagggcgcaagaaaataggcattgccgctttggctcgacatagagccaagtcaatgccaacttctgaggcttttagacctgtcaaagcaatggccgttgaccttttcccccacactgaccactgcgaaatggtaatgctccttgagaggtaagaatacgaaataaactctttaagagaatgatgtagcaccaaaagaacaaatttaaatacccagaaatacccagcaaattggagctctgcagagctttcgttcgtatcatcggtttcgacaacgttcgtca

SEQ ID NO: 94 - DNA, 1867 bp, Saccharomyces cerevisiae
ttcatttatttgtcagctttcaaactctttgtttcttgtttgttgattaacccttaattaagatggcgaaccgtcttctcatatacggccttattttgtgggtaagtataatcggatcttttgcattagataggaacaaaactgctcaaaatgcgaagattggtctacatgataccactgtgatcacgactggaagtacaacgaacgtgcagaaagaacattcctcaccactatccaccggttctttaagaacccatgattttagacaggcctctaaagttgacatacggcaggctgacatacgggaaaacggtgagaggaaagagcaagatgcactaacacagcctgcaacaccaaggaatccgggcgattcgagtaattcatttttatcgttcgacgaatggaagaaggtcaagtcgaaggagcactcatcaggccctgaacgtcatcttagtcgagtgagggagccagtcgatccctcttgctataaagagaaagaatgcataggagaagagttggaaatcgatttggggtttttgacaaacaaaaacgagtggagtgaaagagaagaaaatcaaaaaggattcaatgaggaaaaggacatagagaaagtttacaaaaaaaaattcaactatgcatccttggattgcgctgcaacaattgtcaaaagcaatccagaagcgattggagcgacttctacgttaattgagagcaaagacaagtatttactgaatccctgttcagctccgcagcaattcattgttatagagctttgtgaagatatcctggtggaggaaattgaaattgctaattacgaattcttttcctcgaccttcaagagatttagggtgtcagtttctgatagaataccgatggttaaaaatgaatggacaatattaggagaattcgaggcaagaaattcaagagaactacaaaagtttcaaatacataatccccaaatctgggcaagttatttgaaaatcgaaattctatcccattatgaggacgaattttattgtcccatatccttaatcaaagtatatggtaaatcaatgatggatgagtttaagatcgatcaactaaaggctcaagaggataaagaacaatccataggaactaacaatataaacaatttgaatgaacaaaatatccaagacagatgtaacaatatagaaacgcgtttagagactccaaacacaagcaatctctcagacttagctggtgcattatcatgtacttcaaagctcatccctttgaagttcgatgaatttttcaaggtgcttaatgcatccttttgtccttccaagcaaatgatatcttcttcttcttcttcggctgttcctgtaattccagaagaatccatttttaagaacatcatgaaaaggctgtcacaactggagacaaattctagtttgacagtttcttacattgaggaacagagcaaactgctatctaaatcgtttgaacaacttgaaatggcgcacgaagcaaagttcagtcatcttgtcacgatattcaacgaaacaatgatgagtaatctagatctgctgaataactttgccaatcaattgaaagatcaatctttacgtatattagaagaacagaaactggagaatgacaaatttactaaccgtcatttattgcatttggaaagattggaaaaagaagtcagttttcaaagaagaattgtttatgcgtcatttttcgccttcgtagggttgatatcctatctattaataacgagagagctttactttgaagatttcgaagagagcaaaaatggcgctattgaaaaggcagacattgttcaacaagcaatcagatgaatttaaatacccagaaattggagctctgcagagctttcgtt

SEQ ID NO: 95 - DNA, 1649 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgtccaatgctgctttgcaagtttatggcggcgacgaagtttccgcagtagtcattgatcctggctcatacacaacaaatattggctattcgggttctgacttccctcaatcaattctgccctctgtttacggtaaatacactgcagatgaaggcaataagaaaatattttctgaacaatcaattggaattccaagaaaagattatgaactgaaacctattatcgagaacggtctagtcatagactgggataccgcacaagaacagtggcaatgggcattgcagaacgaactctatttgaattccaactccggaataccagctctgttaactgagcccgtttggaatagcacagaaaacaggaaaaaatctttagaagtgctcttagaaggcatgcaatttgaagcctgttacttagcacccacatcgacatgcgtttcttttgcagcaggtagacccaattgtttggttgttgatattggacatgatacttgcagcgtcagtccaatagtggatggtatgacattatcaaagagtacaagaagaaattttattgctgggaaatttatcaatcacttgattaaaaaggcattggaacccaaagaaatcataccacttttcgcaatcaagcaaagaaaaccagagtttataaaaaaaacattcgactatgaggttgataaatcgctgtatgattacgccaataaccgagggttctttcaagagtgcaaagaaacactttgtcatatatgcccaacaaaaactttggaagaaacgaaaacagaattaagttctacggctaaaagatctattgaaagtccttggaatgaggagattgtttttgacaacgaaactcgttacggctttgctgaagagcttttccttccaaaagaagatgacatcccagcaaattggcctcgctcgaactctggagttgtgaaaacttggcggaatgattacgtgccgctaaaaagaaccaagccaagcggagtgaacaaatcagacaagaaagttacaccaactgaagaaaaggaacaggaagctgtaagcaaatctacttctccggctgcaaatagtgcagacactccaaatgaaaccggtaagagaccgttagaagaagaaaagcctcctaaagaaaataatgaattgattggtctagcggatcttgtttattcgtctataatgagcagtgatgtggatctaagagcgacactagctcataatgttgtccttacaggcggtacatcctctattcctggattaagtgataggttaatgacagaactaaacaaaatactaccatcccttaaatttagaatattaacaacagggcacactatcgaaaggcaataccagtcatggcttggcggtagtatacttacaagtctgggaacatttcaccaactgtgggttgggaaaaaggaatacgaagaggtgggcgtcgaaagattgcttaacgataggtttagatagctcgagacccagctttcttgtacaaagtggtgataaattggagctctgcagagctttcgtt

SEQ ID NO: 96 - DNA, 1564 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgattcaaacgcaaagtacagcgatcaaacgacgtaattctgttcataaaaacctctttgatccatcactgtatcaaataccagaaccaccacgtggggggttccaacaccaaaaaaaagaatacagtaaggagacattcagtaatcaagtctttggatatgatattactagccttaaaaaaagattcacgcaactatttcctagtaatatacaagggtacttacctgaagttgacctaagaataaccattatttgttctatatggtacgtcacgtcatctatttcaagtaacctatctaaagccattttaagaactttcaaccatcccatagctctcacagaattgcaatttcttgttagtgctgttctatgtgttggatttgcttccatcgtaaatttattccgactacctcgtttgaagcatacgaagttttcaaaggcactcaatagtttccctgacggtatccttcctgaatatctcgatggcaatttcaggagttctatcctgcacaagtttttagttccctcaaagctggttttgatgaccactttccctatgggaatattccaatttattggtcatatcacatcgcacaaggcggtatctatgataccagtatcactagtgcattccgtgaaggcattatccccaataataacagttggctactataaatttttcgaacatcgttattacaattccatgacttattataccttgttacttttaatttttggcgttatgactacttgctggtcaacacatggcagtaagagggcttcagataacaaaagcggatcttcattaatcgggttgctttttgcctttatttccatgataatatttgtagcacagaatatttttgcaaagaatattttaaccatcagaaggaaggtaggaatactgccgtcttcttctacggatgacgtcacgtcgaaggaagggcaaccgagtctagacaaaacaagattttctccattgcaagtggataagattaccatattgttctactgctcctgcattgggttttctttaaccctattaccttttttaaccggcgaattaatgcatggcggtagcgttatcaacgatttaacgctagaaacagtagcccttgtagcgattcatggaatagcccattttttccaagcaatgcttgctttccagttgatcggtttactatcttccattaattattcggtagcaaacatcatgaagaggattgttgttatatccgtggcactcttttgggaaacaaagttaaatttttttcaggtgtttggtgttatcttgacaattgccggattgtacggttatgacaaatgggggctttccaaaaaagatggacgtcaggcatagctcgagacccactttcttgtacaaagtggtgataaattggagctctgcagagctttcgttcgtatcatcggtttcgacaacgtt

SEQ ID NO: 97 - DNA, 2001 bp, Saccharomyces cerevisiae
ttcatttatttgtcagctttcaaactctttgtttcttgtttgttgattaacccttaattaagatggtaaatatactgcccttccacaagaacaatagacacagcgcgggagtcgtcacctgcgcggacgatgttagcggcgacggtagcggcggcgacaccaagaaggaggaggatgttgtccaggtaacggaatcaccatcgtccgggtcgcgcaataatcatcgcagcgacaatgaaaaagatgacgccatccgtatggagaaaatatctaagaaccagtccgcgtcgtccaacggcaccatccgcgaggatttgattatggacgtggacttggagaaatcgccctccgtcgatggcgatagcgagccgcacaaactaaaacaaggtttgcagtcgcgccatgtgcaactgatcgcgctgggcggcgccatcggtaccggtttgctggtggggacttcatccacgcttcatacgtgcggtcccgcggggctgttcatatcgtacattattatttccgcggtgatctacccgatcatgtgcgcgctgggcgaaatggtgtgctttttgcccggtgatggttctgacagtgccgggtcgacggccaatctggtcactaggtacgttgacccttcgttgggcttcgccactgggtggaattacttctactgctacgtcattttagtggccgccgagtgtacggcggcatccggtgtggtcgaatactggaccaccgcggttcccaagggcgtttggatcacgatctttctatgcgtggttgttatactaaacttttccgcggtcaaagtgtacggcgaatccgagttttggttcgcgtctatcaagatattatgcattgtgggactgatcattctgtcctttattttgttttggggtggtggccccaaccatgaccgtcttggcttcagatactggcaacatccgggcgcttttgcgcatcacctcacgggcggatcgctgggtaacttcacagatatctacactgggattatcaagggcgccttcgccttcattcttggtccggaactggtgtgcatgacttccgcggaatgcgcggaccagcgtagaaatatcgctaaggcttcgcgccgctttgtatggagactgatcttcttctacgttctggggacgctggccatctccgttattgttccatacaatgacccaacattggtaaatgcgctggcgcagggcaaaccgggagccggctcgtcaccctttgtgatcggaattcaaaacgccgggattaaggttcttccccacattatcaatgggtgtatcttgaccagcgcgtggtctgccgccaatgcgtttatgtttgcgagcacgagatcactgttgaccatggcgcaaacgggacaggcacccaaatgtttgggcagaatcaacaaatggggtgttccatacgtggctgtgggtgtttccttcttgtgttcttgtttggcatatctgaacgtgtcttcatccacggcagacgtgtttaattggttttccaatatcagcaccatttccgggtttctgggctggatgtgcggctgcatcgcgtacctgagattccgcaaggctattttctacaatggcctctacgacagattgcctttcaagacgtggggacagccttacaccgtgtggttctctctcattgttataggcatcatcaccattaccaacgggtatgccattttcatccctaagtactggagagtagcagatttcattgctgcctacatcaccctacccatcttcctggttttgtggttcggccataagctgtatactcggacgtggagacaatggtggctccctgtgtccgagatcgatgttactacagggttagtcgagatcgaggagaaatcaagagaaattgaggagatgagattaccccccaccggtttcaaagacaagttcttggacgccttgttgtaaatttaaatacccagcaaattggagctctgcagagctttcgttcgtatcatcggtt

SEQ ID NO: 98 - DNA, 1913 bp, Saccharomyces cerevisiae
ttcatttatttgtcagctttcaaactctttgtttcttgtttgttgattaacccttaattaagatgcctgagcaagaaccattgagtcccaatggccgtaagcgctctgaggttcactatatctcaatcccattgaacagaggttccgcattctcaccagatgattctgtatcacagtttcagtctgacgggttcatgacacgtaggcaatccatattggaccatcctgtgggctcatttaagggagttaattctttaagtcgatttgcgacttcgttgaggagagccaattcgtttcgtaatatcgagctaaatgcggataatgaaagatcctttttcaaagagagtaacgatgaaacctacgatccggatactttagcaccagctttggacggtagaagattatcagtaactttaaataatgctggtcgcccgcgcattactaatttggctaacaacgatagagttagtacagccagcatggctattcacgatgatgattatgggtccatccaaaattcaacaattggggattctgggtcaatattacgccctactgcctccttaacagaaatgatgagtggtggagcggggagaaggtttacaaataatgacatggattcaattgtagtgaagagagtggagggtgtagatggtaaggtagtaactcttcttgctggtcagtcgaccgctccacagaccatattcaactcaatcaatgtactgattggtattgggctcctggcgttacctcttggtttgaaatacgccggctgggttataggacttactatgcttgcaatcttcgccttagcgacattttgtactgctgaacttttgtctaggtgcctagatacagatccaactttgatatcttacgcggacttgggatatgcagcatttggtacaaaagggcgcgcactaatttctgctcttttcacacttgacctactgggtagtggggtgtccttggtgattctcttcggagattctttaaatgctctatttcctcaatactccaccacttttttcaaaatagtttcattttttatcgttacacccccggtttttataccattgagtgttctatctaatatctcgcttctgggaatcctttcaacaaccggaactgtgctagtcatttgctgctgcggactatacaagtcgtcttctccaggttcattagttaatccgatggaaacgagcatgtggccgatagatctaaagcatctctgtttatctataggtttattgagtgcctgctggggaggacatgcggtttttcccaacttaaagacagatatgaggcatccagataaatttaaagactgtttgaaaactacctataagataacatcggttacggacataggtactgcagttattggctttttgatgtttggaaatcttgttaaagatgaaattactaagaacgttttgctgacggagggatatccaaaattcgtttatggtctgatttcagcgcttatgactatcattcctatcgcaaagaccccattgaacgcaagacctatcgtttctgtattggacgttctgatgaatgtgcaacacatagatgaagcggccagcgccataaaaagaagagctgcgaaaggccttcaagtattcaataggatctttattaatgttgtcttcgttttgatagctattaatttccctgaatttgataagattatcgcatttctgggggccggtttgtgttttacaatttgcctaattttgccgtgttggttctatttaagattgtgcaagacaacaatcaaaccatgggagagagtggcttgtcacgtaaccatatgtattagtgtcgtgttgtccacattaggtgttggtgctgcaattatttcataaatttaaatacccagcaaattggagctctgcagagctttcgtt

SEQ ID NO: 99 - DNA, 1636 bp, Arabidopsis thaliana
ttaattaaatgaattgcttttcatgtttttatttccatgaaaagaaaaaggttccaagagattcagacaacagctaccggagaaatggggaggtgaccggtagagacaacaacaaaacacaccctggtaagctcaaaacatctatattaatttttacagataagtcttatatatattagggtttataagactagattcagtaatctttgtgatgtttacagagaatccaaagactgtaaatgagcagaacaagaacaatgatgaagacaaagaagtgacaaacaacattgctgctcaaacattcagcttcagggagctagctactgcaactaagaatttcagacaagaatgtctgatcggtgaaggcggctttggaagggtttacaaaggcaaactcgagaaaaccggcatggttagtatatacttttgtacatcactttgaaacatgaatatggtatatgatttatagcattctatatctctctacaacaaatctctgaagatttttcgaatggttattttgggttcagattgtggcagtgaagcaattagatagaaatggattgcaagggaacaaagagttcatagtagaggtcttgatgttaagtcttttgcatcacaagcatctcgtgaatctcattgggtattgtgctgatggagatcagagacttctcgtctatgagtacatgtctcgcggttcactcgaagatcatctcctcggtaaattacaaaactaaggatccgtattgactaactttgaatcagtcctaatgtttaactgttttttgaaatgctaacagatctaacaccggaccaaataccgttggattgggacacaaggattagaatcgctctaggagccgcaatgggtcttgaatacttgcatgacaaggcaaatcctccagtgatctacagagatctcaaggcagctaatatccttctagacggtgaattcaatgccaagttatccgatttcggtctggcaaagctaggccctgtcggggacaaacaacatgtgtcttccagagttatgggaacttacggatattgtgctccagagtatcagagaaccggtcagttaactacaaaatccgatgtttatagcttcggagttgtgttgttggagttgataactggacgaagagttattgatactaccagacccaaagatgaacagaatctagtaacttgggtgagtttctctttttcagcttacatgaaaaccttttggcttcaattgtttaaaagatctaaacttttgtactttggtttaggctcaaccggtgttcaaagaaccgagtagattcccagagttagcggatccgagtctggagggagtgttcccggagaaagctctgaatcaagcggtggcagtggcagcaatgtgtttacaagaagaggcaacggtacggccactcatgagtgacgttgtaaccgctctcggtttcttaggaaccgctcctgacggctcaatctctgttccacactacgatgatcctcctcagccgtcggatgaaacgtccgtggaggattcagtggcagcggaagaacgggaaagagccgtggctgaggcaatggagtggggagttgcttcaagagcacattcccggaacccaagtgcttcttgaggcgcgcc

SEQ ID NO: 100 - DNA, 2783 bp, Arabidopsis thaliana
ttaattaaatgttggaaaccgaaagcagtgtctgcgacaacatcgccggcaatgagaaatggcgagcggaagctgaaattggtggcaacgagagagctctgcaagcgcttcgagaactcattatcttcccttttcgttaccctctcgaagctcgaactcttggtctcaaagtacatatatccacacctctgttggactcatagcttctctctttcgcttaatttgcttaatttgacttatcattgcagtggcctagaggattgcttctctacggtcctcctggaaccggcaaggtaaaaactctgtttctgtttgttggatttttcaaaaaactttgatcttgcagaagctaattcgaccgctcttgtattgaaattttggtttttgtagacaagcttggtccgtgctgttgtccaggaatgtgatgcacatttgattgttttaaggtactttgttatgtagcttctgtatagtttatgctttggagtaatagaggctaaagctaatttatgatttgtctttgtttgtcaaatactctgtttagccctcattctgtacatcgagcacatgctggagaaagcgagaaagtcttaagggaagctttcgctgaggcttcttctcacgctgtttcagacaagccttctgtgatttttattgatgaaatcgatgttctttgtcctcgtcgtgatgctaggtattgcttcacccctagtttatagttgctatcttcagagagatctttaagagattgagaataatcttgttctctttaaaatgcagacgagaacaagatgttcgtattgcttctcaactgtttacacttatggactcaaacaagccttcatcatctgcaccaagagttgttgttgtagcatccacaaataggttcttgtctaccttaagcataatataagttgattatcaacattggttttgaatgcaatgatccaatggttttccccgatcttgtcaaaagggtggatgcgattgacccagcgctaagaagagcgggacgatttgatgctttagttgaagtgagcacaccaaatgaggaggatcgtttaaaaatcctgcaggtaattatcgagttcttaaatgggattttcgtatatagtaagtttgtttgtgatcttcatgttttctatttttttcagctgtacacaaagaaagtcaatttagatcctagtgtcgatcttcaagccattgcaatatcttgcaacggttatgttggagcagatttggaagctttatgtcgtgaagcgacaatatctgcaagtaaaagatcttcagattctcttattctaacatctcaagacttcaagattgcaaaatctgtggttggtccaagtataaacagaggcatcacagttgaaatccctaaagtgacatgggacgatgttggtggtcttaaagacttaaaggtcaatactttttaaaaatattcattttgcactttgttgtcctgttttctccattgcgattaatggtttttttttccttgtgacagaaaaagctccagcaagctgttgaatggccaatcaaacattcagctgcatttgtaaaaatgggcatatcgccaatgcgtgggatacttctacatggtcctccaggttgctcaaagacaactcttgctaaagccgctgcaaatgctgctcaagcctccttcttttccttaaggtatagattttgatagatcacatttaacaaaatccccctttggttgtgaaacttgtttaaagaaacttattttttcttgtgtctttgtgtgggtgtgcgatgcagctgtgcggagctattttctatgtatgttggagaaggtgaagcattattgcggaatacatttcaaagagctcgacttgcttctccaagtataatattctttgatgaagctgatgtcgttgcctgtaaaaggtttgtctctatctctcccaactcttgcttcgtgttatagactcttcttaacatgtttatttccttgggtcttcgtagaggtgatgagagctcaagcaatagttctacagttggagaaaggcttctatctacactgttaaccgaaatggacggtcttgaagaagcaaaggtaaacaaaagctcataggcttttaaagattttatctttgttattgggttgcaatgatattgatcgggttttggtttaagggaatcctcgtcttggctgccacaaaccgcccgtatgcaattgatgctgctctaatgcgacctggtcgatttgatctcgtaagtcctcatattggatcttttgatcacacgagttctgaaatagcaaacctcattgctaccctcttcttgatttaggtgctatacgtgccaccgcctgatctagaagcccggtttgaaatactgcaagtgcatacacgcaacatgacactaggagacgacgttgatctcagaaaaatcgctgaagaaaccgatctcttcacaggtgccgagctcgagggtctatgcagagaaagcggaactgtctcacttagagaaaacatcgcagcaaccgctgtcttcaatcgccatttccaaaccgcaaaaagctcgcttaaaccagcgttaacaatcgaagaagtcgaaacttattcatcattcaggaaggcggcgaaaagatctgattcgaaaccgattccgattaacaaaaagaaggcgacttccaccgtcttcggattctcatggcaattaggtgttttgagcttattgttgcttgctactggaaactattacttcaaccacactaaacatgaattactagtagcttctgctacatgaggcgcgcc

SEQ ID NO: 101 - DNA, 1127 bp, Arabidopsis thaliana
ttaattaacacaacacagatagattacacactgagaaacagagaatggtagctgaggccttgcccaaatgccctgaagctccactcgtacttggactccaacccgcagctcttatcgataacgtcgctcctgttgattggtctttactcgatcaaattcccggtgatcgcggtggctccattgccgtgcaaaaggatgagttagagcacatgctaaaagagcttgatgcacatatcagtgtggctccattaaagaagatggctggaggaagtgtgaccaatacagttcgaggcttgagtgttgggttcggtgtagccactgggattattggtgcttatggagacgatgaacaaggccaattgtttgttagcaatatgggttttagtggtgtgagtatctcaaggctcaggaagaagaaaggttccactgctcagtgtgtttgcttggttgatgactctggtaatcgaacaatgcgaccatgtctctcgagtgctgtgaagattcaggcagatgaattaagcaaagaagatttcacaggctctaagtggttggttcttagatatgctgttcttaatttacaagtaattcaagcagccattcgatttgccaagcaagaaggtctttctgtttccttggatttagctagttttgagatggtcaggaattctaaatcagagcttcgacagcttctggagtctggtaacatagatctttgctttgctaacgaggacgaagcagcagagctccttaggggtgagcaagaagcgggtccggaggcagctcttgagttcctaggcagacattgcagatgggctgtggtaactttagggtcgaaagggtgcattgcaaaacatgataaagaggtggtacatatatcagccataggagagacagtagcaactgatgccacaggagccggtgacctattcgcaagcgggtttctgtacggactaataaagggattgtctttggaagaatgttgcaaagtgggatcatgcagtggtggatctgtcatccgtgctctcggtggagaagtaaccccagaaaactggcaatggatgcacaaacagttgcagttgaagggcttacctgttcctgacatccacaactgatgatatcggcgcgcc

SEQ ID NO: 102 - DNA, 1261 bp, Arabidopsis thaliana
ttaattaaacacaaaccaaaaaccaaaaactcttcttcttctgatgaaagatgattggcattggaagaaccctaacttcttcttctccatctaagatcattctcgaagatcttcctcctggaatttatcgctatggaacagagatattcacttccgttcccaggaaaacgttccatcacatcaagtttttgcgtttggattctgctcagagcagcaggattcttaagccggtcccgcttcgttcttcgtcgattaaggattcgcaggtaaacgtagaagatgaagaaatcgaagcttctaacaaaacagttcgtgtaaggttccagttgcggaaagaatgtgtctttggggaacattttttcattgttggtgatgatcctgtgttcggtggcctttgggatccagaaactgccttaccactgaactggtctgatggcaatgtttggactgtagatttggatttgcctgttggaagattggttgaatttaagcttttattgaaggcacagacaggggagattttgtggcaaccaggtccaaaccgggctcttgaaacctgggaaactaacaaaactatcagaatatgtgaagactgggataatgctgatcttcaaatgatgattgaggaagattttgtgccttacaccaatatttcgtcgatcggttcagaagatgaggatgaagtgcttggtagtgtacaacaaaactcttcagtagtagctgtagagaatgcaggatacgtgagtgatgagtctgcccagaattcgagtttcagtatccaaagtgagaaaactatggaaccttcgaatggagctttgactgctcgggaggtgatcaaagaagccatgtttactgaggaagaaagtccagttttggttcctggattgattcctctgtctgacttggataatgaacaagtggaagttattaatgaaggtaaagcagaaacgttcccggaggtagataagaagcaagaacccaaagcagaaagaaacaagaaagcaaaagtaaaagcgatttcattattcgagaaatcggagcaagaagcagtgaaaagtgtagagcagaggcaatacaatgcagtagaggaagagcagcagcggctagagacagagccgcttggaacgccggatgtgctttttgagaatgatatccaatggggacgcagaacactttacaagcttctaagcaactttagacttttctaaactcgactaagttttgagtgcatacatacatcggcaaaagagcctggcgcgcc

SEQ ID NO: 103 - DNA, 1075 bp, Arabidopsis thaliana
ttaattaagaagaaacagagagttttcagaggaagaagaaacagagagtagtgatgacatcagggacgagaatgccgacatggagggaaagagagaacaacaagagaagagaaagacgacggagagcaatcgcagctaagatcttcaccggattaagaatgtacggtaattacgagcttccgaagcattgcgacaacaacgaagtgcttaaagcactctgtaacgaagctggttggatcgtcgaacctgatggaactacttaccgcaagggatgtagtagacctgtagagcgtatggagataggtggtggttcagcaaccgctagtccttgctcttcctatcagccaagtccctgtgcttcttataatcctagtccaggctcctccaacttcatgagtcctgcttcatcctcatttgctaatcttacctctggtgatggccaatctctcatcccatggctaaaacacctctcaacaacatcatcctcatcagcttcttcatcatcaagactccctaattacctctatatccctggaggctccataagcgctcctgtaactcctcctttaagctctccaacagctcgtaccccgagaatgaacactgattggcagcaactcaacaactccttctttgtctcctcaacaccgccaagtcccacgcgtcagatcatccctgactctgaatggttctcagggattcaactagcacaaagtgttccagcttcaccaacgtttagcctcgtctcacaaaacccatttggattcaaagaagaagcagcctctgctgctggaggcggaggagggtcaaggatgtggacaccaggtcaaagcggaacctgctcccctgctattcctcctggtgctgaccagacagcagatgttccaatgtctgaagccgtggctcctccagagtttgcttttgggagtaatacaaacgggctagtgaaagcatgggaaggagagaggatacacgaggagagtggttcagatgatcttgaactcactcttggaaactcaagcaccaggtaattccaaagccacatgtacattttcaaacccggttgaggcgcgcc

SEQ ID NO: 104 - DNA, 375 bp, Arabidopsis thaliana
ttaattaagtgtttttcttcttctccaaaactcgtaaaacctataaaccacaatggctcgttctctcgctaacgctaagatccaatccgtcttcggctccgaaaagctctcgaacgccgttttcagacgagggtttgccgccgcagccaaaacggcgttagatggaagcgtttcgaccgcggagatgaagaagagagctggggaagcttcaagcgagaaggcaccatgggttccagatcctaaaaccggttattacagaccggaaaccgtttctgaggagattgacccggctgagctacgagctattctcttgaacaacaagcaataaatttattaaaaaccgtatttttattcatcaatgttgtttggcgcgcc

SEQ ID NO: 105 - DNA, 904 bp, Arabidopsis thaliana
ttaattaaatggaagctaattcaggcggaggaggaggagctgaaggcggaagagcggtaaccggaggaggaggaggaggaggagggagcgatgtggaattggtgagcaagacgttgcaagtggagcataagctattctattttgatcttaaggagaatcctcgtggaaggtatctaaagatatcggagaagacgtcggcgacgaggtcaaccatcattgttccttcctccggcatctcttggttccttgatctcttcaactactatgtcaattctgaggaacacgagctttttagcaaagaattgcagcttgattccaaggtgttttacttcgatatcggtgagaacagaagaggacgcttcttgaaggtgtcagaagcatcggttagtagaaatcgaagtaccattattgttccagctggaagctctcctgatgaaggatgggcagctttcaggaatatattggctgagatacatgaagcatcaggactttttgtgatgccaaatcagaaaccttctgatggacaggaacacttggttgatgatgttggagctggttttatacctggacatggtagtcagcagccatcttcttcagaacataatgtggatcgaacaattgactcgccaggccaggaagaaaccggaatgactggtgtttctaaagtaatcagagctgaccagaaacggttcttctttgatcttgggaacaataacaggggccatttcttaaggatatctgaggtggcaggttctgacaggtcttccatcattctaccgttatcgggtcttaagcagtttcacgaagtaattggtcactttgtggagatcaccaaagataaaattgaaggtatgacaggcgcaaatgtcaggacagttgatcctcctcagagataaatttaaat

SEQ ID NO: 106 - DNA, 1010 bp, Arabidopsis thaliana
ttaattaaagagagagaagggccaacgaccacacatacacacacagaccaataaaccatgagcccttccaagcagcgacatcgtagctctaccggagaaaacaagtcaaagccggtcagatccgcttcatcctccgccataccggaatggattaccgaatcaaccaacggcggatctctccgtcgcgtagatcccgatacaggtaccgacggctgggcttctcctcccggcgatgttttctctctccgctccgattcttacttgtccaaaaaacaaaaaactcccgccggtgattacctcctttctcccgccggcatggactggctcaaatcaagtaccaaactcgagaacgcgctcgctcgtcccgataaccgtgtagctcacgcgcttagaaaagctcaatctcgcggtcaatctctcaagagcttcatcttcgccgtgaatctccagattccaggtaaggatcatcacagcgccgtgttctacttcgcgacggaagaaccgattccttccggttcgcttctccaccggttcatcaacggcgacgatgccttccggaaccagagattcaaaatcgtgaatcggattgtgaaaggtccttgggtagttaaagccgcggtggggaactatagcgcttgtcttctaggtaaagccttgacgtgcaattaccacagaggtcctaactactttgaaattgacgtcgacattagcagctcagcgatcgcaacggcgattctacggctggctttagggtacgtgacgagcgtgacaatcgatatggggttcttagcagaggcacaaacggaagaggagctgccggagagattaatcggagctgttagagtttgccaaatggagatgtcgtcagcgtttgttgtcgacgcgccaccaccgcagcaactgccgtcacaaccgtgtagaacattaagttcggcgaaagttaaccatgacgaggacgaggattgagattaaaccacaacatgtcaatgaagtatttttctcggcgcgcc

SEQ ID NO: 107 - DNA, 516 bp, Arabidopsis thaliana
ttaattaaaattcgttctctttgggaaattagagatgcaggcatcaagagcgcgactgtttaaagaatacaaagaggtacagcgagagaaagtagcagatcctgatattcaattgatctgtgacgataccaacatattcaaatggaccgctcttatcaaaggaccttcggagactccttacgaaggcggtgtttttcagcttgctttttctgttcctgaaccttatcctttgcaacctcctcaagttcgattcttgaccaagatattccatcctaatgttcatttcaagacaggagaaatatgtctcgacattttgaagaatgcttggagtcctgcttggacgcttcagtctgtgtgtagagctatcatagcattgatggctcatcctgagccggacagtcctcttaactgcgactcagggaatcttctaagatctggtgatgtgagagggttcaattcaatggcacaaatgtatacacgcctcgccgctatgcctaagaaaggatgaggcgcgcc

SEQ ID NO: 108 - DNA, 2782 bp, Arabidopsis thaliana
ttaattaaatggtctctaaagagtgttgccgaaacgaaatacgtgcggctattcgacagcttagcgaccgctgtttatactccgccgcaaagtggttcgttttctcaaaaccctaatcttattcaacctctcccattgttgcaatctctagctcgctactgctctggttcgattaaaaatcgattttttcactatcctttatgggttttactaatttttttgtatcctgggctaattgtaaacaaatttggttaagcagattcgttgattcgaattcacttttgttgcgaatttggtgttggatacattccaattcagatgattcgacatgtgggttttgtgttatgatatgtttgagctcgacactaattgaaaaaatgtgttctttcgatgggaacttctgatctccggttcaatctttcgatatgtttgagctcgacactaatttgtgaattatgagttaaagtttcagtttttagtactcgtattgtagttcaatggtggtgaactattagtcagttccatatttgatatctcctttgctttcatcattgcagggcaggagagcagcttgtggggatagagcaagacccgtctaattttacacctgcgaatacgaggtttcagcgaggaagctctagcatccggagaaggttcagcaccaatgaatctatttcaacaccgttaccttccgttggcttctctcaagcagctactcctctcccggaagaagatgaagcgattgatggtgacatttaccttttagcaaagtcctattttgattgtcgagagtatagacgggcctcccatatgcttcgtgaccaagtgagcaagaaatcactgttcttgcgttactatgcgctttatctggtatgttctgtttctctatctcctattttctatttagctagagcttttatatcttatcagaatagggtgatggaatgaactttttaaaagttggctccaaaatgcttttgagtgttcttttagcctcggccagtaggctgccttcaaataaatgcaatatatggacgttattacaaacttataggactgagcctctgattcacaattttgttgatgtccagtcacagttatgttctatgatacaagagatatgagggtatgcaactgatatacaaaagtaaataaatgagtgaaacttaattggaattgttcgtcctgtttaaagactattctgtaaacgtttatggcaattacttactgagagcttgttttttactcccgcttatttacaccaaaagagatagttctctataatatgtcattaactttgttatcgtttcaatgaaggctggagaaaaacggaaagaggaagaaatgatagaacttgaaggccctttgggtaagagtgatgccataaaccgtgaactggtatctttggagagggatttatcagctctgaggaggacaggagcaattgactcttttggattatacttgtatggtgtggttcttaaagaaaagggaaatgaaagtcttgcacgtgccagccttgtggagtctgtcaacagttatccttggaactggagtgcctggtcagagctgcagtctctgtgtacttcgatcgaaatcttgaatagccttaacttaaacaatcactggatgaaagagttttttcttggcaatgcttatcaagaactcagaatgcacaccgagtctttggcgaagtacgagtatttgcaaggtattttcagttttagcaattacatccaagctcaaactgcaaaagctcagtatagtcttagggaattcgaccaggttgaaatcatgtttgaagaacttctgagaaacgatccatatcgggtagaagatatggatttgtattctaatgttctgtatgcaaaagaagcatgtgctgcgctgagttaccttgcacataaggtgtttttgactgataagtacagacctgagtcttgctgcatcattggcaactactacagtttaaaaggccagcatgagaaagcagttatgtatttccggagagctttgaaactgaacaagaagtatttatctgcgtggactcttatgggccatgaatatgttgagatgaagaacacgcctgctgccattgatgcatatcgacgagctgttgatataaaccctactgattatcgagcttggtatgggttaggacaagcatatgagatgatggggatgcctttctatgcacttcactattttcgcaaatccatattctttcttccaaatgattctcggttgtggatagccatggctaaatgttatcaaaccgaacagctttacatgcttgaagaggccatcaagtgttacaaaagagctgtgaactgtactgacacggaaggaatagcacttaatcagctggcaaagcttcaccagaagcttggacgtaatgaagaagctgcatattacttcgagaaggatttagagagaatggatgctgaaggattagaaggaccgaacatgtttgaggctttggtttttcttgccacacattttaaaaatcacaagaaattcgaagaagcagaagtgtattgcacccgtcttctcgattatagtggacctgtaagttttctgctccaattttctccattgttaactagtttataaggatctgagtatcctgatacacttattacacttagtgagatagtgtgacgagattgcattcatcttttcaggaaaaagaaaaggcaaagagcttactcagagggatcagaatggcgcaaaccggttttccttcaatggatctcgagcattttcctatttagggcgcgcc

SEQ ID NO: 109 - DNA, 1929 bp, Arabidopsis thaliana
ttaattaaatggctagtttagtctctggtgataaagaagctcaaatctctggcgatccaggcagcaagcgcggtggatggatcactttcccgttcatgctcggttagctagtgttttttattgttttggttttatgttttcgaaaccaaaacgttgacaaatgttgggttctatgtcgtgcagctactttgttaggcctttccgtgacttctttcggatgggtaatgaatttgatcgtcttcctaatcgaagagttcaacatcaagagcatcgctgctgctcagatttcaaatgttgccaatggatgtctcagcatgttgcctgttgttgcagccattctagctgattctttctttggaaacattccggtcatcgcggcctcttctttcatttctctgcttgtaagtccaagactctttctgttgcatcaattctcttttgtggtctgataagctcaccagtatatgaaaacgtttgtttagggaatcgttctcttgacgcttattgcatctttggactacttgagacctcggccgtgtgaagcagggtcagtcctatgcacaccgccgtcaaaactccacctcgggatcttgtacacagccttagctttagtgaccactggagcaggtgggacacggttcaccatggcatccgcgggtgcaaaccaatatgagaaacctaaagaacaaggaagcttcttcaactggtacttcctcacactatacgctggagctattactggtgcaacagcaattgtatatatacaagacaatgctagctggaaactagggtttggtctctgcgcggctgctaatttgatcagtttcatagtttttgtctctgggaagagatactacaagcatgacaaaccaatgggaagtcccttcacgagtctaatccgcgttgtagtctctgctacagtaaaaaggaaggctgtaatatcatgcaacgaagaagactatcatcactatggtctcgaaaaggaggtcaagacttctgctgcaatgccatccaagagcttcaggtgaaaaaatcaaaacaaaagcttacttgattcttgacacttgcacatagcgcttaaataccttttcatgtgcaggttcttgaaccgcgccgctttgatgaccaaagatgatttaaatcagaaagaaggatcagttaacaacatctggaggctatgctctgtacaagaagtagaagatttcaaagccattctccgagtttttcctctatggttatcaatcatcttcgtgagtactcctatggtgatgcaaacaagcttgattgtactccaagctctagtcacggaccgcggacttggtcctaatttcaaagtcccggccggttccctccaagtaataataatcatcactgcatgcattgttatcatcatgaacaactggcttgtctttccaatgtacaagaagctaactcataagttgctgacaccgcttcaaaaagtcggtataggccaggttctcaccattctaagcatggcactctccgcggtggtagaagcaaagaggctgaaaacagttgaaaatggtcatcccatgtcagtgttatggttgtttcctccccttgtgatagtaggtataggcgaagccttccagtttccggccaatattgaattattttatggcgaattccccgagtctctgaggaacaccgcgacttcattgacctcggtggtgattggaatctctttctatttgagcacagctctcattgatcttatccagaggaccacagcgtggttaccaaatgacattaaccacggaagagtggacaatgtttactggcttttagtcattggaggaatcttgaatttcggctacttccttgtgtgttcttgggtctacaaatatagaaacctcaaggataatgatcaagaacaagatccaaaagatggtacaatgtaaggcgcgc

SEQ ID NO: 110 - DNA, 2664 bp, Arabidopsis thaliana
ttaattaagtggtctctctggtaatggaagagatcaggaaagaaatagatgtcggtgattggcattcaaatctagctcacgatgaatggacaccactccctgtttctggctctcgagcatcagctcgttacaaggtcactgattatatctttgtctgtggttaagcatttgattaaattggagataatttctctgaaatcttttcgtgtgttgtctggatgacgcagcatgcggcagtggttgttgatgagaagctctacattgttggtggaagccggaatggccgatacttatctgatgtccaggtaaattgtgtgtttcttctttgtgtctgtatcttccttttgttttcatgaatctgtggtgatttgaaaaaaactcaacttatcaggtgtttgatcttagaagtttgacttggtctagtttgaaactgaaaactgaatcatcaagtgctgataacattcaagaggatgatggtagcagcttacgggaagcttttcctgctatttcagaccatcgcatggtaagtcctttcttaacatgaagaagaattttgtaatcaatactcaaaaaaaatgttaaatttgaagcattttggcagattaagtggggaaacaagcttcttttgatcgggggacactccaagaagtcatcagataacatgttaggttagccgtatccagctttccttctgattggatgctctttcaatttcttatttatgtgtttgagttttttcttacagtgcggttcattgatttggaaacacattcatgtggagtcattgatgtgtttgggaatgttccggtaagaaaactgttatctaaattgttgctcactccatatgtagctgttttggatagttaagttatattatcttccatgttttctaggcttcacgtggtggacattccattacactggttggatcccgagttcttgtttttggtggggaagataagaacaggagactgctgaatgatctgcatgttcttcatcttgagacaatgacttgggatgttgtagagacaaagtaagtttatgtaaaagtgcaggcagctagatctaggccatgcttatgtttactgcacttctgtctacctcgtcttacaagtaaatgctctgtattgtttttttttggatgataggcagacacgcccagttcccagatttgatcacacagctgccacacattctgatcgctacctcttgatttttggtggttgttctcattcgattttctacagtgatcttcatatccttgacttgcaaacagtaagtaagcacattttattggtattttttttgccaatttagtcatattctgatgaatttactttactcatggcagatggagtggtcacagcctcatgttcagggagatgttgtaactcctcgggcaggacacgctggaatcaccattgacgaaaactggtatatagttgggggcggtgataacagtactggtaaatgcagtctctgcttttagaattacgtcttactcgctcaacatgcgattccagttaacactttgcattcatctctcctcggtaactcttttctttccgtgcaggttgtttagagacccttgttctaaatatgtcaaagctggtttggtctacatcaacccatgtagaagcaagacatccacttgctagtgaggttgatacttccaaaactagaacccaatcgtacatgtttcttttccgagttttcttatgtgttgtatggttcaactgcagggtctcagtgtatgttcagcatcagtatttggagagaacatcttagtagcttttggcggctataacgggaagtataacaatgatgtaagcacatagcaatagatttcaacaagtcaaatcttattgatatgcttatttgggctgttgtcttcttttcatccagatatttgtcatgaggctaaaaccaggagaatcctcacatcccaaaatctttaagtcaccagcagccgctgcagctgcagcctctgtcactgctgcttatgccatagccaagtcagataagtcagattatcctccacctgcaaatccaactctcaatggaaatggaaacagtcttcctgagagagatattaggaacagaatcgataccattaaagaagaaaaaagagcattggagtcatctattgcggaaactcaagtagaaaacgcgaagctcagggaaaagatagatgaagtcaatagtagccacactgagctatctcaagtacgtaatctctatctgtcaggttatccctatttgcgttctatgaacatgtttcacattccataaacattatcgcaggaactccaatctgtagaaggtcaacttatttcagaacggtctagatgctttaaactcgaggtttataagcctcctctaacctttcaatagccttctctttttctaaaatctcaaactcaagtgcgattttatctaatggcatgtctcaggcacaaatagcagaattgcagaaagcactggagtcagggcaatccatcgaagctgaagttgagatgcttagaagacagaggtcagcgtctgatgaagaagaagacgggactgtgcaaaggcaaggctctgctggtgtgtggggtttgtttggaaggtaaatcccaaacagtttggcgacacaaatacctataagctctgacgaggcgcgcc

SEQ ID NO: 111 - DNA, 1176 bp, Nitrosomonas europaea
gctttcaaactctttgtttcttgtttgttgattaacccttaattaatccgggcgcgcctgatttatcacaagtttgtacaaaaaagcaggctcctgcaggaccatggcaatcagaattggcatcaatggttttggtcgtattggccggatggttttccggtgttccatagaggagtttgatgacattgaagttgtcgcaatcaatgatctgctggaaccggattatctggcttatatgctgacacatgattccgtccacgggcgcttcagaggagatgtatccgtcagcggaaacaatctgattgtaaacggcaaacagattcgtctgaccgccatcaaggacccgaccgaattaaagtgggatgaagttggtgcggatatcgtggtggagtctaccggactgttcctgaccaaggagctcgctcaaaaacatatccaggccggtgccaagaaagttgttttgagtgctccgtccaaagacgatacgccgatgtacgtttatggtgtaaatgataaagcatacggcggagaagccattatttccaacgcatcatgtaccactaattgcctggctccgattgccaaagtactgaatgatacctggggtatcaagcgtggcctgatgacgacggttcatgctgccaccgctacacagaaaactgttgacggtccttccaataaagactggcgcggtggacgcggaattcttgaaaatatcatcccttcctctacgggtgcagccaaagcagttggcgtagtcatccctgaactgaataaaaagctaacaggtatggcattccgcgttcctacctctgacgtttcagtagtggatttgacagtcgagcttgagaaagacgcatcttatgaagacatttgtaatgcgatgaaagaagcctcagctggttcaatgaaaggcatactgggatataccgatcagaaagtggtttccacagattttcgcggagaaacctgtacatcggtattcgatgcagaagcgggaattcagctcgacaagaattttgtaaaagtggtttcctggtatgacaacgagtggggatattcctgcaagttgctggaaatggtacgagtaatcgccagtaaataactcgagacccagctttcttgtacaaagtggtgataaattggagctctgcagagctttcgttcgtatcatcg

SEQ ID NO: 112 - DNA, 1208 bp, Xenorhabdus nematophila
aactctttgtttcttgtttgttgattaacccttaattaatccgggcgcgcctgatttatcacaagtttgtacaaaaaagcaggctcctgcaggaccatgaaagcacttgtttatcacggagccggaaaaaaactttgggaagagaaagcgccaccccaactcattgagcccacggatgctattgttcgcattgtcaaaaccaccatttgtgggacagacctgcacatcctcaaaggagacgttcctactgttgagcagggccggacactgggccatgaaggtattggtattgttgagttaatcggcgattctgtccgtaacctcaaagtcggtgataaagttatcatctcctgtattaccgtctgtggtagctgtccctattgtaagcgccagctttatgcgcactgcaaagatgggggctggattctggggcataaaatcgacggtacgcaggcagaaaaagtacgtattccccatgctgataatagccttcatcgcctgccggaagatgttgatgaagaagccgccttaatgctcagtgatattctgccgaccgggcttgaaattggtgttatcaatggcagggttcagccgggccataccatcgccttaattggtgcagggcctgtcggactctctgcgctactggcatcccagttttactctccggcacatatcatcatgatagataccgatgataatcgtctcagcgttgctcagcagtttggtgccaacacaattatcaacccgacacggcaaaacgtggttgaaaccatccacaaattgactgatggcattggtgttgacgttgctattgagtgtgtggggatccctgcgactttccagatatgtcaggatatcatcgccgcaggcgggtttattgctaatgttggtgttcatggcaaatccgtcgatttacatctggaaaatctctggatcaaaaatatcaccatcaccactgggctggtcaatacaagcagcacgcccatgctgttgaaaagcgttcaatccggtaagatttcaccggaaaaattggtcactcaccattattcattgagtgaaatagagactgcttatgacatatttggcaatgccgccaaagagaaagcactgaaaatcgtcctgtcagcataactcgagacccagctttcttgtacaaagtggtgataaattggagctctgcagagctttcgttcgtatcatcggtt

SEQ ID NO: 113 - DNA, 1951 bp, Bacillus subtilis subsp. subtilis str. 168
attcatttatttgtcagctttcaaactctttgtttcttgtttgttgattaacccttaattaatccgggcgcgcctgatttatcacaagtttgtacaaaaaagcaggctcctgcaggaccatgggaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcagtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaactcgagacccagctttcttgtacaaagtggtgataaattggagctctgcagagctttcgttcgtatcatcggtt

SEQ ID NO: 114 - DNA, 1636 bp, Sinorhizobium meliloti
tttgtcagctttcaaactctttgtttcttgtttgttgattaacccttaattaatccgggcgcgcctgatttatcacaagtttgtacaaaaaagcaggctcctgcaggaccatgaatctgaaagacccgtcgctgtttcgccaggctgctctcgtgggcgagacctggatcgaagccgacccgaagaatgcgatcgaggtgaacaatccagcgaccggcgaaatcatcggccgcgtcccgaagctcggcgccgccgatacccggaccgcgatcgaggccgcggcgcgggtgcagaaggaatgggcggcgaggaccgccaaggagcgctcggcggtgctgcgccgctggttcgagctgatgatcgaaaacaaggacgatctcggccggattctgacgatggagcagggcaagccgctagcggaggcgacaggcgagatcgtctacggagcgagcttcatcgaatggttcgcggaagaggcgcggcgtgtctatggcgatctcgtccccgggcatcagaaggacaagcgcattctggtgatgaagcagccgatcggcgtcgtcgccgcgatcacgccgtggaacttcccgaacgcgatgatcacccgcaaggccgggccggcccttgccgccggctgcgccatggtcttgaagccggcagcgcagacgccgttttcggcgatcgccatcgccgtgctcgccgagcgcgcgggcatgccgaaaggtctcttcagcgtcattaccggctccgcgcgcgagatcggcgccgagatgacttcgaacccgaccgtccgcaagcttacctttaccggctcgaccgaggtcggcgcagagctctaccgccagagcgcggcaacgatcaagaagcttggcctggaactcggcggcaacgccccgttcatcgtcttcgatgatgccgatctcgatgcggcggtcgaaggcgcgctgatcgccaagttccgcaacaatggccagacctgcgtctgcgccaaccgcatctatgtgcaggacggcgtctacgaggccttctccgacaagctcgcccaggccgtcgccaagctcaagaccggcaacggcatggaggacggcgtcatcctcggaccgctgatcgaccagccggcgctgaaaaaggtcgaggagcatgtggcggatgcgcttgcgaagggcgcgcgcgtggtgcagggcggccgtcgccattcactcggcggcaccttctacgaggcgacggtgctggccgacgtgacccaggcgatggcggtcgcgcgggaagagaccttcggaccggtagcgccgctcttccgcttcaaggacgagtcggatgtgatcgcacaggcgaacgacaccgaattcggcctcgcctcctatttctacgccaaggacctcgcccgcgtcttccgcgtggcggaagcgctggaatacggcatggtcggtgtcaatacaggcctgatctccacggccgaagcaccctttggtggcgtcaagctctcgggccttggccgcgagggctcgaaatacggcatcgaggaattcatggagatcaaatatgtctgcctcggcggcattgcctgactcgagacccagctttcttgtacaaagtggtgataaattggagctctgcagagctttcgttcgtatcatcg

SEQ ID NO: 115 - DNA, 3211 bp, Arabidopsis thaliana
tttgtcagctttcaaactctttgtttcttgtttgttgattaacccttaattaatccgggcgcgcctgatttatcacaagtttgtacaaaaaagcaggctcctgcaggaccatgatgaaactttttcttctccttctttttcttctccacatttctcataccttcaccgcaagccgaccaatctccgagttccgtgctctcctctcactcaaaacctctctcaccggcgccggagatgacaaaaactcgcctctctcttcctggaaagtctcaacaagcttctgtacatggattggtgtcacgtgcgatgtatctcgccgtcacgtgacttctcttgatctctccggtctcaacctctccggtactctttccccagatgtttctcatttacgtcttcttcagaatctatcactcgctgaaaatctaatctccggtccgattccgccggaaatctcgagcctttccggtcttcgtcacttaaatctctcgaacaatgtcttcaacggttcgtttcccgatgagatttcttctggattggtgaatctccgagttcttgatgtctacaacaacaatctaaccggagatttaccggtttccgtcaccaatctgactcagctccggcaccttcacctcggtggtaactacttcgctggaaagatcccgccttcgtacggaagctggccagttattgagtatctagcggtttccggcaacgagcttgtcgggaaaatccctccagagatcggaaacctaacgactctccgggagctttacatcggctactacaacgctttcgaagacggtcttcctccagagatcggaaatctatcggagctagtcagattcgacggagctaattgcggattaaccggtgagattccgccggagattgggaagcttcagaaactcgatacgcttttcttgcaagtgaatgtcttctccggtccattaacttgggagctaggaacgctatcgagtttaaaatcaatggatttgtctaacaacatgttcaccggagagattccagcgagtttcgcagagttgaagaatctcacgcttttgaatctcttccgtaacaaacttcacggcgagataccggagttcatcggagatttgccggagcttgaagtgttacagctttgggagaacaatttcaccggaagcatcccgcagaaattaggagaaaacggtaaactaaatctcgtcgatctctcttccaataagctgaccggaactttaccgccgaacatgtgctccggtaacaagttagaaactttaatcactcttggaaactttctctttggttcaatccctgattctcttggtaaatgtgagtctttgacccggatccgaatgggtgagaatttcctgaacgggtcaatcccaaaaggactattcggattacccaaattaactcaagtggagctccaagataattatctctccggagagttaccagtcgccggaggtgtctctgttaatcttggtcagatcagtttatcaaacaaccagctctcaggtccattacctccggcgatcgggaacttcaccggcgttcagaaacttcttcttgatggaaacaagttccaaggtcctattccttcagaggtagggaagcttcagcagctctcgaagattgatttcagccacaacttgttctccggtcgaatcgcgccggagattagtcgttgcaagctcttaacgtttgttgatctgagcagaaacgagctctccggtgaaatcccaaatgagatcactgctatgaagatattgaattacttgaacctgtcgagaaaccatctggttggatcaatccctggttcaatctcgtcaatgcagagcttaacatctcttgatttctcttacaacaacctctccggtttagttccgggaacaggacaattcagttacttcaactacacatcgttcttgggtaatcctgatctctgtggtccttatcttggtccttgtaaagacggtgttgctaaaggaggtcaccagagtcatagtaaaggacctttatcagcttctatgaagttattgcttgttcttggactacttgtttgttcgattgcgttcgcggtagtagccataatcaaagctagatcattgaaaaaggcgagtgagtcacgggcttggaggttaacagctttccagagactagacttcacgtgtgacgatgtcttggattctctcaaagaagacaacattataggcaaaggaggagctggtattgtctataaaggcgtaatgcctaatggtgatctagtcgcggttaaaagactcgctgcaatgtctcgtggatcttcccatgatcacggcttcaacgcagagattcaaaccttaggaaggataagacacagacacatagtgaggcttctcggattttgctcaaaccacgagacgaatctacttgtctatgagtacatgcctaatggtagtctcggtgaggtgcttcacggtaagaaaggaggacacttgcattgggacacacgttacaagattgctcttgaagctgctaaaggactctgttaccttcatcacgattgttctccattgatcgttcacagagatgtcaaatcaaacaacatcctccttgattcaaactttgaagctcatgttgctgactttggtctcgctaaattccttcaagattccggtacttctgaatgtatgtctgcaatcgctggctcttacggctacatagctccagagtatgcgtatacgttgaaggtagatgagaagagcgatgtgtatagtttcggtgtggttcttttggaactcgtcaccggaagaaaacctgtcggagaatttggagacggtgtcgatatagtgcaatgggttcgtaaaatgactgattcgaacaaggattcggttctgaaagtattggatccgagactttcttcgattccgattcatgaagtgacgcacgtcttctatgtagcgatgctctgtgtagaagaacaagctgttgagaggccgactatgagagaagttgttcagattctcactgagatcccgaagttgccaccgtcgaaggatcagccgatgacggaatcagcgccggagagtgagctttcgccgaagtctggtgttcaaagtccgccggatctactcaatctatgatagctcgagacccagctttcttgtacaaagtggtgataaattggagctctgcagagctttcgttcgtatcatcggtttcgacaacg

SEQ ID NO: 116 - DNA, 1110 bp, Nitrosomonas europaea
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaaaactcgttctcctgcgacacggagaaagtatctggaatcaggaaaatcgctttaccggctggactgacgtcgatttaacgcccaagggactaaaagaagccgaagaggcaggcagattgcttcgcgaaaacggtttctccttcgacattgcttatacatctctactcaaacgggcaattcgtacactctggatcgcactggacgaaatggatcagatgtggaccccgatcgagctcaactggcgactcaatgaacggcattacggggcacttcagggtttgaacaaagcagaaaccgccaaacaatatggcgatgaacaagtactcgtctggagacgcagttacgatatccgcccaccttccatcacaatcaacgacgaacgctatcccggctttgatcttcgctacagaaacatgtcatccggcgatattccgcttgctgaaagtctcaaggatacggttgcaagatttctgccctactggaatcagtcaatcgctccacaaatcaaggcagaaaaaaaggtaatcattgctgcacatggaaattcgctgcgcgctctgatcaaacacctcgataatatctcggaccaggatatcctgaattgcaatatacccacagggattccgctagtttatgaactggatgacgacttgaaaccactcaacagttactatctgggagatgctggccaaattggggaagccatttcggcggtcgccaatcagggtaaatccggagcttgactcgagacccagctttcaaatacccagcaaattggagctctgcagagctttcgttcgtatcatc

SEQ ID NO: 117 - DNA, 1014 bp, Sinorhizobium meliloti
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagcggcaccctcgtccttgtccggcacggccagagcgactggaacctgaagaacctcttcaccggctggcgcgatcccgacctcaccgaactcggcatcgaggaggcaaaggccggcggcaaggcgcttgccgattacggcatcaaattcgacatcgccttcacctccgtcctcatccgggcccagcgtacctgccagctcgtcctcgacgccgtcggccagtcgtcgctcgaaacgatccgcgatcaggccctgaacgagcgcgactacggcgacctctccggtctcaacaaggacgatgcgcgggcgaaatggggcgaagagcaggtccatatctggcgccgctcctacgacgtgccgccgcccggcggcgagagcctgcgcgacaccggcgcgcgcgtctggccctattacctgaccgacatcctgccgcgcgtgctttcgggcgagaaggtgctcgtcgccgcccatggcaactcgctgcgctccctcgtcatggtgctggacaagctgaccaaggagcagatcctcaagctcaacctcgcgaccggagtgccgatggtctacaagctgaacgcggattcgaccgtcgcttcgaaggaagtgctaggggatatgtccggggcgcattgaggcacacacctcttgcgggctggtgcggcggatactgctcgagacccagctttcaaatacccagcaaattggagctctgcag

SEQ ID NO: 118 - DNA, 1433 bp, Synechocystis sp. PCC 6803
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggccgttagtgagattcatattcctaactctttactagaccgggattgcaccaccctttcacgccacgtactccaacaactgaatagctttggggccgatgcccaggatttgagtgccatcatgaaccgcattgccctagcgggaaaactgattgcccgtcgcctgagtcgagctgggttaatggccgatgtgttgggcttcactggggaaaccaacgtccagggggaatcggtgaaaaaaatggacgtatttgccaatgatgtttttatttctgtctttaagcaaagtggcttggtttgtcgtctggcttcggaggagatggaaaaaccctactatattcctgaaaattgccccattggtcgctatactttgctgtacgacccgattgatggttcctccaacgtggacattaacctcaacgtgggttccatttttgccattcggcaacaggaaggggacgatctagacggcagtgcgtcagatttattggctaacggagacaagcaaattgctgctggttatatcctctacggcccctccaccatcctggtttattccctcggctccggagtgcatagctttatcctcgatcccagtttgggggaatttattttagcccaggaaaatatccgcattcccaaccacggccccatttacagcaccaatgaaggtaacttttggcaatgggatgaagccctgagggattacacccgttacgtccatcgccacgaaggttacactgcccgttatagcggtgctctggtgggggatattcaccggattttgatgcaagggggagtgtttctttatcctggtacggaaaaaaatcccgacggcaaattgcgtttgctctatgaaactgcgccgctggcctttttggtggaacaggctgggggaagggctagtgacggccaaaaacgtttactggacttaattccttctaaattacatcagcgtacccccgccattattggcagcgcagaagatgtgaaattggtggaatctttcatcagcgaccacaaacaacggcagggtaattagtttacttaatcactgcaaatcgtttgaggtctaggaacgtcttctcgagacccagctttcaaatacccagcaaattggagctc

SEQ ID NO: 119 - DNA, 1685 bp, Sinorhizobium meliloti
aaaaaagcaggctcctgcaggaccatgaaagaggcgccgtggttctcgagctcggtcatctatggaatcgacgtgcgcagattttcggacggaaatggcgacgggatcggcgacttcataggtctcaaggagcgcgtgtcttatctgcactatctgggcatcgactgtgtctggctctcgccgttcttcaggtccccctttgccgataacggctacgacgtcagcgactattattccatcgatccggttctcggaacgctggacgacttcctggatttcctgcacgccgccggcgaacagggcattcgcgtcgtcgtcgatctcgtcgccaaccacacatccagcgagcatccgtggttccaggcggcgcggcgcgacgcgaggtgccgcttccgcgactattacgtctggtcggaaagcccgccgccggtcgctccggacaacaagacggcgtttcccggcgaggaaagcagtgtctggacctatgacgatctcgcccaggcctattacttccacaagttccgccatttccagccggacctgaacatcgccaacccggcggtgcgagacgaattgcttcgtgtagtcgactattggctgacattgggcgtcgacggattccgggtggatgccgcgccattcgtaatcggcgaaaccggcatagagcacgcggaccccagggacccccagggctttctcagggaaatgcgcaagctggtcgacgggaggcgccaggacggccttctgctcggcgaagcggacctggcgccggaaaagctgcggtcctatttcggcgacggaaagctcgaccttctgttcaacttcgtgttgtgtgcggctttcgccgcgagcctcgcggggcagaaggccgaccccatcggccaggcgctttcgatcatgccggagccgcctccccatcgcggctgggcgaacttccttcgcaatctcgacgaactgaacctcgatcgcctgccggaagacattcgagaggaaacctttgcagccttcgccccggatgaggagatgcggatctacggacgcggcatcaggcgccgcctcgcgccgatgctggacggaaaccgggcgagaatagaactcgccttcagtctgcttctgtcttccccgggcgtgccgctcattctctacggcgacgagatcggccttggcgaggacctttcccgaccggggcgggagccggtccgcgtgcccatgcagtggaatgcgggttccaatgccggcttctccaccgcccagcgcgccaaactcgtccagccgccggtgacagacggcccattctccttcaagcgggtcaatgtcgaagctcaacgtgaggacccggggtcgcttctgaaccgcgtgcgggcgatgatcctggcgcggcgccggcacgagctcttcaacaggggacgcccggtcatgctgcacaccggagacccggcgctgttcgcgctggcctattccgacggcaccgaactattcgtggtgctgcacaatctttcggacggcaagcggcgggcggagctcgaactgcccggcgcaatcgacgccaggctcaatgacattctcggcgagggtgaggtcgagctttccgggcagcgtctggcgatagggctcggtccgttcggctacgtctggcttcattcgggaaagaaggattgactcgagacccagctttcttgtacaaa

SEQ ID NO: 120 - DNA, 2786 bp, Arabidopsis thaliana
ttaattaagagagaagaagaacgatgaaaggggttctacttgacgaatctgtactgtttagtcctgagagtgaagattcttcgccaagtctgcgagaatcagtcccgtcgcttctcaggctgcttcgttattccatgatccgaacggtaacgactgatttgaattgctatctcaaattccaaaccatgattcttattatctgcattgcagatttccgaaattaaaccctttcatgcaaaatttatagatttgtcttcaattagtgaaattgtatagtgattcttcaattgagagctagatgagaaatgattgaactttatatgcaattcttcttttggtttccacttatcgttcatactgattttctgcaggggatttcatatggacttgatcttccggaaaacaaggtttgagactaactatttcaacttgagcctacgaatgtgatgactattctatgttttaagcaaagagttttgttcaagtcaaatctttgccttgtctaattgtttaactttgttatgagattgatttttctgtaacatgtgataggtggatctactgaggaaaacggcagcagaatactcgatcaattgcttgcctttagagacgtctcttacgagtgttacctttggtgatactctcaaagcatggtatagtgacggtagtattctgtatgttgcttcaagcagaaaggaagagatactgcgtgaacttagtcccagtcagctagttgttttactcggttagtgatgaagataatctctagtcctataagagataacttattcaataattccagcttctgcatttattgtctaaatagtttgctctttgaatgtttaaacatgcttcctgattcgaattatggatcttttcgatttatgaactctcactaataggaaaaagataggcattaaagtttgctacattaaagttctgagtttccttttgtactgataacttttatgaggcacctaactttgttggattttttgggtttctagatgttgaaggcgattcacttgaggatcctaacataattcatatccatagtcttgaggagctgccaatgactatttgctgcataaacaaaaaggtatgtcatgactgcagttctggcttatactagaatacgctcatagttgagaaataagctggtctgtttgaagaaagtactaattgtaggccagaactaaacagtgtaaaaatgtagttcgagatgcttgatattacaccttcattaccattttttggtttgtatatcttgccgattagtattttgaccacccttttgatatcgcctcccaaaacaggcaatgggtgatggtgctgcaatagttgcttacatcatgaagccatctcgggtagaggactttgccaaggttagatccttatttgcaatctgactctgaagtattatatatatggtgatcattgcttagtttttggctctctgtgtgctggtcgtatatatgctttaccctctaggtcattactgattcatgaaagtaatatggatatatatgtaatgttcaccgatgttaaattttctgattttcttagaggggtgctttacccatgtatcctacttcatgtgggttgatatttctgcccctcatgtttgagttccctcttgcatctcaactcaaacacgctgatatcattttccacaaagcaactgatgaaatcttgtccattgaactgaactgctccgactcaaaatcatctgttgcagttacattctctaccggcatggagaaactgaaaaagtaagcttctcaattctttgttttcaatctagcactcagttatatctgcaagtggcgtatagataccatcatacacaaatatgagaaaccttgttaaaaattctccattcaggtttgcataatgatataaggtatttgcaggtatatggaagatcaaaatgcttgtgccatagtcgaccctattcgaaatatatatccagtcgtagaccgactcaagatgcaacatattcttcttggattagagggccttggtgcagcaggacgaaagataagaggtgcctgctttctcaaggtcgtaaaagtcctctcattttgatcaactcgtcaatcttctttatgcttataatcttacatagttatctcttgagacctttagtctggcctcttaacttctccagtttcgcattgatgcttttcttttttactttagcaaattaatatcagagttccttatctgcagattgacagctatgatgaaccagatctggctcagaacttgtcaagagctggactctctcttccatgtattgtgaaaccacaggttgcctgtggtgttgctgatgctcacagcatggtgaatatctcatactttccatctagatttgatatctcgcaatatctgttgctcttttcacagcagaacaaaaaaattcctcgttttcatgtgtttctcacaggccattgtcttccgagtcgaggattttaagaatctgaacactcctgttcctgccattatccaagtaagtcataatgtaatatggatacccaaatctaggggcacactcctaaatcaagatgtcaagcatagaaaaacttctcaaccgatgttttgcaggagtatgtggaccattcatctaggatttttaagttttacgtcttgggggaaacgatctttcacgcggtcaagaaatcgatccctagttcttctagtctgaggaaatcagcggaggaaaatggtctcaaaccaattctctttgacaggcaagatttcataacagttccatgaggcgcgcc

SEQ ID NO: 121 - DNA, 2047 bp, Arabidopsis thaliana
ttaattaagatgttggagaaggttgaaactttcgacatgaacagagtcattgatgaattcgatgaaatgactagaaacgctcatcaagtccagaaacaaactttgaaagagattcttctcaagaaccaatccgccatttacttacaaaactgtggtctcaatggaaacgctactgaccctgaagaagctttcaaatctatggttcctttagtcactgatgttgaattagagccttacatcaaaagaatggttgatggtgacacttcacctattctcactggtcaccctgttcctgccatttccttaaggtaacttcctctttttgctttatcattgatgattctgtttctcagtgtgtgtgtttttgatcatcagctctggaactagtcaaggccgtccaaagtttattcctttcactgatgaattaatggagaacacattgcaactgtttcgcactgcttttgccttcagaaacaggtatagtttaaatttgtgtttatgtttcccccacacacatttcacacttttctctgttccatccattgacatgaacagagaaactagtgatgttgttacttaccaccgactatgccttaacatgtgatgtttttcttcttgtacagagattttcccattgatgacaatggcaaagctttgcaatttatcttcagcagcaagcagtacatatcaacgggaggtgtcccggttggaaccgcaaccacaaacgtgtaccgcaaccctaacttcaaagctgggatgaaatctataacgtctccttcctgtagtcccgacgaagttatctttagtcctgatgtccatcaagccttgtattgccatctcttatccggaattctcttcagagatcaagttcaatacgtctttgccgtctttgctcacggtctagttcacgcttttagaacctttgaacaggtttgggaagagattgttaccgatatcaaagatggtgtcttaagcaaccgtattactgtcccatcggtccgtactgcaatgtcgaagctgctcacacctaaccctgagctagctgagacgatccgcaccaaatgtatgagtttgagcaactggtacggattgattcccgcgctcttccccaacgcaaagtatgtttacgggatcatgactggctccatggagccgtatgtgccaaagctgagacattacgcgggtgatctacctcttgtgagccatgactacggtagctcggaaggatggattgctgctaatgttaccccaaggttatctccagaggaagctacatttgctgtgattccgaatctcggttatttcgagtttctccctgtatctgaaacaggggaaggagaggagaaaccggttggtttaactcaagtcaagattggagaagagtatgaagttgtcatcacaaattacgcaggtattaccgttgttttaaggctggaattagcgtagtatcggtctcgtaatggatgcttataattctcatttgatccacattgcacagggttgtatcgataccggcttggagatgtggtaaaggtcattggtttctacaacaacactccccaactaaaattcatatgcaggagaaacctgattctctcgatcaacatcgacaagaacaccgaaagagaccttcagctttcagtagaatcggctgcaaagagactctcagaagaaaagatcgaggtcatagacttctctagctacatcgatgtctcgacagatccaggacattacgctatcttctgggagatttcaggagaaacaaacgaagacgttcttcaagattgctgcaactgtttagaccgagcattcatcgatgcgggttacgttagttcccggaaatgcaagactattggagccttggagctgagagttgtcgcaaaaggaactttccggaagattcaagaacattttctcgggcttggttcatcggctggacagtttaagatgccaagatgtgtgaagccaagtaatgctaaggttctccaaattctgtgtgagaatgtggtgagtagctacttcagcacagcgttttgactggcgcgcc

SEQ ID NO: 122 - DNA, 2033 bp, Arabidopsis thaliana
ccatacttacacatatccactctatataagtttagttcactaccactaaacccaaccaaagcaaaaacatcacttctctcaacagaatagtttgaggttgtgtgagacaaaaagaaaaccatggagccaactaacgatgctgagacattggaaactcaaggagaggttacaaccgctatttggccgtcatctcaaatcctcaagacgactatcgatattccggggactctcagccatgacggcagatacatccagtacaatctatttgggcatatctttgaactccccgcaaagtataagccaccgattaggcctattggcagaggtgcttgtggcatcgtttggtaatatccttttaacagaattaatagtttcatttcttttcctaatcattttgagcactttagaatgtagatgccatgaccatttttgtgtgtaatttatggtttgggttgataagtttcatctttttatgagaaaagttcaaatcgtttctatcatagagatctctaaacagttattataccattcatgacttttatgttattcttgttacttttaaaatttcctcacttgacacattagtttttacttttctttttaactttttttacagttcggctgtggactccgagaccaatgagaaggtagcaataaagaaaataacgcaagtatttgataacactatcgaagcaaagagaactcttcgtgaaatcaagcttcttcgtcacttcgatcatgagaatgttcgtttgattttataactattgtctcaccttttttcttttattttgttattcattaaaagctaactatgtaatatcatttttctatagattgttgcaatcagagacgtaatcttgcctcctcagagagattcattcgaagatgtttacattgtgaatgaattgatggagtttgacctttatcgaaccttaaaatcagatcaagaactaaccaaagatcatggcatggtgtgtgtttagagttattgtttcttgaaacttaaaaatcattttgattagtgagcttgacacaatcttcaaatttttggcagtatttcatgtaccaaatcctgcgcggattaaagtacattcattcagccaatgtgctacacagagatctaaaaccaagcaatctcctcttgagtacacaatgtgacttaaagatttgtgatttcgggctcgctcgtgcaactcctgagagtaatttaatgactgagtatgttgtcacaagatggtaccgtgcacctgagcttctgttgggctcttctgactataccgcagcaatagatgtttggtctgttggctgtattttcatggaaataatgaaccgtgaaccgctcttcccggggaaagatcaagttaatcagcttcgtttgcttctggaggtagtaaagtaaaaccctttgttgtgccaagatcatattcgttttttgtgattcatgattagcttaaaaagtcttgggacattgttttgcagctcattggcactccatctgaagaagagcttggatcgttgagtgaatacgctaagcgatacataaggcagcttcctacgcttcctcgccaatctttcactgagaaattcccgaacgtgcctcccttagcaatagacttggtggagaagatgctaacatttgatcctaaacagagaatctcaggtcagtttctgtctccatatagcctcttctgcagttttatttggattcttatcatcagttttgccactttgcagttaaagaagcacttgctcatccataccttagctcgtttcacgacattaccgatgaaccagagtgctcagagcccttcaatttcgatttagatgaacatccattctctgaggagcagtttagagagttaatctactgtgaagccctagctttcaaccctgaaaccagcaatgattgaaaaggaccatatctttgatccttgttctgtttttttcttttccttctctgcttttctttgaataatttcccttttcatttcctttaattttttcatctctcagaaattttgttgtgctaa

SEQ ID NO: 123 - DNA, 2466 bp, Arabidopsis thaliana
aacgacgaacaattaaaaaaaaaaaaagctcaccacgatcgtccctctccttggaagatacaatgtggttttgatcattgactgatcttggttctttgcgattcattatcatcatcaatcatggacaacattgccgcgcagttgaagcgtgggatatcgagacaattctcgacaggatcaatgagacgaacattaagccgacaattcacgcgccaaaattctctcgatccacggcgtaacaacatgagattcagcttcggtcgtcaatcttcgcttgatccgatcagacgtagtcctgagtctcttagctgcgagccgcatatgtctgtccccgagaatcttgattcgacgatgcagcttctctttatggcgagtaaaggtgatgttaatggcgttgaggagctgcttaatgaaggaatagatgtgaatagcattgatcttgatggtcgtactgctcttcacattgcttcctgtgaaggtcattatgatgttgttaaggttcttcttagccggagagctaatatcgatgctcgtgatcgttggggtagtacggtgtgttctcttcttcccctgttttaatagtgtttggttttggatgcatccttaaggtgacatttttgacattgttcaggcggctgttgatgcaaagtattatgggaatgttgaagtttataatctcttgaaagctcgaggcgctaaagctccggtatgatatttaaaataaagatgattggtctctatgttttgcttcatcttcaacatttgtttgtcgttgatttttagaaaactagaaagactccaatgacggtagggaatccaaaagaagttcctgagtatgagcttaatccactcgagctgcaagtccgaaaagttgatggcatttcaaaggtttgttgattttcctaattgacaagagccaggtgagattttttgtccgaagtctctcttattctgatgtgtttgtgtttgcttaatttgcagggaacttatcaagttgctaaatggaatggcacgcgagtctcagtaaaaatattcgataaagatagctattcagatcctgaacgagtgtatgcattattcttgaacttctctgtatgattttgtccgtagcatgaagtaatctaacattgtgtttgtctatttccggttcttttttacgagcagaaatgctttcacaaacgaattgactttgctagcaaaagctcggcatccaaatattgttcaatttgttggagccgtcactcaaaatctaccgatgatgattgtagttgagtgtaatccaaaagtaagtacgcattgtttcatacttcatttcagctcattgaatcacaaatgtggcaagcaatcttgtttcattaatcatctcaatttcagggtgatctaagtgtctatcttcaaaagaaaggtcgtctttctccttcaaaagctctgagatttgctcttgatattgctagaggaatgaactacctccatgaatgtaaaccagatccgatcatccactgcgagttaatgccaaagtaagacaaagccgagaacaaattatttaatggcgaaaaaacagtttggataatattttgaaagttttttgtaaggtgccagaaatattttgctagatagaggagggcaattgaagatctctggttttggtttgataaagttgtcaaagattggagaagacagtgcaaaagtagtgaaccacgaagctcaaatcgataagtcaagtaagaaaaaggctgcattttaagttagaaacagattcatatatatatatacaagttagaagcattgttcttgaaagatcctatgcttaccttttgaactgcagattactatatagcacccgaaatttacaaagatgaagtcttcgataaaagggctgatgtgcattcgtttggtgtcattttgtacgaggtagtaacacaaagctttagccttttctttgtaattaaatgtctcggtttcaaactctgcaatgttgttttttggtttcatatgtgaagttgaccgagggagtatctttattccatcctaaaccacctgaagaggttgcagaatcgatttgtatagaaggtaaaagaccaacaatcagaacaaagtcaaagagttaccctccggaattgaaagagtaagcatttcaagatcatcagctattattacatatatgattgttttacaaacattaacatctcaagaatcatatgactatgtaggttgattgaggaatgctggcatccagaaatcagtgtgaggccaatattctctgagattattattcggctcgacaagatagttacaaactgttccaagcagggttggtggaaagacacatttaagttcccttggtaaaaacaaagtttcatcttctttaatctgaatatcaatcctcagttaagtcaaagatttatgttcatcatgttttgtattttcacaggaaatgaaatggaaatattgaatcaatccaatcaa

SEQ ID NO: 124 - DNA, 422 bp, Arabidopsis thaliana
ttaattaaggtctttgattctttcgttgtgtggcatctgaagagttaagaggaagaagaagaacgatggcatggagaggaagcatatcgaagtctatgaaagagcttaggattcttctttgtcaatcttctccagctagtgctcccaccagaacgtttgttgagaagaattacaaagatttgaagtctctaaaccctaaattaccaatcttgatccgtgaatgtagtggagtccagcctcagatgtgggcaagatatgatatgggtgtggagaggtgtgtaaacttggatggtctgacagagccacagattctaaaggcccttgaaaaccttgtgaaatccggagctacaaaggcctaagtttgtttgtttgtttgtttttctctatatgatcccgaataagattaaaccgcaaggcgcgcc

SEQ ID NO: 125 - DNA, 1587 bp, Arabidopsis thaliana
ttaattaacgttgactaaaatgaaagatttcccgatagcaatctcccttctgttcgctctactatcgccggttcttctaccttgctccggcgattccaccggcggcgtcgaggatgattctccagcgaccgtatgtatcgtcgggagtgggatcggaggctcatccgtagctcacttcctccgtaactactctgtttccaccggcttaaatcaagccaagatcctgatgtttgagcgtcacgagatagtcggtggacgcatgaggaccgtcactgtcgccggtgatactttcgaagccggcggttcgattctccatccgaagaactaccacgttaaggatttcgtcgaaaggttcaatctgacggttcgattaccgacgccgattgaagaatcttcagcgattggaatctgggatgggaagagatttgtcgtcaagacattcggttccggtaccaaatttccgtttttggatacgatcgtctcttgggtgaatgatctctacttgttcttacgttatgggttatcactgctgagaatgagcagcttcattgagaatacagttgataatttcttgaagtactatgaaagcttagagtcaagacctatcttcgacaatgttgaagggatgcttaaatggtcaggcttgtacaatctcacaaagctcactctacaggagaaattatctgaagctcagctttctcctttgttagtcaacgagctggttacggttattacaaggataaactatggacagagtgtactcatcagtgggttggcaggtgctgtctctttggcgggttcaggtggaggattatggtctgttgaaggtggaaactggcagatggctgcaaagctcattaatcattcagatgttacgttacacctgaacgagaaaattgaatccatttcatatctcgaaaaccattacgagcttaaatccactaaaggaaacagctacaagtgtgatgtcacagtagttgccacaccattagacgaagtggatattcagttctcacccacgatctcaattcctaagagagaactacaacacacgcacacgacatttgtgagggggcttttaaacccaggatactttgggatgaaatcgctttcagatgttccagctttggtgggaacccttgaagatcctctaattccattctcatgcatctcaattctaaggaaatatagtaaaacagatatgacatacaagatttttacgcgacaacctgcatcagattcgttgcttgatgagctcttcagtaggagaaccgaaaccgttcgaatagactggggtgcatacccaaagtaccacgcgcctgaagttttcgcaccattcatattagatgaccatcacttgtactatgtgaatgcttttgaaaacgcggcaagcacaatggagacaagtgcagtggctggtgagaacattgccagactcataatttccagattcatgacaaaggaatcattatcttcctcggacaaaagaagctgtagttctggtctgcactcagactcataaacaactttggtccccacataaacaaggactattggctgtgtgtgttttgaagaagaaggcgcgcc

SEQ ID NO: 126 - DNA, 980 bp, Arabidopsis thaliana
ttaattaacatcagtttcgttctgcgatactattttgtttaggatagtatggctgaaaaggaagtggtttctgcctcaactttagaatctaagatcactgaggatcatcatgacatctggatccgaggagcgatggaaaagagccgctcctccaacatcagtgttctgaaggatagattcatagctgctgaggattctgctctagtttccaaggatgttgcacaaaaggatattgagattctcttgagacgagtgaaaactgctacagctttattgacttacctgaaatctaaagcgacaactgtggctgctgccgatttggccaatctttcacttgaaactgaccagctccaagatacaatagacgaacatgatgggacttatgtcactgagatgcttcagcatgtagagaccgttacaggcgtcatggagtctctggctaggcgtgcttttatcgccgaatcagaagccgctatcgagaaaggaaaggttgtgctaagccaagaggaaattcaaagaaaggttggccaactcgagaacatgtccgtgaagttagaggacatggaaaagtttgctcttgggaccagtagtattctctgtgaaatgcggcagagggttgatgatttggttgaagagacctctagacagaagcaaagagctactgaaaatgagctggaactcagtcgcgtcaggagagactttgagtctcttaaatcgtatgttacaagtctcattagcgtcagagaaactctcgtctcatccgagaagcagttccaaacaatcgagaggctttttgaacggcttgttgcaaagacaacgcagttggaaagcgagaaagtgcagaaagaagcagaggttcagaaactaatggaagagaatgtaagactgacggctcttgtggataagaaagaggcacagcttctggccatgaatgagcagtgcaaaatgatggccctaagctctatatgatgcggcgcgcc

SEQ ID NO: 127 - DNA, 1091 bp, Arabidopsis thaliana
ttaattaaccattttctgagagcacactttcgttgacttctctttaaccaatgtctttaaccacagtccctacgctcgccatcagatccggaccatccggtcatcactcgatgccggttcttggttttggaaccgccgcttctccgctaccggaaccaacgatgctgaaagagacggtgattgaggctattaagcttggttatcgccatttcgacacctctccaaggtaccaaacggaggagccgatcggcgaagctttagcggaggcggtttcactcggcttagttcgatctcgatctgaattctttgtcactaccaaactttggtgtgctgatgctcatggtggtctcgtcgtaccggcgatcaaacggagtttgaaaaaccttaaactggactatcttgatctttatataattcattggccggttagctcgaaacctggtaaatacaagtttcctattgatgaagatgattttatgccaatggatttcgaagtagtgtggtctgaaatggaggagtgtcagagacttgggctcgcaaaatgcataggagtaagcaatttttcatgtaagaagcttcaacacatactctctatcgcgacaatcccgcctagcgtcaatcaagttgagatgagtccaatatggcaacaaagaaagctaagggagctttgtagatcgaacgacattgttgtcacagcgtactcggtgttgggatctagaggagctttttggggaactcccaaaattatggaatctgatgttctcaaagaaatagcagaagcaaaggaaaaaacagtggcccaggtgagtatgagatgggcttatgaacaaggagtgagcatggtagtgaagagctttaccaaagagagattagaagagaatctaaagatatttgattggtctttgacagaggatgagacacagagaatttcaactgagattcctcagttcagaaacgtccacggagaggtttatacctctaagaaaggtcccatcaaatctgtcgccgagatgtgggacggggagatctgatcactttgtgtgaaaatagcctattgaaaacggcacaattatcattcgtcacggcgcgcc

SEQ ID NO: 128 - DNA, 432 bp, Arabidopsis thaliana
ttaattaagagaaatgcaaacatttgctcctggaacaagagtctaccacctcatcatcatcgtcttcttcttcttcttctgcttatcatcgttcttcgcttcaatcgtcatggctgatgaatataccggagaagcaacgggatcgtcggaagcaaaggttcacatcatctacaccgagaaacctaccgatgaagaacctaaaacctatcatctccgtaccctttcctctgctctcggcagtgaggaagctgcaaaagatgctttgatttacagttacaaggaagctgcttctggtttttcagctaagctcactcctgagcaagtcgctgagatatcaaaacaaccaggtgtgattcaagttgtgccaagccagacttatcagctgcacaaacctggtggtggtggtggtttcaagttgacctaaggcgcgcc

SEQ ID NO: 129 - DNA, 617 bp, Arabidopsis thaliana
ttaattaagttgaattggttgagtttggtggaggaaagaagaagaagaaatgaatgtgagccatgcatcggtacatccagtggaagatcctcctgcagctgcgacggaagtagagaatccgcctcgggtgaggatggatgatatggaaggaatgcctggaacattgcttggtcttgcattgcgtttttttcagttcttgtttgctgctgctgctctttgtgtcatggcttctactagtgattttccttccgttaccgccttctgctacctagttgcagctactggtctgcagagcttgtggagtcttgcactagccatggttgacgtctatgccattatggtcaaacgctctctacagaaccgtcgacttgtgagcttgtttgcaattggtgatggggtgacatcgacgctgacttttgcagcagcttgtgcatcggcaggcataacggttctaatagacaacgatctgaatagctgcgcacaaaaccactgtgttcagtttgaaacatcaacggcattagctttcataagctggttcgctgctttgccttcgtttctcttcaatttctggtctcttgcatcccgttgacacgatactgctcagcaagaggcgcgcc

SEQ ID NO: 130 - DNA, 2034 bp, Arabidopsis thaliana
tcttgaacggttcctgccattaatgtcgaactcttcctaaaccctttttgttcacatttccttctctttctcttcctccgtctctctctgaaaaaccctaattgactcgttgcgattgaaatggatccttgtccattcatccgtcttacaatcgggaacctagctttgaaagttccgttagcggcgaagacaacgagctccgtcgtgcatccgtcgtcttctccttgtttttgtaaaatcaaactcaaaaacttcccgccgcaaaccgccgcaatcccgtacattcctttggagacgactcagtttccggagatccaaaccctagccgccacgtttcatctcagcagctccgatattcaacgcttagcttccagatctatatttacttctaagccttgtcttaaaattttgatctacactggaagagccggcgctgcttgcggcgtacactccggtcgtcttctggcgaaagtctccgtaccgttggatctatctggtacgcaatcgaaaccgtgcgtcttccacaacggatggatatcagtcggaaaaggagctggaaaatcgtcgtcgtctgctcagtttcacctgaatgtgaaggcggagcctgatcctagattcgtttttcagtttgacggcgagcctgaatgtagtcctcaagtcgttcagattcaaggcaatatccggcaaccagttttcacatgcaaattcagttgccggcacaccggtgatcgtactcagagatcaaggttagttttccggccaatcaaatcaaatcaatgttcaccataattatcggaaattgtgatatcaattttttattttatttctaattatgttattttcccgaggaatcaaatcgaaatatacgctttaattagatccactgccaaagattattgcgaaatactgaaatcacattccttgtttttaatttttgctttagtgtacgtatctatcgaaaaaactttactcttatgatatttatccacttttattcattcatagtataaactttagtctatgatatttaaccacttttattcttagtataaaactttactcttatgatatttaaccacttttactctttaaagggaattaatatgattagattaaaataaagttgattaatggtgttttgtttgattgatcagatcattgccgactgagacaagtgtttcacggagctggctaaactcgttcgggagtgagagagaacgtcctgggaaagagcgtaaaggatggtccataacagtccatgacttgtccggttcaccagtggccatggcgtcaatcgtcactccattcgtggcatctcctggaaccgatcgtgtgagccggtcaaaccctgggtcatggcttatactgcgtcccggagactgtacctggagaccgtggggaagacttgaagcatggcgggaacgcggtggagccactgatggtctaggttacagattcgaactcatcccagacggatcaagcggtgcaggaatcgtgcttgcggaatcaaccataagttctcacagaggtgggaaattctcaatcgagttgggatcgtcgccttcttcatcgtcgccaacaagtgtggtgaaccgatcgagaagccgtagaggtgggagtagtggaagcggtggaggagcatcgccggcgaatagtccgagaggagggagcggagattacggttacggattgtggccgtggaacgtgtacaaagggtttgtgatgtcagcaagtgtggaaggtgaagggaaatgtagtaagccttgtgtagaggtgagtgtgcagcacgttagctgtatggaagatgcggctgcttacgtggcgctttctgcagccattgatcttagtatggatgcttgcaggctgtttaatcaacggatgaggaaagagctttgccatgagtcactgagctgaagaaaagacaaggattttcattttttgtttctgaaaattttagagtcacaaatggccttgggaggtttttttcttttttgaaaagaaacttccggtaagggcgctaacaaaataggatgt

SEQ ID NO: 131 - DNA, 746 bp, Arabidopsis thaliana
ttaattaataaaaggtctgcaaaatggttgctcagggattcactgtggatcttaaaaagccccttgtatttcaggttggtcatcttggagaagattatgaggaatgggttcaccaacctatcgcgaccaaggaaggccctcggttttttcagagtgacttttgggagttcttgacacttacagtttggtgggcagttcctgtcatttggttgccagttgtagtctggtgcatatcaaggtcagtaagtatgggatgttcacttccagaaatcgtcccaattgttgtcatgggaatattcatctggacattttttgaatacgttcttcaccggttcgttttccacataaaaacgaagagttactggggaaacactgcacactatcttattcacggatgccatcataagcacccgatggaccaccttcggctcgtctttcctcctactgcaacagcgattttatgctttccgttctggaacattgcgaaggctatctcaactccttcaaccgcacctgcattgtttggtggaggcatgctcggatatgtgatgtacgatgtcactcattattaccttcaccatgcccaacctactagaccagtgaccaaaaatctcaagaagtaccatttgaatcatcacttcaggattcaggacaaaggatttggtataacttcgtcgttatgggacatagtctttgggacacttcccaccacaaaagcccccagaaaagagcaatagtggcgcgcc

SEQ ID NO: 132 - DNA, 869 bp, Pseudomonas fluorescens
aaaaaagcaggctcctgcaggaccatgagcaacacacgtattgcctttatcggtgccggcaacatggccgccagcctgatcggcggcctgcgggccaagggtctggaagctgcacacatccgcgccagcgatccgggtgaagaaacccgcgccaaagtcagcgccgaacacggcatcgaaaccttcgccgacaacgcccaggccatcgacggcgccgatgtagtggtactggcggtcaagccacaagccatgaagctggtgtgcgaagcgattcgcccgagcctgaaaccgaatcaactggtggtgtccatcgccgccggcatcacctgcgccagcatgacggcctggctcggcgaacagccgatcgtgcgctgcatgccgaacaccccggcgctgctgcgccagggcgtgagcggcttgtacgccacaggcaaagtgagcgccgaacagcgtcaacaggctgaagaactgctgtccgccgtgggcatcgccctgtggctgaacgaagagcagcaactggacgcggtcaccgctgtctccggttccggcccggcgtacttcttcctgctgatcgaagccatgaccgccgccggcgtcaaactcggcctgccgaaggaaaccgccgagcagctgaccttgcagaccgcgctgggcgccgcgcagatggcggtatccagcgacgtcgacgcggccgaactgcgccgccgcgtgacctcgccggccggcaccacggaagctgcgatcaaatcgttccaggccggcggcttcgaagccctggtggaaaaagcactcggcgccgccgcgcaccgctcggccgaaatggccgaacaattgggcaaataactcgagacccagctttcttgtacaaa

SEQ ID NO: 133 - DNA, 1082 bp, Saccharomyces cerevisiae
ttcttgtttgttgattaacccttaattaatccgggcgcgcctgatttatcacaagtttgtacaaaaaagcaggctcctgcaggaccactctccctaccatccaattgaaacataagatatagaaaagatgtcaattgtttcactgttaggcatcaaagtcttaaacaacccggcaaagttcactgatccatatgagtttgaaatcacttttgaatgcttagaatctttaaaacatgacttagagtggaaactaacctatgttgggtcctctcgttctctagaccatgaccaggaattggattccattctggtaggccccgttcccgtaggtgttaataaatttgtgttttctgctgaccctccctccgccgagctgattcctgcgagtgaattggttagtgtgactgttattctattaagttgttcttatgacgggagagagtttgttagggtcggttactacgtgaataatgagtacgatgaagaagagttaagagaaaatccgccagcaaaggtacaagtagatcatattgtaagaaatatactggctgaaaagccaagggtaacaaggtttaacattgtttgggataatgaaaatgaaggggatttatacccacctgaacagcccggcgtagatgatgaagaggaggaggacgatgaagaagaagatgacgatgaagatgatgaagacgacgaagatgacgatcaagaagatggagagggagaggcggaagaagcggcagaggaggaagaagaggaggaagagaagactgaagacaacgaaacgaatcttgaagaagaggaggaagacatagaaaatagtgacggcgatgaggaagaaggagaagaagaggtggggtctgtagacaagaatgaagatggtaatgataagaagaggaggaaaatagaaggggggtccacggatattgaatccactccaaaggatgcggcacgttcaacgaattaagaatttatgggttataagattaatggtacctgcaagagaggtacacctcgagacccagctttcttgtacaaagtggtgataaattggagctctgcagagctttcgttcgtatcat

SEQ ID NO: 134 - DNA, 867 bp, Glycine max
aactctttgtttcttgtttgttgattaacccttaattaatccgggcgcgcctgatttatcacaagtttgtacaaaaaagcaggctcctgcaggaccatggactctaacagcgtcgtttcttggccgaggatgccagaaaacatcaacggtttcggcctcaaacagaaccaatccgaagaggttcatgttttagccgttgatgacagcaccgttgatcgcaaagtcatcgaacacttgctcaaagtcttagcctgtaaagttactgctgtggatagtgggctgagagcactgcaattgcttggactattggacgagcagaaaataccctctgaaactaatggttttgtgggtttgaaggtagatctaatcatcacagactattgtatgcccggaatgaccggttatgaattactcaagagaatcaaggaatcatctactttcaaggaaacgcctgtggttattatgtcatctgaaaacgttttgccacgcatagacagatgtttggaggagggtgcagaggatttcatagtgaagccagtgaagttatctgatgtgaagcgtttgaaggattacatgacaacaaaggaggttaggggtgaattaagccaagaagagagggaagggatcaacaagaggaagctattggacacctctgatgtgtcgccatcatcaccaccgtccatttcctcatcaccacttccatcttcactcagctcagtgattgactctccaatcagacggcttaaaatgaccaacactgattgatatactctagcaatttgctgtttttcttttctcattccctcgagacccagctttcttgtacaaagtggtgataaattggagctctgcagagctttcgttcgt

SEQ ID NO: 135 - DNA, 1395 bp, Agrobacterium tumefaciens
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcgaaattcgacgtactgactgtcggcaatgccatcgtcgacatcatctcccgctgcgatgatcgctttctcaacgacaatgccatcaccaagggtgcgatgaacctgatcgacgcggaacgcgccgaactgctttattcgctgatgggaccggcgctcgaagcctccggcggcagcgcgggcaacacggcggcgggcgttgcgaatttcggcggcaaggccgcttatttcggcaaggtggccgaagaccagctcggcgaaatcttccagcacgatatccgcgcccagggcgtctatttcgaaaccaaaccggaaggcacattcccgccgacagcacgttcgatgatcttcgtgaccgaagacggcgaacgctcgatgaatacctatctcggtgcctgcgtcgatctcggcccggaagacgtagaagatgacgtggtggcgaagaccaaggtcacctatttcgaaggttacctgtgggatccgccgcgtgccaaggatgccattcgcgaatgcgcccgcattgcccatgaaaacggccgcgaagtctccatgacgctctccgacagcttctgcgtcggccgctaccgcgacgagtttctggacctgatgcggtctggcacggtggacatcgtcttcgccaacaagcaggaagcgctttcgctttacgaaaccgaggattttgagctggcgctgacgaaaatcgccgccgattgcaagatcgccgcggtgacgatgagcgaagaaggcgccgtcatcctgcgcggcacggaacgtgtgaaggtggaagcctatcccgtgcatgacgtggtcgatacgacgggtgcgggcgatcttttcgccgcaggtttcctcttcggttatacgcaggaccgttcgcttgaagattgcggcaaactcggctgccttgcggcggctgccgtcattcagcaggtcggaccacgccccatgtcatccctgaaggcgctgggcgaaaaacacggccttatttaaaggcttcgccggggtaagcgccccagatttccccctgggataccatttaaatacccagcaaatacccagcaaattggagctctgcagagctttcgttcgtatcatc

SEQ ID NO: 136 - DNA, 972 bp, Zea mays
ttcttgtttgttgattaacccttaattaatccgggcgcgcctgatttatcacaagtttgtacaaaaaagcaggctcctgcaggaccatggaggtcgcgacggcgacggaggcgtctgcgccggcggcaagcggcggcgcggcggggcagagccacccgttcccgtggctagacgctgccatctctgagccctactacttcctgcacctcctcgccttcttctcttactttgcggcccgcagcgcggcgctctccgccgacgacggaggggagctccacgaccgcctcctccgtagggagatccaggcagtgctcgtgttcctggtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctaggccattcaaatcacttgaccccattgcaacttgaaagtctgctaactgaagagccaacatcacgattttggctggtagaattccgaacttcattttcagcaaaatgtgtacaagcaagcagcattctgcctgaactttctatcgtgtactccaacaagaacatctcttttggaacaattgaccttgggcatttcccaaatgctgcagcaaagtttgggatatccatgtgggatcatctccccacttacatattgtttgacaaggtgactgaagtttctcggtttccagaaatcacaagtgaatcaaaagtatttgtgccaaaagttactaagaaacttctttgccagcattttgatctcgacagacgattgattggatacctatccacctgactcgagacccagctttcttgtacaaagtggtgataaattggagctctgcagagctttcgttcgtatcatc

SEQ ID NO: 137 - DNA, 426 bp, Zea mays
ttcttgtttgttgattaacccttaattaatccgggcgcgcctgatttatcacaagtttgtacaaaaaagcaggctcctgcaggaccatgccttcactccagaaagcattgcctccagaacttgctgataatgtgctcaggttatatcgtgaatgcttacggagggcgaagtatattggccatcagaaacacaatacagaacttttagtcgccatggtgagacaacaattcaagaaaaacatgcatgaaactgatccagagaagatacagaaaatgaaggacgatgctgcaaggggccttatcaatcatattctatatgagtccgagaagattacaggacgcaagttttcaggttagctcgagacccagctttcttgtacaaagtggtgataaattggagctctgcagagctttcgttcgtatcatc

SEQ ID NO: 138 - DNA, 541 bp, Zea mays
ttcttgtttgttgattaacccttaattaatccgggcgcgcctgatttatcacaagtttgtacaaaaaagcaggctcctgcaggaccatgtcttggtccgcgcccgacgacatcctcctctccacctccctcgccggcttcttggacaagaaacttattgtcctgctaagagatggacggaaactgcttggcaccctctgctcatttgatcagtttgcaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacgggaagccagagatctgaaagggacgatgaggaaacggatggagttcctggacttcgattaacgagacccagctttcttgtacaaagtggtgataaattggagctctgcagagctttcgttcgtatcatc

SEQ ID NO: 139 - DNA, 1534 bp, Glycine max
acaagtttgtacaaaaaagcaggctcctgcaggaccatgtccctgagcatatgttccacaaactcatctcagccatcacttaatctcaccatagcaaaaaatcatcaccaatcctcaagaatctcattagccattgtggcagacttcaatattcccatctctctttggacctctagacctttcaaacctagcaccaaaaccatgaggttaaatgatgatgaaaccctttccaatctccttgttaatttcatagaagagatccttcattatggctccaacaagcacagtattattccctatatcaagttccccaaacttgattctgtttccaacttccaagacattttcaaccttgcttttctcaccctcttgttcctagtttgcatatatgaagccccttctgatcttcgttctggttgccttagcactttgaaagaacaattggcagggtgtcaatcaaggcaagcatcaaaatttctgatgaaactcttgggttccaacttggaagagcagtggatgcgttctgtgaaccttgcaatcacaaattggatagtggagatccaagaagcacatcacactgatcacaccaccttcagaacaccatctcctctattttcttatgcgttctcaacgtttgggttgtggaaagttcaattgtactgccctgtcataaacatggatgttgtgaatgcaaacaaccacccagctgatgagaggcttcaattctctctcaagtatcagcagcttgaaggtgttcttcaattcaattacaaagtcacaatcagagagaggtgggttgaaatcgtggtgaacattgacaacataagatgcgatgttttcaaactggtaaatgacattctgatgagagaacgaggagcaggtgcagcagaaaaacatttcccttcaagaatctcattgcaactcactcccacaattcaacaacaagtattaaccgtatccgttggcaaatcctcagagaatcctcgaatagagtttggcgtggagaaaggcatagaagcctcattcgagccaccaaatccttacataggacttagcgtatcagcaggagagtccacaactgtgagcttaaagccctggaaattcgagcaatcagttcatggctacagtgcaaacttgaactggtttcttcacgatagcaccgatggcaaggaagtgttctccacaaagccttcaaaggttgcgttgtttaacccaaaatcatggttcaaagacaggtactcaagtgcttatcgtcctttcacgaggcaaggaggggttatctttgctggtgatgagtatggagaaagtgtgtgttggaaagtggacaaaggtgctgtggggaagacaatggagtgggagataaggggttggatatggataacgtattggcctaacaagcacaagaccttctaccatgaaaccaggaggttcgagttcagggaaacggtctacctcaaaattgcatagcttaggagtcacgcataggaatatatcaatcaacttctcgagacccagctttcttgtacaaagtggt

SEQ ID NO: 140 - DNA, 1472 bp, Zea mays
ttcttgtttgttgattaacccttaattaatccgggcgcgcctgatttatcacaagtttgtacaaaaaagcaggctcctgcaggaccatggggatgttcttcagcaaagcggaaccgccgccgcccatggtgctggtgccgccgctcttcgactaccctcccatcgctgcccgcaccaggatggcggtgccagcatatgagctaatgtttgggaaagtctccctgcacaatctgtttgaggactactttgaccaagctgggaatatgacctcaaggatcatgttgaagccgcttgaagatcctcacgttgatttgattgctactgtgtctgctgctgctgatagaaacagtggaacagaagtaaaaggggatgctttatttcgctggcagagagagctggatgacccccatacctttgtggaccttcttgtgtcaacttcaaatcccttgctgcagctgagattatgtgcatatcatcctaagtatcgtattggtgcctttggaacattacctttgctaatggggaacagggtgcgttcagaagactatggggtcatgggtgtaagatatggttcagagaatttatctgttggagcatcctttgtgccaatttccttatccagtgaggtaccctttggtgcatggttggttgggagaaaagggagcttatctgcaggagtacaatacaagccacttagtggcagcaaatatcctatgccatttacagaattggagaactggaattatgcaatcagttatggtgttggctcaactagcccgctcagcccttcattcattttctccctggaacttgccagaagcacacagctaaccgcatcattctatcagcacctggttgttcaaagaagggtaaaaaatccttttgaagatgatcaggttgttggcattacaaactacatcgattttggacttgagttggctgccagggttgataaagataaagtgagtggggatggcaactcgtttcagttggctggaagttggcaagctaacaaaaactttctgctgaagggaaagcttggtccttccacgtcctctgtagctctggcattcaaatcatggtggagaccatcctttacatttagtgtaacagctgtgaatgatcattcaaagggcacaacatcgtatggatttggcctccgtgtcgaggaccttagacgagcgagttaccagcgcgctgatccaaactacgtcatgctgacgccaagcaaggagcacttggcaccaggtgttctgcgggagtacgggaagcggcccatgttccagacacaaatcgattcgggcaactacgaccatctgcctacagagctgaagcctcttggcaggattttctaactgtaggctggctgctcgtggtcgtctttcgctaggagatttttcttctcgagacccagctttcttgtacaaagtggtgataaattggagctctgcagagctttcgttcgtatcatc

SEQ ID NO: 141 - DNA, 2235 bp, Arabidopsis thaliana
ttcttgtttgttgattaacccttaattaatccgggcgcgcctgatttatcacaagtttgtacaaaaaagcaggctcctgcaggaccatgtcggatgatcctggacagatgttgctcatctatgatgatccttcagatcagcgatccttgtctttagatgatgctagtagtactgaggaatctccagacgataacaatctctctttagaagcagttcacaatgccattccctatctcggacaaattttccttacacatgatactgcttacgagttctatagtacatttgcaaagcgttgcgggttctccatacgccgtcacaggacagaaggaaaagacggagttggcaaaggacttactaggcgctactttgtttgtcaccgtgctggtaacacacctatcaaaactctaagcgaaggaaaaccacagagaaacagaaggtcttctcgatgtggatgtcaagcatacttaaggattagtaaacttactgagttaggttcaacggaatggcgtgttactggttttgctaatcaccacaatcatgagctcttagaaccaaaccaagttcgttttcttcctgcgtacaggtccatatcagatgcagataaaagtcggattttgatgttttccaagacaggaatttcagttcagcagatgatgaggctcttggagcttgagaagtgtgtcgagccaggatttttaccattcaccgaaaaggatgtcaggaatttgcttcagtcattcaagaaactcgatcctgaggatgagaacattgatttcctgaggatgtgccaaagcataaaggagaaagaccctaactttaagttcgagtttactttggatgcaaatgataagttagaaaatattgcctggtcgtatgcttcttccattcagtcatatgaactctttggagatgctgttgttttcgatacaacacatcgcttaagtgctgttgagatgccacttggaatatgggttggagttaataactatggtgtcccttgcttcttcggttgtgtgcttctacgggatgaaaatttgagatcgtggtcatgggcactacaggcattcacagggttcatgaatgggaaggcacctcaaacgatattaacagaccataatatgtgtctcaaagaagccatagctggagagatgccagccactaagcatgcactctgcatatggatggttgttggaaagtttccatcctggtttaatgccggtcttggggagcggtacaacgactggaaagctgaattttatcgcctctaccatctggaatccgttgaggagtttgagttgggttggagagacatggtgaactcttttggactgcacacaaacagacacatcaacaacttgtatgcctcacgttccttgtggtctttaccatacctgagaagccattttctagctggaatgactttgactggccgatccaaagccattaacgcctttattcagaggttcttgagcgcacaaacccggctagctcactttgtagaacaagtggctgttgttgtggattttaaagaccaagctacagaacagcaaacaatgcagcagaatctccaaaacatcagcctaaaaactggcgcccccatggaatctcacgcagcctcggtgctcactccttttgcattctccaagctccaagaacagcttgtgcttgctgctcactacgcatcgttccagatggatgaggggtatctcgtgaggcaccacacaaaactcgatggaggaagaaaagtgtattgggttcctcaagaaggcatcataagctgcagttgccaactgtttgagttctctgggtttctctgcaggcacgcactccgtgttctctccacaggaaactgttttcaggtccctgataggtatcttccacttaggtggcgcaggatcagcacgtcgtttagcaagacgttcagaagtaacgctgaggatcatggagagagagttcagcttctgcagaatctggtttcgactctggtctcagaatcggctaaatcgaaggagaggctagatattgcaactgagcaaacctccatcctcttatcccgtatcagagagcagcctgtctcctcacttgctatcagagacatttcttcttctgtgcagaggaatttttgataccacaaatgctatgcgtgtctaactatttttagactcgagacccagctttcttgtacaaagtggtgataaattggagctctgcagagctttcgttcgtatcatc

SEQ ID NO: 142 - DNA, 1077 bp, Zea mays
ttcttgtttgttgattaacccttaattaatccgggcgcgcctgatttatcacaagtttgtacaaaaaagcaggctcctgcaggaccatgtttggtcttcgtgcccgcgcagcggcgcagctccagcgcccaaccccgtctccctcctccgcttcctcggcgtcgttctcgctcgcgaggctcgggtgcgcctccccgctcgccgccctcgcgcctctggcttccgcaccgccgtcgccgtcggccagggagacacagccgacctccctctccgccaggtggcctgccgcgcccatgcgtccctggggaacccgtggccactccaggccgaccacgcgcgttctctgcactgctgccggcagcgtccaaagagaggggaaagaactgctagttcagcatttgcttgttggtgaaaaggatgtcaggcttctggttgatctcgaaaagaatatcattgcagaaggagcagacttgagtgatttagccgtggagcactccttatgtccatccaaagaaaatggtggtatgcttgggtgggttcgaaggggacagatggtaccagaatttgaggaggcagcatttagtgctcctttgaacaaagttgtacgatgtaagacaaaatttggatggcatctagtgcaagttcttgctgagagggatcaatgcgtactgcaagacattgacccagaagagcttcactcaaaattgcaagaccctagttttctcgaagaagctcaattgattgatgttcgggagcctgatgaagtggagaaagcttcacttccaggcttcaaggttctaccgctccgccaatttgggacctggggaccagttatgacagacgagtttaatcctcaaaaggacacttatgttctgtgccaccatggcatgcgctcaatgcaggtggctaaatggttgcagtcacagggtttcaaaaaagtttacaatgttgcgggtggaattcatgcctatgcggttaaagccgactcctccatcccaacgtattagctcgagacccagctttcttgtacaaagtggtgataaattggagctctgcagagctttcgttcgtatcatc

SEQ ID NO: 143 - DNA, 690 bp, Zea mays
ttcttgtttgttgattaacccttaattaatccgggcgcgcctgatttatcacaagtttgtacaaaaaagcaggctcctgcaggaccatggttctaaccagcaatatttcggttcagaagaccttgtacgaggttttatctgtgagtgaagacgctacatacgatgagatccgcgcagcatacaggtctgccgctctgaacacgcaccctgacaaagcgcagacaactctcgagtcatcatccgtgccttccaccgagcaacaggaattttctagcgtgcagaaagcatgggaagtcctacgacatcctacatccagagcatattatgacaagcagctgcagtcatccagacaaagcatcgagatcatcgcatctgaaatccaagtcggggacatgatcgtcgagagcgctgctggtgctctagagctgctgtacccatgcaggtgtggcgattatttctccatcacttcgggtgaacttagcgggatggggattgtcgtcactggggatggagaagaggtagaagggctgcaggcgtcggattccgggtcggcttctgtcgttctgggctgtggctcctgttctctcaaaatacggctggttatagatggaacctcatgactcgagacccagctttcttgtacaaagtggtgataaattggagctctgcagagctttcgttcgtatcatc

SEQ ID NO: 144 - DNA, 434 bp, Zea mays
ttgttgattaacccttaattaatccgggcgcgcctgatttatcacaagtttgtacaaaaaagcaggctcctgcaggaccatgggatccctgggccccacagtgagcttgagcatcatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcgagtacggccttcccgccgacggcgacgtcgacagcaagcgccgcttcgccatgggcgccttcctctggcccgaccagtactgactcgagacccagctttcttgtacaaagtggtgataaattggagctctgcagagctttcgttcgtatcatc

SEQ ID NO: 145 - DNA, 2248 bp, Arabidopsis thaliana
ctgcgcaagaatctaaaccaaatctctcatcctctcttctatgtcccaaaacaggaacataactactactactaccatgtcttgactctgttgagaatcttaaatcctacctaacctccaatgggtaagaagagcggttcttcttcttcttggctcactgccgtgaaacgagctttccgatctcccaccaagaaagaacacaacaacaatgctcatggtaatgaagtcgacgaagatgaagacaaggttcgtatactttctctagtctcgagatcttgcttcttaattcttgtttttttattcacatgctctgtttcttgtttctctgttttgtatattactataattcatatgctctgtttctgcagaagaaagagaagagacgttggttatttagaaaatctacgaatcatgactctccggtgaagacctccggcgtcggaaaagacgctccggcgcagaaatccacagaaacaacgacgatcatcaacccaaccgttttatcctctgttacagaacagaggtacgacgcatctacaccgccggccaccgtctccgccgcatcggaaactcatcctccttcgacaacgaaggagttaccaaatcttacaagacgtacttataccgcaagagaagattacgcagctgttgtaatccaaactggtttcagaggctatttggtgagcaaaattctcccttaactacatttgattaattagtaatcaaacaggttttggatttaactttgaattatataggcaagaagagcattaagagcattgaaagggctagtgaagttacaagcactagtgagaggtcacaatgtgaggaagcaagcaaagatgactttaaggtgtatgcaagctctagttcgagtccaatctcgtgtgcttgaccaacggaaacgcttgtctcacgatggtagtcgcaaatctgccttcagcgacactcaaagtgtgctcgaatctcgttatcttcaagaaatatcagacagaagatccatggtgagtgatctctataagtttcagaacaccattgttgctctgtttcaacgaccatttttgctctgtttcagcaatcagctatataaagctaacattttgaaatgccttttttgttgttgtgtagtcaagagaaggaagtagcattgcggaagattgggatgatcgaccacacacgattgaggaagtgaaagcaatgttgcaacaaagacgagacaatgcgttgagacgtgagagtaacaatagtatatcacaagctttctctcaccaggtaatagatatgaattcatattaatcgtttgtttgttttcggtaatttgattcgtttcggtgtttgatttcggtgaaaggttcggagaacaagaggtagttattctacaggagacgagtatgaagaagagagaccgaaatggttagacagatggatggcttctaaaccgtgggataaacgagcttcaacggatcaaagagtaccaccggtttacaaaaccgtggagatcgatacttctcaaccgtatttaacccgcggtaactcgagaaccggtgcaagtccaagccgtagccaaaggcctagttcaccatcaaggaccagccaccattaccaacaacacaatttctcatcagctacaccatctccggctaaatctagaccgatacaaattcgatccgctagtccgcggatccaaagagatgatcggtcagcgtacaactacacatcaaacacacctagcttgagatctaactatagtttcacagcaagaagtggttatagtgtttgtaccactactactactgctacaaatgctgcattgccaaactacatggcgattacggaatctgctaaggctagaatccggtctcagagtgcaccaaggcaacggccttcaacacccgagaaagaacgtatcagttcagctagaaaacggctttcgtttccagttccaccgctgccgcagcaaatggatggtcagagtttaaggagtccaagtttcaagagtataggtggctcacaattgggtgcattggaacaacaatcaaattactcttcttgttgtactgagtctcttggtggtggtggagagatatcacctgcttctactagcgattataggcgatggttaagatgattccataatccaaccaaatcaaccggtcatgatttttttcctcccttttttttttttgttatatataaataaaaacaatttgacaaaaagaaccataactttttcagtttttattgatga

SEQ ID NO: 146 - DNA, 2281 bp, Arabidopsis thaliana
tttcttctgtaaaaatcttctctttttgccctaatcttctagggttcttcttcttttcatgaatcttagtcttcgatctcttcaaatcttcgtctttcttcttcaaatcttcttcgaattatgtctggaatcttcagatttagtggtatgcttctcaattttagatttgttgttgtgatttgataaggaacttgtggttaggtttctagggtttgatctgatttagtctcatttcgttgatgttgctatgttatgttacattagggtttgttctttgagtgttcttatgttgtgacttgtttgattatatataggtgatgaagattgtttacttgggggatcgatgtatctatcaccagggagctgtcccggtgtatattacccagcgcgtaagaggttacgtgttgctgcgacgtcgttttacagcggttttgaggagaagcaaacttcaatcgatgtattgcctgaagagtgtttatttgagattctaagacgtttaccttctggacaagagaggagtgcttgcgcttgtgtttccaagcattggcttaatcttttgagtagtatcagtaggagtgaagtgaatgagtcatcagttcaagatgtggaggagggtgaagggtttttgtctaggagtttggaggggaagaaggcgacggatttgaggttggcggcgattgcggttgggacgtcgagtcgtggtgggttggggaagcttcagattcgtgggagtgggtttgagagtaaggtgactgatgttggtcttggtgctgttgctcatggttgtccatctcttaggattgtttctttatggaacttgcctgctgttagtgatttgggtttgtctgagatcgcacggtcatgcccgatgattgaaaaacttgacctttcacggtgtcctggaataactgacagtggattggttgctattgctgagaactgtgtgaatctgagtgatctgacgattgattcttgctctggtgttgggaatgagggtttaagggctattgcaagacgttgtgtcaatctgagatctatctctatcaggagctgcccacgtattggtgatcaaggtgttgccttcctcttggctcaagctggttcttacttgacgaaagtgaaactccagatgctgaacgtatctggtttgtctcttgctgttattggtcactacggagcagctgttactgatcttgtgcttcatggacttcaaggtgtgaatgagaaaggcttctgggttatgggaaatgcaaaagggttgaagaaactgaagtccctctcagtaatgtcgtgcagaggtatgaccgatgttgggctcgaagctgttggaaatggttgccctgatctgaagcatgtctctctgaacaaatgcttgcttgtttctggtaaaggacttgtcgctttggccaaatctgcattgtcacttgaaagtttgaaacttgaagaatgccacaggatcaaccagtttggtcttatgggttttctcatgaactgtggctcaaagttgaaagctttctctttggcaaactgtctgggcatcagtgacttcaactcagaatcctctctgccatcacccagttgcagctctttacgttctctgtcaatccgatgctgccctgggtttggggatgcaagtctcgctttcttgggaaagttctgtcatcagcttcaggatgttgaactctgtggactaaacggagtgacagatgcaggtgtgcgcgagttgctacagagcaacaatgttggtctagtgaaggtgaacctgagcgaatgtatcaatgtttcagacaacacagtctctgcaatttctgtttgccacggacgcacattggagtctcttaaccttgacggctgcaagaacatcacaaacgcaagccttgtcgcagtagccaagaactgctactcagtcaatgaccttgacatctcaaatactttggtctcagatcacggaatcaaggccttggcatcttctcctaaccatctgaatcttcaggttctttccattggcggctgctcctcaattacagacaaaagcaaggcatgcatacaaaaactcggccgcacgcttttgggattaaacatccaacgttgtggcagaatcagcagcagcactgtggatactcttctcgaaaatctatggaggtgcgatatactctactaaattcccactttttctacaaaaccttagtatcatcatcatcagtccaagtctttttcctaggttttggtcgctaaaacccatagattccacctagaacttagtttctttctcaggacactg

SEQ ID NO: 147 - DNA, 1985 bp, Arabidopsis thaliana
catacaaaattctaaaagaaacatacatttatgatttaacgcaaacccaaaaagagccttcaccttttttctcttcgtcttcttcaccatcttgtggggaaaaacaaaacttctccggccatggatcctggcgacccaacttcaataatcttttcaaagatcagaactttcgaacttgagaacgcttccagagtcattgactattttctcttgcaagacatggaacaaagagatttgattcgaattgcttttggtcctgactctctcatacagactttctgtcagaaagctaaagtcgatttaggtttttcctcgaacggtttctcgagacccatcaatatccatggccagtcattgtcctcgtcttctcccagaaatgggttcttagagttctcgagaaaccctagtaaccctttgtcttcttcgttaactttgaacacactcagagataataagcctaacttcaattctagtccttttcgtgaaagttcatcactttttgcctcttcttccggcgatgagcagcagcaacaacaattcagtaacaactttctgttcacaaacgacgaggacccatttgccaattctcacaagaggagtttctctgctaacgatgcttgttttgagtcagaggaaccatggtttggaggaggaaatggttgtcatcaatttccacaaggcggtttagttgatggttttggttcctctggtgtctttggatcgccgagtgagatggattacatgcttgaggggatgatgaggatgaagttagctcagcaaaagagcatggttgctgctcagtttatggcggcttgtggctctccaatgttgcataggtaagtttgggattttttgttttctttctctgtgtatgttctgttaggaaagacttaaactttacacaacaagagtagtagcattttagcttgaggcaagtttttttagatggttttggtttgttctcttggttttgttgtatcaagaagttttgagctctgaggcttggttttcctcatggtgattgtttctttgcagacacggatcaggacattttggagaagaatgtggtaactattttagtcaaggaaggcatgaaagagaggattcagtctctaaacagatttacttgacatttccatctgaaagctccttcactgatgaagacgtctcaacctatttcaggtaaatcatgtgttgtgatataatcgggttatagatgtaaggaaggactctgtttggtgtacatttggattagggagtcatgtttctttgttttgactgtcatgtttttttttaatgtgtagagattttggacttgtggatgatgtgaggattccatatcagcagcaaaggatgtatgggtttgtaacttttgctaaggctgaaactgtgagaaccatattagctcgtggaaaccctcatttcatatgtgactcacgtgtgctcgttaaaccatacaaggagaaaggaaaaatccttcaaaagtaatgcttggtccttgttactatttatcatgtttttttctttctcttgggcgttttcttattatagtttggtgaaacaatagcaggaggcagcagcaacaactacacgagttgttggagagagggaactattcaccttcttcaagtccgtctggaaaggactcgagggaactatatgaatgtcgcttaggttggtttcaatttgttaaagagactttagaaaaacaatttcttgtttccttcttactgagatagtaactcttcattctatattcgttaccaggaccaaggatgttttcaaagaagacacaggagatgttgcgaagaaaaaccgagcaagctgatttacaacatgccatagaagtagaactccaaagatgaaggttcttgaatctgcaactacctgacatggagaataaatatattcaccatcaccaccagcgtagtccttctattggttctccctctcatttcccacctcgattcaatcatagtcttctc

SEQ ID NO: 148 - DNA, 2737 bp, Arabidopsis thaliana
atatttagggcttctttcatgttgaatgactctgttctctaatatctgttcttagttattgtttataaagatgaatactcactctgattgattttctttaggttctgcaagaagtaaaacatgtcagttcttattgtgacgagccttggtgatatagtaattgaccttcactcggataaatgccctttgacttgcaagaacttccttaagctttgcaagtaagtgtctctgtgcttatctatgtaagaaacatttatatggtactcattatgtctttacggggttttaactttcttatttggtttaggatcaagtactacaatgggtgtctttttcacactgtgcaaaaggatttcacagcacagactggtgatccaactggtacgggagctggtggagattcaatctacaagtaagttgctgttattttaccttttgatatgtggtctttgtatattttgattactcttttaccgtttgagtcatttaatgtgttgctttcccacctccttgttcgtgttttctctggtcaatgtttgaactttccttaaccaccttgtgcttgttatgttggatttccagatttctgtacggtgagcaggctcgtttttacaaagatgagattcatcttgatttaaaacattcaaagaccggcactgttgcaatggccagtggtggagagaatctcaatgcttcccaggtaagcttaatcatttttgcctgaattactaagtttatgaaatctcttgggaaaagaaatgttctggtgatcgatatgtcctcatgtgaacttttctattctcttttcagttctatttcacacttcgtgatgatttggactatcttgatgggaaacacactgtaagtgcaagataataaatgatctgcctaatctttctttggtatatatcggtcacctttgatatgccattttatgccatttttaggtgtttggacagattgctgaggggtttgacactttgactaggataaatgaagcttatgttgatccgaagaacagaccctataagaacattagaatcaagcacacacatatacttgatgatccatttgatgatcccccacagctggctgaaatgatgccagatgcttcccctgaaggaaaaccgaaagaagaggtcaaagatgacgtgcggcttgaagatgattgggttccaatggatgaagaacttggtgctcaggaactggaggaggttatccgcgaaaaggcagcccattcaagtgctgttgtacttgaaagtgtaagtatcaccgattcaattgtcttgtagctttcttgatgttatatcaaatcatttttaatggaccttgtattgctgtgcagataggagatatccccgaggctgaggtaaaacctcctgacaatgtgctgttcgtctgcaaactgaatccagtgactgaggtaggtgtttgatatttgaaattcgaagcaaagccttcctctgtttgtgacatttttgttcttattttcttgtctcatgcaggatgaagacctccataccattttttcacgctttggaaccgttgtatcgtgagtgatagttccttgattccttattcgtttgagaaacttaattgatgcagttgtattgatcatcatgtattaatgtggcagggctgatgtaatccgggatttcaagacaggtgacagtttgtgctatgcttttataggtgagtaaagtctctgttttgctaagaaaattttggattttatgatttttgtatatagttgtggtgttaactgagagttttgtctctgttctagagtttgagaacaaggagtcatgcgaacaagcgtactttaaggtaaatggcaaatggctgacaagtatgtatagtagagaagttgtgaaacgaattgtttagggggatttaaccaacttgttgatttgcagatggacaatgctctgatcgatgatagacggatacatgtggatttcagtcagagtgtgtccaaactttggtcacagttcaggcaaaaagactcccaaaagggcaaaggtaaatctttttttttttctcctccctatggaataagtgacctgctatagacgaaacaagtaatgaaatccttggcaaacatgaaacagggaatgggtgtttcaaatgcggctcgacggatcatattgccaaggactgtgtgggtggtccgtcttcaaagtttattgtaaaagatcaaaacagacagcacggaggaggtgaaggctatgagatggtgtttgagggtgatgtgcatgaaacccccaagcataatagtcatgagagggagaggagtgagaagattcagaggagaagtcctcatggtaatggggaaggcaaaagacagcacagagatgaacgtgatgatggtagaagacagcatgatcgggaagacgcacgagaactggagaggaaacacagagagagaaaagaaagagagagtagggaagatgaagacagaagaagaagaagacgccgtgaagagtctagagataaagagagtcggagagagagagacgaagatgatcatcggagtcatagagattataaagagaggagaagagagagagacgatagacatggaagagaagctagacatgagagaagggatagatgaaatcatgggcttctcattttaagggatagatgaaatcatgggcttctcatttttgctctatgcggttaaggtttatagtgtttagtgggatttgtattaatgaggtttttgaactacgga

SEQ ID NO: 149 - DNA, 772 bp, Arabidopsis thaliana
tcaactgcttcaacattattccaatctgtcatctctgtttgtcttcacatgtttttaataacttcttctcttccttcttcattcctttaatccatttttctcgatcttggctaatccatcatgactgtcaaggtaaacatcctagtactagttccttttcaaatccgacaccgaatgtttgagtttttgttgtggttgtgagcagaaagttgagatcaaggtggatataaactgtggaaaatgcaacagcgcaatcatggaagcagtcacagagatagaaggtaatgaacgaaaaaagactcaagaaatatgtgctcttaagtcttaacatatcatcttgaacatgagatttggtgcaggtgtgaatcatatttcattagatgaaggaaatagtatacttaccgtggtggggacaatggatccggtctgcgtagcaacaaggctgaaaaagattaaacagaaacctgtgatcattagcgttggaccaccaccaaaacctcctgagccaccaaagcctccagagcctgaaaaaccaaagcctccaccagcacctgaaccaccaaagcatgtatgcaagccaccttactgcaacagttgtgatgttgtgtctgttactacctatgaaagtggaagcggctgcaccattctttgagtcatatatcgcgtaccatagccttcatgttaagtcctgtatttagccaatactaattcatcatgttctcatgcttttttgtttatttctttttctcaaatatgaatctctgttgtttgt

SEQ ID NO: 150 - DNA, 2631 bp, Arabidopsis thaliana
acaaaccctactctggaaaagtcctaattcctaaagctactttcaacaaagacgcctgaagcatctgcctatagtgaaagatcagaagactcttcaaccaaaatcttattctcatccaccatggaagctctcttcacttcaacacacacacccaatttacagactaagcctctcctcaaatctccgctgcccacttcttcccagtcttcgtgttggttttgtaattcgctacccaaaacgcaattcccgaagctgagactcagtaatggatcaagtcacgggcttcgtatacaagctctcttacgtaacgagacgccaagtgaaggtgaagataataatgggtttggtttttttcctggggatatcttctctttatcacaggtactttttctcttgtcttgtgatgaataaattcaactaaagattataacttttgttttgggtatgcaaaaattcagcaaaagattacaattttggacacaaaactttggttttgatgcagagtttgtgtagaatcgaatcttagattagcggaaagatgataccacgtaatggtttgctttgacatagagattaatagcttgtaatgttgtgtgaaggaaaagctcgggagtaatagcaatggtgaaacttctcatagtgtaatcgatgtggaggcatctcttgcacatcctcaaggtggtggaggaaatcgagctgggctttttagaactccaatatctggtggtgttcaaaatgctacatcagctcatgctttacctcggcctgctttagctgtacggaacttgttggaacaggtaaaagggtttgtcctttagatggtttgtattcttccttttttacttcaatgagaaaagattatttaagttctttatctgtcttgtcttgtgtttttatgattcaaggctaggtttgctcatctgtgcacagtgatgtccaaaatgcaccaccgcagggaagggtacccatttggctcattggtagattttgcacctgatcggatggggcgtaagtcactgagtctttctttctttgttgactgctcctagttctacagtgtcttcttttgttgcacgctcaatttttctcagagtatcagtttaattatttgctagtcgacaattggttcttagtcataactcctctaactgtaaaattgatttgatttttgtgggaacgcatagtaggaagtgaagtcaaagttgtttttttccctcttttccttaaatttcattagaggtgtacatgtaggagtgtttttgtatctgtgtattgaaggcaatactgaattataatggtacagttaatgttttgagatacaatagatgctcatttcttgaatggcttctactttttcttatcagatccaatatttttgttttcaccgctggccatccacacacgaaatctcttgaatgaacctagatgcagcctcgttgttcaggtaacattggctattgtgtttaaattatacgagcaaaaggtttaccctttatgttatgtaaccgttgatttggctggcagatacccggatggagtggcttatcgaatgcaagagtgacattatttggtgatgtgtacccattgtcagaggatgaacaggtgggtgtctagttacatttttccttttctatttatggttgtcgatgcatgaatctcaccagccaaacatctgtatgtctgagtaatggctcgtaatatctctggttgtggcttggtaggagtgggcccataagcaatatattgcaaagcacccgcacgggccttcagagcaatggggaaactttcattattttagaatgcagaacataaggtttgttccaaaacttgtgccttccaagttaccaatacttgtcggatgattgtttgtctcctattacttatccactccacactcaatgtgacaattggcagtgatatatatttcattggaggctttggcacggtcgcttgggttgatgtcaaagagtatgaaggtttacaaccagataagatagctgttgatggtggtgagcggaacctcaaggtgcgttgtttcaaatccctgttggtcgccttagagactccaataaacttgctcctcattcttggccttttgtaagctggatttgattcgagtgtgctctaacgtattttccctaaaacttctgataggaactaaatgccatcttctcgaaaccgctgagagagctactgtctactgaatcagaggtagacgatgctgctctcatttcaatagatagcaaaggaatagatgtacgggttcgtcaaggtgctcaggtaaaataacactgtattaattagttttgtccagttgatgtcgacacaattatgatcatgcacagtgcttctcagcttatctttctttgttcaattgtttgttttgtttttttgcagtttaacatacaaaggctagcatttgaggaaggtcatggtgttgagacactagaagaagctaagtctgcattatggaaagtgttggagaaggtcaagctgaatttgcagaaatgacaagccccttttgctactttatacgggtccttttaaaatagtaggaccaataaaatgttgtttggttcctcttttcttcttcttgactagctgaaattttgtagtttctttcttttatct

SEQ ID NO: 151 - DNA, 2321 bp, Arabidopsis thaliana
ttttaaggggttgaagttgtaattttgaagaagttgaagatcaatcaaaaataatagaagaacagagacgacgaaacgaaaccagccggagaactgagcagagaaaaacccccggcgagaatgggaaattcgaattcgtcttctgttgatcatcgcttcatttctgcttccaggtattcatcggaaccaatctccctttcactccctaagttctaaattggaaatcgatcttatcaattgtgtgtttgtgttttgttgcagagcttttactcagaagaagctcgatgatctcaaatctctcttcgtctccctcgcttccaattctcagagcaatgaccaatacgtctcgtaccctgttttccaggttttgacgatttctgtgttctgttcttatctggtttctattgtctgataatttaaattcagcctgtcggatttcgattgtcacaggagtattttggtctgagtggttctttaggagaaaggatgtttgatatggtcactcaacgcaggaaagatgataaaatgacttatgaagatcttgttattgctaaggtacactcaagtctttttatcctcttaatcatttggtttcttcttctgcgtttttgaagatcttataatgcagatttcaataggactataatttctaggactcgatttagaatttgagagattcttgtgttgaactcaattcttattgctttttaggcaacatacgagaaaggaactgacgatgagattgctgagtttatttaccagactttggatgttaatggcaatggggtcttgtcaaggtatccatcttgtgggttcaagttgcttctgtgatccaagtttcattacctgttttgttgtatgtccattactcggtctcttgatccacttaagaacatatttggatagaaactcaattgagattcttagattagatggggtcattctatgaatgtgacacattctagtatgtcttcaggtctgatttagagtcgttcctggtggtgattttgaagagtgtgttctccactgagagttctgatgcggaatcaagtgattacaagaagatggtggatgcgctactcaatgccgctactttctcaaaatctgatgatggttctgaaaaaggaatgtcttttgaagacttcagaagctggtgctcattcgttccaactatcagaaagttcctcggaagcttgcttatgcccccgagtacaggtttattctttgtcttctctcatcttaactcttttcttgttaacaaaattggtaaacattttccttttttcacttttttatatcctctgaaccttgttatatagtgagacctggatatcaagtcccgcatctgctatatgaagatagtgtgagttcagataggctactattaaagaaggaatacgcttggcatattggaggagctcttcctcaccatgagcttgtagagtggaagctgttgtatcacagttccgtacacggtcaaagcttcaacacattcctcggacacacatcgtgagtgtttctcaacagtaacataacatcatttaaacttgactgagtagaatcaagacagaatttgtgtgtataggcttgtaagctaacgtaagatatcttgcagaaacactggtatgtcggcatctgtgctaatcatcaaagacacagaaggatatgtgtatggagggtacgcctctcaaccttgggagaggtacagcgatttctatggagacatgaagtcttttcttttccagcttaaccctaaagcagccatttaccgaccaactggagcaaacaccaacattcaatgggtatggcctctacagacactctgttacttctacatatgagaatgtgattataagcatattctaatataagttcactcggtcgggcagtgtgctactaatttcacatcggagaacattccgaatgggataggatttggaggtaagataaatcactttggcctgtttatatcagcaagcttcgatcaaggccagacattcgaatgcacaacgtttggtagcccgagcctttccaagacgagcagaattcagccagaagtgatagaatgctggggaatcgttcaggcctcaaatgaacaagacaccaaacataacgccatgaaaggtactgttctggagaggtttaaggaagatcgcaacatgctcaaactagtcggcatggcaggcaattcaaatgattgaatagagaatttaggttctgagattcaatcttagatatacactcaacgttcgtatacattgtgagagtgagtgtgcaaaaacattatgtacaataaagagtgttgtatgattcataccatt

SEQ ID NO: 152 - DNA, 518 bp, Arabidopsis thaliana
ttaattaataaaacatggcttacttctccacagcgacatctcttctcctcctcgtcctctctgtttcctctccttatgttcatggagcctccgactgcgacacccttgtgattaccctgttcccatgtttaccttttatatcgatcgggggtacggccgatacacccacagcttcatgctgctccagtctcaaaaatattctcgatacgaaaccgatatgtctatgcgaagggttgaagaaggcacctttaggaatcaaactcaacgttactaaatctgctactcttcccgttgcttgtaaacttaatgctcctccggtgtcagcttgtgattcattgcctcctgctagtcctcctactgctaatgggcaagctccagtatggggatcaggatgggctccagctccaagcccttctaaaggaaattcattgatcccaatctctggcttttcctttgtaatcgttaccgcattggccatgttccgtatctaaaacccgacagccttctagtggcgcgcc

SEQ ID NO: 153 - DNA, 869 bp, Arabidopsis thaliana
ttaattaaaatccatggcttctacttttaggctctctattagcttcctcactctcatcctcttctctctgtgggtagtggaggcacacacgtctagaaagttgatatcaatcaaggaaaaagaaggtcaagatattagtcatttgctcaaagatggtgaatttgatgacccttcgttgtacatgtatttcacactcaatgatctcaaactaggaaccaaattgctgatttacttctacaaaaacgatcttcaaaagcttcctccacttctcacaagacaacaagccgatctcattcctttcactaagtcaaagcttgacttccttctcgaccacttctctatcaccaaagactctcctcaagggaaagccataaaggagactttgggacattgtgatgctaaagctattgaaggagagcataagttttgtggaacttctttggagtcattgatcgatcttgtgaagaaaacaatggggtataatgttgacctcaaggtcatgacgactaaagtaatggtaccggcccaaaattcgataagctacgctttgcataactacacattcgtcgaggctccaaaggaacttgttgggattaagatgttgggatgtcacagaatgccttacccttatgctgtttactattgccatggacataaaggtggaagtagagtctttgaagttaatttggtgacggatgatgggagacaacgggtagtaggacccgctgtctgccacatggacacatccacgtgggacgcggatcatgtagcttttaaggtgttgaagatggagccgaggtcagcaccggtttgccatttcttccctcttgataacattgtgtgggtaacaaagtaagaaaaggcgcgcc

SEQ ID NO: 154 - DNA, 2754 bp, Arabidopsis thaliana
caaagacggtggctttggtgagtttttcagatagtggaaattttgaaatgtctttgtgtttgtatgggaattgatgaatattgctttgtgtgtggttttttgtagctcggtaaatagattatggaacatggtttaccgtctattaaatcatggaagtcacttgttaagagaagaaacaatgctcaagaaggggtaagtcaagctttttttctctgtatctcaccacaatattcctggtttatgctgttgattttgatgtgggaatgctgaaatctgcagggtaaatcgtcatggaaaatgaaaccagttgtggtgctaatgtgtacagtacttttgatcttttggtataagactacaaatattcagtatgaacaaacagaggtattgtggaaaagacagagctatcatgtttagatataacgatgtgattattgatatgtaactctcttttgtttgctatatgcattactcagatagaagaaacagattatccatttgagatggcaaaggtaacatttttgaatatctttgtttctaatgttgatgcattactggtctgaagttgatgtgtgtggatcttgttcaggaatctgaaccggtcagtgaaaagttgaaaggcttaccttttggtatcatgcaacctaaatcagatttggagttaaagccactttggtcaagtagtagtttgaggtcaaaggttagatttttctgtaagctttagatagaggaatcagatatatttgttgctgtaggaagtttctaatagactgttgttgtcttacaacagagcggcgaattgaccaaccgtaacttgttggcaatgccggtaggacttaagcaaaaggataatgttgatgctgttgtaaagaaggtaagtatgcttttgtctagatcagtgaattactgaaaattttctgtttctaatgttagttagtttgttgtattcagtttcttcctgcgaatttcactgtcattctatttcattatgatggaaacatggatcaatggtgggatctagagtggagctcaaaagccatacacattgttgcacataaccaaacaaaatggtatagtgatgtttccaatataaaatctatgaagatcaactatatatatggcttgtaacaatgatatttactcaggtggtttgcgaaacgttttctccatcctgatattgtctccatttacgattatgtttttctttgggatgaagatcttggagtggagaatttcaaccctcaaaagtaaaattccatttacaacttcacttgtgaatttacctgagatcaaatcttggagtgccttttctaagcagtctctctacaggtacctgaggatagttaaaacagcgggactggagatatctcaaccggccttgcacccaaactcaactgaagttcaccatagaattacagtccggtctagaacgaaaatatttcataggtgagttccttgtgattttgtgaaccactttgttaagtagttctcttgataatttgtgtcttcgattacttacacaaaatgataacaaaaccgcaggcgagtttacgatagtagaggcaatatgaaatgttcaaatgctagtgaagggcccccatgcacagggtaaaatttcttaagtagcataacagtttaagacttctctatatgccaaaacacagacattaatgtcattgttttgtctgttttttctctgttttttccagatttgttgaaggaatggctccagtgttttcgagatctgcatggttttgcacttggaatctaatacaagtaattttaagagatgaatgcttataaacaaatatatctgttcttctttaaatgaaattgcatcctacttattgtttttgcggtttgtagaatgatctggttcatggttggggaatggatatgaaacttggatactgtgctcaggtaaagactttttcttctttaagaccttgcaacatcactcgtctccattagcattgtgatccgattgcattctctagatgaatcggttttgaaaatgtcgtttttagggtgaccgtagcaagaaagtaggcattgtcgacagtgaatatatcttccatcaaggcattcaaacactaggtggaagcggttatcccgataagaaggtaagatcatctacttccccacctattctccttgtatgtatacccaaaaccgataaacgaataatctcttcctaatttccacagaactcagctcgcagcggagtaaatagggtaagctacgtaactatccaaatcctcatttgtttactgtaaaacaaacagaaagttcacaactttggtcacttttttcttatgtacagagacgcggttctgcgacttttgattcaagaacagaggtgagttattattacctgatgatgaatctgctttaggaactttctttcgtctatagagcaggagtgtaatgtgtgtgttttgtgagcagatacggagacaatcaacgtgggagctgcaagcttttaaagaacggtggaaccaagcggttgcagaagacaaatactgggtggagcggtcttcaccgagccggaaccgaataggcaataaccggagattaaaaagaagtagtatgattccaagtttattgcagaggaaagctgaagagactacaacataaacagatacagttttaatcagattaaatatagagaaatgtttttttggttggtctcattgttatatataagttaatagttaatcatttacctctctttgattagtgtagttttcatgatct

SEQ ID NO: 155 - DNA, 3100 bp, Arabidopsis thaliana
cccaaaacctctcatctagggtttttctgtctggagaacttagctcacttttgactctgtatctctctgtgtctctcttccccgttagtcttcgtcgtgacctttttgtagtattaagcaatgaagattaagacgttatcaagatcggttgatgaatacactcgagaaagaagtcaggatcttcaggtaatttttgcatatccaattcgtttcccatatcacaaaatttagctttagactatcaataacattatcaattcgtttccagaggggtctttcacaacttcgacccaagtcttcgacctatggagaaggccgtggaataccagagagctcttacagctgccaaattagaaaaggtgtgctcttgagtttcaattttgattgtctgtgttgtttagttatggagcagtccccaaatttggctctgtttttgtttttctgtagatatttgcaaggccgtttgttggagcaatggatggtcatcgtgatggagtctcatgtatggcgaagaacccaaattacctcaaaggaatcttctctgcttctatggatggaggtaattatctaatggcatatttatgtaagctggttgtttgtatccattgatgttactgatactatgtatcgttttcttctctgcagatattcgcctttgggatatctcttcaaggttaaaatcttgaaaacgaaatcccctctgaattaatttgaacttcatttagtattaaaggctttgctttgtgctgtgcttttggtaaatgaattctggaacttgaaacatgcaggcgtacagtttgccaattccctggtcatcaaggtgctgtgcgtggtcttactgcatcaaccgatggaaatgtattggtttcatgcggaactgattgcacgtaagatataataacaatttattgttccagtcggtgatcagatttttggctgttaaactaaggttaatggatttgtgcagtgttcgtttgtggaatgttcctcgtccttcacttgaagattctagcatttcatctgagaatttcattgaggtagttctttcaatattgtattatctggagctttctcttgctggtatataactacaagcttttaacaaactattttttcagccatctgcaacctatgtctggaagaatgctttctggtagacttcgtacacactctttatgcgatttctcatgattctgttggtacaaaaaacttgagttactaagctttttgtcatttctagggctgttgatcatcagtttgaaggtgacctttttgctacggccggagctcaacttgatatatggaatcataataggtactcaggctcctgctaaaagaaatctttggtgtttgttttaattttacgtaagcagggcttatggttttactttttgtaattaggtctcagccagttcagagtttccagtggggaactgactctgtaatatctgttcggtttaatcctggagagcctaatttattggctacatcagctaggtatattctttctactttatacttgtatatgtcatgtaattgtctgtgctacaccttccagagctttctctaacactgtaaggggatatctcttcttccagtgaccggagcataaccatatatgatctccgcttgtcttctgcggcaaggaaaattatcatgatggtatagttgaaacttttttacatattctcgtcatatttaatcattaatacccttcaaactaaacaattgcaaccgtggtctgctaattgcttttcttttggcagacaaaaacaaattcaattgcatggaaccccatggagcctatgaacctgacagctgtaagtgataatcataaagtgaatttttctgtgatgggctatgctaaatcagcgtttgtcttttgcttatgtgctaattttatcccatggggaaactgaataggctaatgaagatggaagttgctatagctttgatggtagaaagttggacgaagccaagtgcgtgcataaagatcatgtttctgcagtgtaagaatgaagaatgatttatctcaagtatcagctataatatttaacaagatatcatccaaatgcattatgattatctaatttcatcatttttcaggatggatattgacttttcaccgactggtcgtgagtttgttacgggttcttatgatcgatctgtgagaatcttcccatacaatggaggacacagcagggaaatctaccatacaaagaggatgcagaggtacaatctactgaacagtctatatatacttcaagttcagatgttctagtgtaccaccttggtaatttgatttagtctaagcaatttctaaatttcatttcttttttcttgtagagtattctgtgtcaaatatagctgtgatgctacatatgtaatatcgggcagtgatgacaccaatctcaggctatggaaggcaaaggcatcagagcaattgggagttgtaagattctgtgaatttatacaaaataaagaccaaaaaagagttaccacaggcttagcagttgatccaatagtgcatatgattatgagatattactcgtacatgctttcttaagaagttttaacttggaacggtgaattgtcaatgttaattggtgtgttgtgctgcagattcttccaagggaacaaaagaagcatgagtacaacgaggctgtgaagaaccggtacaagcatctttctgaggttaagcgcattgtgaggtaaatgaccaatgaaaactgtggttttatcccatgctttaactctggagattgtcaaaagataactatagtaacatggtaacgttttggttattgtgaattacagacacaggcacttgccaaaaccaatatacaaagcgatgggtatcattcgaactgtgaacgattcgaagagaagaaaagaagcacgaaggaaagctcacagtgctccaggaacagtggtcacagcacctctgcgcaaaagaaagatcatcaaagaagtggagtgactctactctttctccgtttgttcctttcaaggatgatgatacgtggagaggattgtattggtatagtgagggtaagattaggaacatgaacatttttgctgtgttgtaagcctttcttta

SEQ ID NO: 156 - DNA, 1531 bp, Arabidopsis thaliana
aaactgtccattctcctccccataaatctatctctctctctttttcctcaaatcccatcttcttcttctacttcttattaagctccattgggtttagagattctggtgtataaactgctaatgacgagtaaccttttccagccaccatcaatggcagcttcacgaggagcaatctcgagaagaacaggaaacgtgaaagtattagtctctttcaccagttctaatggcaaaacgctgagttttagtgacaactcatttaggctcagacccatgttcatcgggaaagtcacagaacagagttcttgttcctccccaaatgaacaacaacaagatgaagaacaagaacaagaacaagaagagattacagtttctcatataaaagaagagctctacgaagctctcaaaggtgattagattcgctcctttcagattcctttcgactatcagaatctttaattcgaaactcattagctcgtagttcaaattttgattttaaatgctttgattctgttatctgattgtattgggattaaagggatcaatagagggatattcggagttaagtcggataaaaagacagagatcgagggactggtgaagcttttggaatgtcggaatccgacaccggagccgactggagagttagacaagatcggaggttgctggaaactcatttacagtacaatcactgtattgggttctaaacgaactaaattgggtcttcgagatttcgtctctcttggtgatcttcttcaacagattgacattgctcaggtagataaaaaagaaattgatcagttcagctttttagtgatgacgtttttaatgtgtttctttttcaattaacgaagggcaaaacggtccatgtgttgaaattcgatgtccggggattgaatctactcgacggcgagtttagaatcgtcgcttccttcaagatctcgtccaaatcggtacattaccgttttcttgacgtttttaggttttttagattcttggaaaaatcgcgttttgacggaattgcgtttgtttgtttgtagagtgtagagattacttatgaaagctcaacgatcaaaccagaccaggtctgtgttgttgtttttttttctttctccgacatatataatcaaattccttttttggtaataaaaaaattgtttcgtgttggaatcagttgatgaacatatttaggaagaacatggatcttcttttgggaatcttcaaccccgagggactattcgagatttcgtatccttttttaattaaaatccaaaatcgtaactagaattgtgtttgttatggattggattccttgattctgagaaattattgcagatacttagacgaagatttacaagtagggagagatgggaaagggaatgtttttgttttggaaagaatagagaaaccttaaatcttttataccaaaatgtttactgcatttttttcaaactcatttccataagaagaaattgcttgtttctcaagaaaattttcaattttttctttggtttgggttatgaccatcagtatt

SEQ ID NO: 157 - DNA, 2526 bp, Arabidopsis thaliana
atcttcgatcttgagctctatttccgggtttatacatttccttcaattcaaaaccttttctttcattgacaaatgatttgaaccaaaaaagttgtttcctttgccaaaatctgaagcgccatgactgaagttcttcactttccttcatctccaagcgcttctcattcatcttcttcttcttcttcttctccttcaccttcttctttatcttacgcctctcgctctaatgcgactctcttgattagctctgaccacaaccggagaaacccagttgctagattcgatcaagatgttgactttcatgcctcaatcgaagaacaagatttgagaagacggagcagtaccgatggaggagaagaagacgatggtggggaagatcagatttcgttgttggctcttcttgttgccattttcaggagatctttgatttcttgcaagagtaaccggagggagctttgtagcatggagattggatggcctaccaatgtcagacacgtggcgcacgttacctttgatcgtttcaatggcttcttgggtttgcctgttgaattcgagcctgaagttcctagaagagctccaagcgccaggtacattgtccaaagatcctacctttttattgaattgctcttaaaagtctcctcacaacaatgatcttgtcctgcaattttggggtgggtgagcagatggatatagaatgcttctgattaaggcttccttgtttcgagttgtagaacctctaagttttggttgtatacagattaaggtttatgtggaattagtgaaaccaaaacgagaagaacttatttgatttttgattcctttatcagtcagtacatgaagtgattagagcacgttcttgtctctctctgttttttcagtctcatagctatgtgtttccgtggaagctaaacacttcatatttacaagattgggctattgagccatgaaccaatgtgttcattcttgcagttatactatagttacttgtcttcaaacatctatatttgatgtcttagatactatctcttagttgttagattctgtgaaggttgcattgttcatccaactatttacatgcttaatcgataagatcaatgttgaaaagggtgaaactgcgcctatgcaattgtaactttgctcttctcggaatatttgttttggaagtataaattgtctctcgtgtgctatcccatctcttacctcttttggtatctcattactttagtgcaacagtctttggggtatcaaccgaatcaatgcaattatcgtatgattcaagaggcaattgtgtaccaaccatactattgctgatgcaaaactgtttatatagtcaaggaggcttgcaggtaatgtacattgcttcatcgagtttactccaaagtgaatatattataagctttccatgtaatcatttcttcatttatttttttaggcagagggcatttttagactcactgctgagaatagtgaggaagaggcggttagggaacaattaaaccgaggatttatacctgagcgaatcgatgttcactgtttggcagggcttatcaaggtatgtaacatatgcacatcttatttccaaaacttatatatgaaccttggtttttaattctggttttcggtttcaggcatggtttagagaactgccgacaagcgttcttgattcgttgtcgcctgaacaggtgatgcagtgccaaacagaagaggaaaatgttgagctcgttaggcttcttccacctacagaagctgctctacttgattgggccatcaatctaatggcagatgttgttcagtatgaacatctaaacaagatgaattcacgcaacatcgctatggttttcgcaccaaatatgacacaggtgagtctgcaacaacaaggttgattatcaatgtttaactcggggtcagatgggataaaatgattgagaaacacttgtattgtagatggatgatccactgacagcactgatgtatgcggttcaagtgatgaactttctcaagacactaatcgaaaaaactttaagagaaaggcaagactcagtggtcgagcaagctcatgcattccctttagaaccgtctgatgagagtggtcaccaaagcccttcacaatctttggcttttaacaccagtgagcagagtgaagagacgcaatcagacaacatcgaaaatgctgaaaatcagagttcaagcagtgagatatcagacgaattaaccctagagaacaatgcatgtgaacagagagaaacagactttggaaaatacagaacaggaagattgagcgactcgagtcaacaggtggtgctgaatctagatcctccagctcagtggccagtgggcagaacaaaggggttgaccaacttgagccgtgtaggatcgagggtagagcgtactgaagcttggcggtgaagaaaaaggagcagagagctccttgaggagacttaagctgttcttcgaaatcaaatgttgtttgattcgttttgtatgtgttaatgtggttctgttggtgtcattgttctatattttttg

SEQ ID NO: 158 - DNA, 851 bp, Arabidopsis thaliana
tagcgtagcgttcacgtagacttccactagttcttgataaaaccccacttcttcccaccactaaatcataaaccattcgatcagaccaaatcccagccgtttaacttgatcatcccaaagatgtttgagattattcaggcggtcttctccgccggggttgcactagctcttttgacattcgccggtataaccctcggcggctcagtggtcgcatgtatcataagcacaccactttttgtcattttcagtcccgttctcgtgccagcgactatagccactacattgctagcttcaggtttcacagcctccggttcctttggtgccacggctttcaccatcctttcgtggctctacaagtaaattattgcaatttggtttacttttattgaaatgtagttttaggcatatgcatctacatgggaacttatttatatgcatgattagacatataatatacatttcaagggatgaacattcggttatatatggtatagttaatagttattgattttgagaatgtataaccttactaaactttatcatgtttggtttaaacctggttcatgttcgattcataatctttagtttatacaaacacaaatcaacgaatttaatttagtaatcagaagtatgtgattgtatgtaggaaacgtacagggagggacctaccaaaaattccaggattgacgccaccggctccggcgtctaacccagcaggttccggcgtctaatccagcagaatcggggaaatacgattaggcgtttcctaatttgggatgatgtatgaaggaacttgatcatactaaattactggggttccataaataaaaataaaaattgatctatcctct

SEQ ID NO: 159 - DNA, 2598 bp, Zea mays
  misc_feature (1)..(87): n is a, c, g, or t
  unsure (1)..(2598): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgatcaacaagcccatccctggttccttatggaggcatcatcttccttgcgcttccaagtttctcgttttagttcgttcaagatatggctatgcctttttctggtactcgttcttcagaactgcagcccagcactttcagattcaccatatttggtcggtatggggagctatgacataacagggccagcagcagacgttaacatgatgggatatgcaaatgctgagcagattgcatcaggaattcactttaggctaaaggctcgtgcctttatcgttgctgagcctaacggcaagcgtgtcgtgtttgtaaatcttgatgcttgcatggcatcacagcttgttactataaaggtgcttgaaagacttaaagcaaggtatggagatctttataatgagaataatgtggctatcagtggaatccatacgcatgctggtcctggtggttatctgcagtatgtagtttatattgttacatcacttgggtttgttcgccaatcatttgatgtgattgtcaatggaattgagcaatgcattgttgaagctcacaacaatctccaccctgggaaaatctatgtgaacaaaggtgacctccttgatgccagtgtgaatcgcagcccaagtgcatatctaaataaccccgctgaagagagaggcaagtataagtacaatgttgataaagaaatgaccctcatcaagtttgtagatgatgagtctggtccgattgggagtttcaattggtttgcaactcatggaacatctatgagtcgtacaaattctttgataagtggtgataacaaaggagcagccgcacgtttcatggaagattgggcagaacaaaatggcattccaaaacaggcagctcatgtaaatcacgatggtttggaatcttcacacatgacctctcgacttccgagaagagtctccccaataattcctgaaccaaatgagataactgatgacttagtacaattggcgtcatcctacgaagcctcaggtggacggcgattatcaagttcaagtatcaccaagcgtatcagaagtacccaacaaaacagacctaaatttgtttctgcattctgccagtcaaattgtggtgatgttagtccaaatgtcctgggaactttctgtatagacactggccttccttgtgacttcaatcacagcacatgcaatgggaagaatgaattatgctatggacgagggccaggatatcctgatgaatttgaaagtacccatatcattggcaataggcaatttcaaaaggctgtagatctttttagttcagcttctgaagaaatacaaggcaaaattgactacaggcatacttacctagatttctcaaaacttgaagtgaatgtccgtacaagtacaggaagtcagcaagttgtgaaaacatgcccagcagccatggggtttgcctttgctgctggaaccacagatggtcctggagcttttgactttaaacaaggagatgtcaagggaaaccctttctggagattagtaagaaacttacttaagacaccagggaaggagcaagtcgaatgtcaagcaccaaaacctatcttgctagacactggtgaaatgaaggaaccatatgattgggcgcctgcaattcttccaattcagatcataagaatcggccagctggctatcttgtgtgtccctggagaattcacaacaatggctggcaggaggctacgtgatgccgtcaaagctgtacttacaagtgacaacagtggtgaatttaataacattcatgttgttcttgcggggctaacaaatacatattcgcagtatattacaacttttgaagaatatgagatccaaagatacgagggagcatcgacgttgtatggcccccacacgttgagcgcctacattcaggagttccagaaacttgctacagccatggtggcaaacaaagaggtcccgacaaattttcagcccccagacatgttggacaagcaaataggactcctcccaggcgttgtgttcgactccacacctcctggggtggagttcggagatgtcagctcagacgtccccgcaagctcaactttcaggaagggcagtgtcgtgaacgctacattctactcggcgtgcccgaggaatgaccttctcacggacggcacgttcgcgctcgttgagaagctggacggcagcaacagctgggttcctgcctacgacgacgacgactggtcactacgcttcaagtggtcgagaccgtcgaagctgagcccgagaagctttgcgacgctggaatggaccgttcctggagacgccccgtcgggcgtttataggttgaggcattttggtgcctccaaaccactgattgggtccatcaaacattttacagggacctctcgggcgttcgcagtgcgttaggttgcacaccgttgcgttgcgttcgacggcacacctgtcagagaatcgacaccgggtcatatatttactttgcatacctgccacagtatatggacatgttttccctatagtttttacatg

SEQ ID NO: 160 - DNA, 2885 bp, Arabidopsis thaliana
ttcttgtttgttgattaacccttaattaatccgggcgcgcctgatttatcacaagtttgtacaaaaaagcaggctcctgcaggaccaaactagttgtgtgtgattgggggaaaaacgttgcaaatgactacaatacccttctgcttcctctttgtagctttcttcttctcttcctccaccgccgatcaacgtcaccactctcgtcacttacttcaccaaccctttttcccggtcgtaaccgccgctccaccaccgtatcaaccacccgtctcttcccaacctccatctccttccccacacacacatcaccaccacaagaaacacctaacgacgacgacgccaccacctcacgagaaacatcttttctcctccgtagcaaatcctccacctcctccgccgtctccgccgcatccaaacccttttttcccttcatcagacccaacttccaccgcctctcaccctcctccagcaccacctcctccggcctcactcccaacttttcccgccaacatctcttcccttctctttccgactcacaacaaacaatccaagcctcccagcaacggccacatcgctaggctcgtcaccataaccgcctccgtcatctccgccgctgctctcctctctctattcgccgtcttcatcatcttcatccgccgaactcgccaccgccgccgctcctcccctgcagacgacaccaaatccacgagatcagacgctcttcagctcttcaacgcctctccttccgacggctctaagaaacagaaacaacatcaacaaccaccaaagtacacttcctcacacacttcctctgagtttctctacttaggtactttagtaaactctcgaagcaatggtttagagcagcaaaagtctccaatctccctctctggcggtatcaccggcgtattggaattacctcctccagcttcgtcgtcttcttcttcttcttactcacagtaccataagctaggctcgccagagcttcgtcctcttccccctttaccaaagctccaatctttcactcccgtttacaaaagcactgaacagttaaaccctaaaagacaagactttgacggagacgataacgaaaacgatgagtttttctctccgagaggatcttcagggcgtaaacagagcccgacccgtgtctctgatgttgatcagattgacaacaggagtatcaacggctcaggctcgaactcgtgttcgccgactaattttgcgccgtcgttgaatgcttctccgggaacaagtttgaaacctaagtcaattagtcctcctgtctcgctgcacagtcagataagctcaaacaacggcattccgaagcggctttgtccagcgaggccacctccaccacctcctccgccgccacaggtctcggaggttccggctactatgtcgcattcccttcctggtgatgattctgacccagagaagaaagtggagaccatgaaaccaaagttgaagactttacattgggataaagttagagcaagctcgagccgtgttatggtgtgggaccaaatcaaatcaaactcctttcaagtgaatgaagaaatgatagagacattgttcaaggtgaatgatccaacttcgagaacaagagatggcgttgttcaatccgtgagtcaggagaatcggtttcttgatccaagaaagtcacacaacattgctattttgttgagagctcttaatgtaactgctgatgaagtatgtgaagctcttatagaaggtaactcggatacgcttggacccgagcttctcgaatgcttgcttaagatggctcctactaaagaagaagaggacaagcttaaggagcttaaagatgatgatgatggatctccttccaagataggacctgcagagaaattcctcaaagcattgttgaacattcctttcgccttcaagaggattgatgcaatgctttacattgtcaagttcgaatcagaaatcgagtaccttaacagatccttcgacactctcgaggctgctactggtgagttaaagaacacgcggatgttcttgaagcttttagaagccgtgctcaagactgggaaccggatgaatataggaaccaatagaggggacgcacatgctttcaagctcgacacgctcttaaaactggtagatatcaaaggcgcggatgggaaaaccaccttattgcattttgtggttcaagagatcataaaatttgaaggagctcgggttccttttactccgagtcaaagccatataggcgataacatggccgagcaatccgcattccaagatgacctagagctcaagaaactcgggttgcaagtcgtttcaggtctcagctctcagctgattaacgtcaagaaagcagcggcaatggattcaaattccctcatcaacgaaacagcggaaatcgccagaggaatagcgaaagtcaaggaagtaatcacggagctaaagcaagaaacaggtgtagagagattcttggagtcaatgaactcgttcttgaacaaaggtgagaaagagatcacagagttacaatctcatggagacaatgtcatgaagatggttaaagaagtaacagagtatttccacgggaactcggaaactcatccttttcgcattttcgctgtggtcagagactttctgacgattcttgatcaagtgtgtaaagaagttggacgcgtaaacgagagaacggtgtatggatccatgccactacattcgccatcgaaccagaccgccacgcctctgtttccggtggttatcaataacaactcacggctaagtccatcgggttctctagacgacgacgatggctcgttctaagtgaaaactcgagacccagctttcttgtacaaagtggtgataaattggagctctgcagagctttcgttcgtatcatc

SEQ ID NO: 161 - DNA, 1302 bp, Zea mays
ttcttgtttgttgattaacccttaattaatccgggcgcgcctgatttatcacaagtttgtacaaaaaagcaggctcctgcaggaccatggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattggcctgggagagcagctgctcggtgcggcccaggcgcgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccccaaagctccgggggagacttgccacatcgttatcgaccatggtggcaatgtgccgtactgggagggccagagctacggcgtcattcctcctggagaaaatcctaaaaagcctggagccccacaaaatgtccggctttattcaattgcatcgactaggtatggagataactttgatgggcgaaccggaagcttgtgtgtccgccgtgcagtttattatgatcctgagactggcaaggaggacccctcaaagaatggtgtctgcagtaatttcctgtgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgccgcatgttcatggaagatgtcccgaactacagatttggtggcttggcctggctcttcctcggcgttgccaattcagacagccttctgtatgacgaagaattcaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactagctcgagacccagctttcttgtacaaagtggtgataaattggagctctgcagagctttcgttcgtatcatc

SEQ ID NO: 162 - DNA, 2454 bp, Zea mays
ttcttgtttgttgattaacccttaattaatccgggcgcgcctgatttatcacaagtttgtacaaaaaagcaggctcctgcaggaccatgcccaaaggatatatccagcaaaaggacagaatgaaagtggtctctatacaccttgctgctgctgttgttgctgttctacttctgttggcggcaaagcgcacccctgctattgcggttcctagccctcaatgccaatggcaatgcggcggcgttgacattgcgtttccgttcggcatcggtgacaactgctcgctatcagcaggattcaacctcagctgccaggaggtccaaagtggcgtctacaggccattccaaggtaatattgaggtgctcaacatctccttgataaatggcacggtccgggagctgaaccccgtctcgacatactgctacgactcctcctctggttccatggagcccagtacctggtcattcgacgcgagcagaaccccgtaccggttttcggacgtccagaacaagttcaccgtcatagggtgccagaccctcgcctacatcacggacaacaccgacaagagctaccagagtgggtgcgtctcgacgtgccagaatgtgtcagacctaacggacggatcctgctccggcatgggatgctgccagacagacatacccaagaagatgggcttctacaacgtaagcttcgaccctgcctccgacacaagccaaatctcacggctgggcctcggcagctgcagctatgccgtgctgatggaggcggaggagttcagcttcagcaccacgtacatcaccaacacgacagctttcaacgacaccaacagtgggagggtgccggtggtgatggactgggcgataagagatgatggcgcgccgtcgtgtgagctcgccacaaggaacgagacgggcacttacgcgtgccgcagcggcaacagcaagtgtgtggaatcccccaatgggccagggtatctgtgcaactgctccgatgggtacgaaggcaacccatatctttcagatggatgccatgatgtcgatgagtgcaagaagaacaacagtccatgcccttcagtaggaggtgtatgccacaacacggtcggagcgtacaggtgttcttgtcgagcaggaagaaagcttaacaagcaaaacaatacgtgtgaccctgataccacattaataacaggggttacaatcggcttccttgttctcgtaatcttctcctccttcggatacatgatcctccagaagagaaaactgaaccaggttaagcaagatcattttcggcagcacggaggcatgattttgttcgagaggatgagatcagaaaatggccttactttcacggtgttcagtgaagctgagcttgtaaaagctacagacagctacgacaagagcagaataattgggaagggaggccatgggacagtctacaaagggatagtcaagggcaacgtgccgatcgcgattaagcgatgtgcgcttattgacgagaggcagaagaaagagtttggtcaggagatgctgatactctcccaaatcaaccacaagaacatcgtcaagctcgagggctgttgcctcgaagtggaagttccaatgctggtctacgagttcgttccaaatggcaccctctacgaactcatccatggcaagaaccaagcgctacagatccccttcagcaccctactgaggatcgcccatgaggcagcagagggcctcagttttctgcactcgtacgcgtctcctccgatcatccatggcgacgtgaagagcgccaacatccttcttgatggcaactacatggccaaagtgtcagattttggggcctccatactagcgccgtccgacaaagagcagtatgtcacgatggttcaaggtacctgtggatacctcgaccctgaatacatgcagacatgccaactgactgagaagagtgacgtctacagcttcggcgtcatccttcttgaggtcctcaccggccaagagcctctcaagttggatgggcctgagacgcagagaagcttgtcatcgaagttcctgtccgctatgaaggagaacaatcttgatgcgatcttgccgagccacgtgaatggtggacaagagagcaatgaattgatcagagggctcgcacagctagccaagcagtgcttggacatgtgtggctgcaacagaccatccatgaaggaggttgccgatgagcttggtagattgaggaagctttcgctgcatccttgggtacagatcaatgcagagatgatagagtctcaaagccttcttagtgggacaacgactgctagctttgaaatagaagttggtacaactgggtatcctacacaggaagctgagaacctgcccatgaacccaagaagttcgtactatgcgaggtagctcgagacccagctttcttgtacaaagtggtgataaattggagctctgcagagctttcgttcgtatcatc

SEQ ID NO: 163 - DNA, 1206 bp, Zea mays
ttcttgtttgttgattaacccttaattaatccgggcgcgcctgatttatcacaagtttgtacaaaaaagcaggctcctgcaggaccatgggcggtggcgccgaccgctcggcgccggtgcgcgccgaggagtccgtctccggcggcgtcgacgtctggagcgacgccgtctcctcccacgcaccggaccacctcctcgtcatggtccacggcatcctcggcagtactgctgattggcaatatggagctaatgaatttgtaaagcaactccctgaccatgtaatcgtgcactgcagtgaaaaaaatgcatcaatgttgactctagatggagttgacgtcatgggggaacgcttagcaaatgaggtgcttgatgtaattagtcgaaggccagaaatcaccaaaatttctttccttgcacactccgttggaggattagcagcaagatatgcaattgcaagactttatagacatccagacagcgtgtctgatggaaatactaaaggaaccatctgtggcttggaaggaataaactttattactgtagcaacgcctcaccttggttcacgagggaacaagcaggttccactcctgtttggatctgttgcaatggaaaaggttgcttgccacatcgttcattggatatttaggagaaccggtagacatctctttctaactgacgatgatgaagggctgcctccactgctgcagcggatggttgaagatcatgacgatctctactttatatctgctttgcgagcattcagaaggagagtggtgtacgcaaacgcagactgtgatcacattgttggctggagaacatcatctattagaagaaacaatgagcttcctgagttgccagtatcgtcgtctgacaagtacccccacattgtacatgaggagcattcagaagaaaccgatgatgataagtggcaagattgcatggcagaatgtgatatggacgttctggaagagaagatggtgacggggcttggaaaggtgtcgtgggagaaggtggacgtgagcttccacagcagcatgacgagcttcgcggcgcatagcatcattcaggtgaagtacgcgttcatgaacgagggagcggatgtgatacagcacatcatagaccacttccagctctagctcgagacccagctttcttgtacaaagtggtgataaattggagctctgcagagctttcgttcgtatcatc

SEQ ID NO: 164 - DNA, 1941 bp, Zea mays subsp. mexicana
ttcttgtttgttgattaacccttaattaatccgggcgcgcctgatttatcacaagtttgtacaaaaaagcaggctcctgcaggaccatggtgaagaggagcaagaagagcaagagcaagcgagtcacgctgcggcagaagcacaaggtgcagcgcaaggtgaaggagcaccaccgcaagaagcgcaaggaggccaagaaggcgggcaaggccggccagcggaggaaggtcgagaaggaccccgggatccccaacgagtggcccttcaaggagcaggagctcaaggcgctcgaggcccgacgcgcgcaggcgctccaggagctcgagctcaagaagcaggcgcgcaaggagagggctcagaagaggaaggcaggattgcttgaggacgaggacattgctagtttggcatctgcagcttccgcacagggcagtgagtttgcagcaaaggagaatgctcccttattagtggcaaagatcaacgatcattcagagaggtctttttacaaggagcttgttaaagtaattgaagcttccgatgtgattatggaggttcttgatgcaagggatccgctgggcacccgttgcattgacatggaaaagatggttaggaaggctgatccaagtaaacggattgtactacttctcaacaagatagatcttgttcccaaggaggcggcagagaaatggcttacatatctaagagaagaattgccaacagttgcttttaagtgcaatacccaggagcagaggaccaagctgggatggaaatcttcaaaattagataaaacaagcaacatcccacaaagcagtgattgtcttggtgccgagaatctaatcaaattgcttaagaattattccagaagccatgagctcaaactgacaattacggtgggtattgttggacttcctaatgttggcaagagcagtctgatcaacagcctgaagaggtcccgagtggtcaatgtcggttctactccagggattactagatcaatgcaagaagttcaattagacaagaaggtaaagttgttggattgtcctggtgttgttatgctcaaatcttccaacagtggtgtgtctgtagcccttcgaaactgcaaaaaggttgagaaaatagaagatccagtcgctcctgttaagcagatcctaagtatttgcccacatgagaagttgctgtctctatacaaggttccaaactttggttcagttgatgattttcttcagaaagtagcaactgtacgtgggaaattgaaaaagggtggtgtagtggatgttgaagctgcagcgagaattgtgcttcatgactggaatgaaggtaaaataccatattttacactgccgcctaaaagagatgctggggaggactcagatgcagtgattatatccgaggatgggaaagaatttaatatcgatgagatttacaaagctgaatcttcatatattggtggtttgaagtccattgaggagttccatcatattgagattcctcctaatgctccactggcgatcgatgaagagatgctagaggatggtggcaagaaaccaagcgaagccatccaggaaagccgggacagggaggagcaaatgcccgacgtgaaggactcaggaggaagcaaggcagccagcgccagcacgcagaacgacaagttgtacaccgccgagggcgtactcgaccctcgcaagagcaaagcagagaagaaacggcgcaaggcgagcaggcccagcgcgctgaacgacatggacgcggactacgatttcaaggtggattatcggatggaggacggtgggagcgagggtgcacacgcggatgatgaagatggcggagatggatccgaggataatgaaccaatgaccggtgtcgatgatgcatgactcgagacccagctttcttgtacaaagtggtgataaattggagctctgcagagctttcgttcgtatcatc

SEQ ID NO: 165 - DNA, 2067 bp, Zea mays
ttcttgtttgttgattaacccttaattaatccgggcgcgcctgatttatcacaagtttgtacaaaaaagcaggctcctgcaggaccatgatgacgcgttgcggtgtacaactcctggtggcacgggggatctcctcatcaccatgcctttctcggaggatcaaccaaacggaaagtgaaattgttcggatgtttcatcctccaattcgtcagagtgaggaagcaatagcaaccattgtgccaaggtacacatattctatgcgtgtcttggatgagaggttcattaggatcctgaagatattcaagtggggccctgatgctgagaaggcgctggaggttctcatgcttagagttgatcactggttggtacgagaggttatgaaaactgacgttggggtcaatgtgaagatgcagttcttcagatgggctgcaaagcggaggaattatgagcatgacacatccacttacatggcattgatacattgtttggaagtagtggagcagtatggtgagatgtggaagatgatccaagaaatggtacggaatcccatttgtgttgttaccccaacagaactttcagatgtagttcggaagctggggaatgctaagatggtcagcaaggcaattgcaatcttctaccagatcaaaacgcggaagtgtcagccaactgcacaggcatataacagcatgataataatgttgatgcatgagggccaatatgagaaagtccatcaactatacaatgagatgagcactgagggtcattgcttcccagacactatgacatatagtgcattgatttctgccttttgcaaattaggtcgacgtgattcagcaattcagttgttgaatgagatgaaggagatcggtatgcagccaactactaagatatatacaatgttaatagctttgttcttcaaattcaatgatgctcatggagcattgagtttgtttgaagaaatgaggcatcagtattgccgaccggatgtgtttacttacactgagctaatcagaggccttggtaaagctggcagaatagatgaagcatatcacttcttctgtgaaatgcagcgagaaggctgcaggccagacacagtttttatgaataatatgataaatttcttaggcaaggctggccgtttgaatgatgctacgaagttgtttcaggagatggaaacgttgcggtgcattcctagtgtggtgacatacaatactatcataaaagcactttttgaatcaaaatctcgtgcttctgaggttccatcttggtttgaaagaatgaaggcaagtggaatctcccccagttcgttcacctattctatccttattgatggattctgcaaaaccaacaggatggagaaggccatgatgctactggaagagatggatgaaaagggtttccctccatgtccagcggcatattgtagcctgattgatgctcttggaaaagccaagcgttatgatcttgcttgtgagctttttcaggaactaaaggaaaattgtggctcgtccagtgctcgggtatatgcagttatgattaaacacttaggaaaggctggacggcttgatgatgctataaatatgtttgacgaaatgaacaaacttggttgcgctcctgatgtttatgcgtacaatgctctcatgtctggattagcaagaacaggcatgattgatgaagctcttagtacgatgagaagaatgcaagagcatgggggtattcctgatatcaattcatacaatattatccttaatgggctggcaaaaacgggaggacctcaccgtgcaatggaaatgctttccaacatgaaacaatctacagtaagacctgatgttgtctcctataatactgtccttggtgccttgagtcatgctggcatgtttgaggaggcatcaaagctgatgaaagagatgaatacattggggtttgagtacgatcttattacatattcatctatacttgaggctattggaaaggttgatcatgaatgtgacccttaactcgagacccagctttcttgtacaaagtggtgataaattggagctctgcagagctttcgttcgtatcatc

SEQ ID NO: 166 - DNA, 1623 bp, Zea mays
ttcttgtttgttgattaacccttaattaatccgggcgcgcctgatttatcacaagtttgtacaaaaaagcaggctcctgcaggaccatgggcgagttctgcccctccccgcagggggactccgcgctggcggcgccgcccttgacgctctcctccccgtccccagcaacggcggttaggccgagctacgggagctgcgaccgccgctacgtgaagctggtcttcgacaacctccacgggagcatctccgtagacccgttggccctgcagtttgttgataccgaggagtttcagaggttgcgggacttgaaacaacttggtcttacatatctcgtctatcctggagcggttcacacacgcttcgaacactcattaggtgtatattcgttggctggaaaggctataaataatcttaagacatatcagggagaagaacttggaattgatcatgttgacatgcagactgtaaagcttgcaggtctcttgcatgatatcggacatggacccttcagtcatttgtttgagcatgagtttcttcctcgagttgatcctggctcatcctggtctcatgaagatatgtcagtgctccttttggacagtattgttgacaaacatgcaatagatattgaaaatggttatctcaaaatggtcaaggagatgataactgccagcgctaagcctaccagcacagaaagtgcaaacgagaagcattttctttatgacattgttgctaatggtcgtaatggtatagatgttgacaagtttgactacgttggccgtgactgcagagcatgtggtcttggctgtaatttccagtattggaggttgttggaaggcatgcgagtgatgggtgatgaaatttgctaccctgccaaagactacttgagcatccataaattgttttcaacacgtgctgatctgcaccgcacagtctacacccatgcgaaagtaaaggctgctgagctcatgcttgtcgatgcactcattgaggctaatgactacttggggatatcattgcatgcacacgacccagaagaattttggaagttggatgacacaatcatcaaaaccattgagactgctcccaacaatgaactgaaaaaagcaaaagaaatcattcaacgtattcgccgaagagaactttacaagttttgcaaccagtattctgttccaaaggacaaactggggcatttcaaaagtattactgcacaggacatagtttgttcgcagaaatcttctgaggtgctgctgaaggaagaggatgttgcagtaagcaatgttaagatagatcttactcgtggaaaagataacccccttgaaagcatcaagttctttaaggattttgggtgcgacgagaagttccccatcacagatgatagggttagccacttgctacctgcatacaacgaggatagaattgtgagggtctatgccaagaagcctgagttggttgatgtggtgtcagaagcctttgagaatctccagatgagaatgtatggtgagaaaactcaagtgcatgagacgcccaagagaaagaggattagatccaactagctcgagacccagctttcttgtacaaagtggtgataaattggagctctgcagagctttcgttcgtatcatc

SEQ ID NO: 167 - DNA, 1223 bp, Zea mays
ttcttgtttgttgattaacccttaattaatccgggcgcgcctgatttatcacaagtttgtacaaaaaagcaggctcctgcaggaccatggtggagctcacctccttatccccagggccaccacgtccttctcggctgactcctcgccgccggccgccgccgccgacacctcatgttcatacctcctcgcgtcgtcgcgggaggatcctcggcgccgcgaccgccacgcctggcgccgacgactaccactccaccatccgctccctcaactcccgcggccgccacgtcccccgaaaatccctcgggcagaactacacgctcaactccaaggtgaacgaggagctggtggcggcggcgggggtggaggagggtgacgtcgtgctcgagatcggcccaggcaccggctcgctcacttccgcgctgctccaggccggcgctaccgtctttgccgtcgagaaggacaagcatatggctactctcgttaaagataggtttggatctacagaacagttgaaggtcattgaagaagacatcacaaaatttcacatccgttcccattttcttcctttcatgaaggagaaatacggtgccaccaaaaaacttgcaaaggttgcatcaaacttaccattcaatgtcagcaccgaagttgtcaaactactactcccaatgggggatgttttctctgtcgtggtgcttatgcttcaggatgaaacagcagtacgccttgcagatgcttcaatacaaagtccagagtaccgatctatcaatgtgtttgtggatttttactcggaacctgaatacaagttcagagtagacagagagaattttttccctcggcctaaggttgatggtgctgttatcagcttcaaactaaagaatgcggaggagtatccgccagttagttccccaaaaagcttcttttcaatggtgaattccgctttcatggggaagcgcaagatgcttaggaaatctcttcagcacatatgctcttcttctgagattgaggctgctcttgacaacattggccttccagttacagctagaccttctgatttgattttggatgatttcgtgagattgcacaatcatttagcgaaagtatgactaagaagtgcctttcaaaatgcctaaggaattgcttgttggcatggtgtctcgagacccagctttcttgtacaaagtggtgataaattggagctctgcagagctttcgttcgtatcatc

SEQ ID NO: 168 - DNA, 1215 bp, Zea mays
ttcttgtttgttgattaacccttaattaatccgggcgcgcctgatttatcacaagtttgtacaaaaaagcaggctcctgcaggaccatgcggcggtccctaccccttctcctcgcgcggcaggtggcgcggcggcggcggctgagcaacgtgccggagtccaccgtctacgggggcccacgcccgcaggagtcctcggcggcgcggcgcgtgacggtgaccacactccgtgggaagcaccgccgcggggagcccatcaccgtcgtcaccgcctacaactacccctcggcggtccacgtcgactccgccggcatcgacgtctgcctcgtcggggactccgccgccatggtcgtccacggccacgacaccacgctccccatcacgctcgacatcatgctcgagcactgccgcgccgtggcccggggcgcgccgcgcccgctcctcgtcggggatctcccattcggctgctacgagtcctccgccgcccaggctgttgactcagccgtgagggtcctcaaggaaggtggaatggatgcgatcaagctggaagggggtgccccatcgaggatcactgcagccaaggctattgtggaggctggaatcgctgtcatggggcatgttggcctcacaccgcaagctattagtgttctcggtggatttaggcctcaagggaagacggttgacagtgctataaaggttgtggagacagcacttgccttgcaggaggctggatgcttctcggttgtgttggagtgtgtgcctgctccagtggcagcagctgcaacatcagcattgaaaatcccaaccattggcattggggctggaccattctgtagtggccaggtcttggtgtaccatgacttgttagggatgctgcaacacccacatcatgccaaggtcacaccaaaattctgtaaacaatttggtaacgtgggcgatgtaatcaacaaggcgctatcagagtacaagcaagaagtggaggctcaggctttccctggtccaagccacacaccgtataagataactcccacagatgttgacggctttgcagatgcactgcagaagatgggtttgagtgaagccgcagatgccgcagccgccgctgctgaaaacagggagaaaggtggagaaccaaaaggagagtagctcgagacccagctttcttgtacaaagtggtgataaattggagctctgcagagctttcgttcgtatcatc

SEQ ID NO: 169 - DNA, 1608 bp, Zea mays
ttcttgtttgttgattaacccttaattaatccgggcgcgcctgatttatcacaagtttgtacaaaaaagcaggctcctgcaggaccatggccgctcgcttcctcctcgtcgttgccgtcgccctcctcctccgccctggggatgcgtccgtgcacgagtaccgcgggctcagcttcgccaacaagggcaacgccttcatcctccacgccggcagcgagggcctctacgcggcctcccacgccaacaccaccgccgaggacgccgccgcagtggccgaagccttcatccggtttgacaagattacttttaggcgatcagaggatactaataattctgtaaaggagactagttcagctaaggttcaggtactcatttttgagatagaagatcgtgaaatgattggtggatcagcatatggaggtcagaaagctatttgttgtacttcagatcttgcgaagttaggagcttgcacagaaggttctgtcatctaccgcccatcccaggtaaatcctggttggccaaagttgtttgtagcatcttttgatggaagtgacctgatcgcgacactaccgtcaaggaccattccaattaccaaaactgggatatacaatatgtactttatacactgtgatccgtcacttgctagtttggaaatcgaggggaaaaccatatggaaaaatcctactggataccttccgggtcggatggcacctcttaagaacttttttggactgatgtcttttgcatttgtcgtacttgggatctattggttttatcagtatatgaagtcctggagagaggttcttccacttcagaactgtattactcttgtgattacactgggcatgtttgagatggcattgtggtattttgagtatgctgagtttaatgagactggagtacggccaaaaggcatcacattttgggctgtcacgtttgggactgtcaagaggacggctgctgaagttattgttctcattgtctcaatgggatatggtgttgtcacgcctactttgggtggcttgacatcaaaagtggtcatgcttggaggaacattctttctagcaacagaaattcttgaattggtagaaaatcttggtgctgttaatgatctatctggaaaagctcgtctgttcttggtctatccagtggccattttagatgctgcatttgttatttggatatttatttctctagctaagaccattggtaaacttcagatttactccaaatcaacagatgtgtttaatgaacgatggcagcatgcccggattattcctgccttctggcatgtcttgtctttcttacttctttgtgtcatttgctacctgtgggcaccttcacaaaactcaatgagattttcttatgatgcaagtgaattctttgatcgaaaggataacatctcattaattaggccagcacccagtgcatccaagaatggatggaatttatcttctacaccagagcccaaagctacaaaggatgtgaataccgtagcagattttgaaggtgatgatgaggaaaacaaaagggagtagctcgagacccagctttcttgtacaaagtggtgataaattggagctctgcagagctttcgttcgtatcatc

SEQ ID NO: 170 - DNA, 1464 bp, Zea mays
ttcttgtttgttgattaacccttaattaatccgggcgcgcctgatttatcacaagtttgtacaaaaaagcaggctcctgcaggaccatgccggtgccgaagccgatggagaggaagcaagccgcctacagcaacctcgatgagaggtacgcgatccagggggagaagtaccaggggcagcagtacagccatatctacttcacgcgcctccaccacatgcggaatctcctccacgccctcgtcccctcctggaagccgcaactccctgtcactacagtgttaggacttgaagaaggaaaggattgcataattgttggaactttatataagcacatgaagttgaagccttcaattcttgatgaatatgccaaagagaggtctgcaattccccttgtcaaaccacataatttcatgcatcctgatgatcatctcattctggaagatgaaagcggaagagttacacttgcaggagccatacctccagcagcattcgtgactggggttgtagtggctctccatgggaaggaaacaagtgctggcaattttcttgtggaagatgttcttgaggctggtcttccaccccaaagtgcattgtctagcgcagaagaagacaagtatgtagtattcatatcagggctaagtgtaggaagtgacacattcaatcctctacagttccaacttcttattgaccatgtcacaggacatctgggtgacgagaatgagcaatccatagcatcaaatatagtacgcattgtggttgttgggaattcagtgcatatttcaccaaggtttgtcaatggtcagacggtaccatcaaaagatcaatcaaggatagcagaacctattaaggaactggatataatgcttacccagctcgtggcttcgttgcctgtagatatgatgccggggtgtcatgatccggcaaatttttctttgcctcagcagcctctgcacagatgccttttctctggggcatccacctacaacactttttcgtcttgttcaaatccccatcaattcgagcttgacagtgtccagtttcttggaacatctggtcagaacatagatgacctgtacaagtactctgatgctaaagacaagctggaattcatggaaagaacactgagatggcgccatcttgctcctactgctccaaatagcctaggctgttatccatacacagacaaggatcctttccttgttgaaagttgcccgcacgtctactttgttgggaatcaagataaatatgaaactcgactgttggaagggcaagaaaaacagaaagtgaggctaatctccatcccaaggttctcggagagtggagttgctgtaatgctcaatctgaggaacttggaatgcagcacattgagtttctcaacaagctttgatgcctgactcgagacccagctttcttgtacaaagtggtgataaattggagctctgcagagctttcgttcgtatcatc

SEQ ID NO: 171 - DNA, 1692 bp, Zea mays
ttcttgtttgttgattaacccttaattaatccgggcgcgcctgatttatcacaagtttgtacaaaaaagcaggctcctgcaggaccatggagatggtgccatggcttctcggcttcctcggcaggtacccggagctcatggtgtccctcgcttgcttcctcctgctgtttcgtaggctgaaccagcgggacgggctgccgacgaactggccggtggttggcgcgctcccggcgatcaccgtcaatgccgggcgcatgcacgagtgggtgacggagttcctgcgcgccgcggggctgtcgtacgtcatgaagggcccgtggggatcgccggtggacgtgatcatgacggccgacccggccaacgtggcgcacgtgttcacgtccaacttcggcaactaccccaagggccaggagttcgccgcgctgttcgacgtgctcggcgacggcatcttcaacgccgacggcgagtcgtgggcgttccagaggcgcaaggcgcacgcgctgctgtcggacgcgcggttccgcgcgggggtcgccgccagcaccgcgcgcaagctccgcgacgctctcgtgccgctcctcgacggcatcgccgcgtcgggcgcggtggtggacctgcaggacgtgttcgtgcgcctcaccttcgatctcaccgccatgttcgtgttcggcatcgaccccggctgcctcgcccctgacttcccctacgtcccgttcgccgccgccatggacaccgtcgaggaggtcctgttctaccggcacgtcgcgcccgtgccgtggctgatgctccagaagtacctcaggactgggcacagcaagaagatgtggaacgctcgacgggtgctcgacgcgtccatcgccgagttcatctcgctccggcgagagcgcgccgccgaggccgaggccgaggccgacctgctcacgtcgtacctggcgtgccacgacgagataggcaagtccggcgccgagctcgagcggttcttgcgcgacaccacgcttaacctcatggtcgccggccgggacacgacgagctcggccttgacgtggttcttctggcttctgaccaagcacccggacgtggaggccaaggtcctcgaggagctccgcgcgcacccgccgttgtccggcgcgggaggccatcgcaccgcggctgagctgaagcagctggtgtacctgcacgcggcgctgtcggagtcgctccggctgtacccgccggtgccgttcgagcacaaggcggcggctcggacggacacgctgccgagcggcgcgcgcgtggggccctcccggcgtgtgatcgtgtcgttctactcgatggggcgcatggaggcggtgtggggcaaggactgctcggagttccggccggagaggtggctgaccgcggcggggcggttccggcacgagccgtcgtacaagttcgtggcgttcaacgtggggccccggacgtgcctcggcagggacctggcgtactcccagatgaaggccgtggtcgccgccgtgctgccgcggttcagggtggaggtggacgccggcgccgtggtgcggcccaagttgtccatcatactccacatgaaggacggcctcaaggtgagggtgcacaagagagaagaagatggcctatgttaactcgagacccagctttcttgtacaaagtggtgataaattggagctctgcagagctttcgttcgtatcatc

SEQ ID NO: 172 - DNA, 1302 bp, Zea mays
ttcttgtttgttgattaacccttaattaatccgggcgcgcctgatttatcacaagtttgtacaaaaaagcaggctcctgcaggaccatgtcattgccgatcgcccttgtagtcggcattgccggtggcgccaccttgctcgcggtggcggccgtgctgctcgcgctctggtgcgctgcgcggatgagggcgcggcgtaaccgcaactccgacactggctcctccgacccctcgacgctagtggagtggggaaaaggggggcgcagctcgttggcaccggacctggagcatcaggttgcgaggcaattctcgctggaggacctggtgcaggccaccaagaacttcagcgacacgaacatcatcggcgcggggagcttcggattggtgtacatgggcctgcttctcgatggcactgttgtcgcgatcaagaggcgcgtgggggcagcgacgcaggtgtttgctgatgaggttaggttgctttcagagattcgtcaccgaaacattgtaactctcattggttactgtcaagaagggggtctacaaatgctggtgtatgagtacctgcccaatggcagtgtctgtggccatctgtatgataacaggaaaggctctgcaacacggcttgagttcaaacaaaggctctcaatagctattggggcagctaaaggtttgaatcatctgcacagtcttgatcctcctttgatacacaaggacttcaagacaaacaatgtgctggttgatgaaaatttcattgcaaaggtggctgatgctggacttgttaggttaattagaggatctgacgatgccggcccatcgcgtgggttcagtaacagtgtttaccaagatccagaggtacagtcgatgactcagttctctgaaagcagtgatgtttacagctttggagtttttcttttggagctaattactggcagggaagcagcttccttgatacctacagagtccagagaatatttggcacactggatggaagcgcatttcagttcaaatgaactgattgacccaagattagccggcaacttcactgcagaaggtatgaaggagcttgttggtctggccttccaatgcttgaacccatcatcaagacgccgaccgaggatgaggcttgttgcgactgaactagaccggattctagagacggagatgtccatgacaacgttcatgggcgacggaaccaccattgtcacgctcgggagtcaattgttctcgtcgtgactcgagacccagctttcttgtacaaagtggtgataaattggagctctgcagagctttcgttcgtatcatc

SEQ ID NO: 173 - DNA, 1878 bp, Nostoc sp. PCC 7120
ttcttgtttgttgattaacccttaattaatccgggcgcgcctgatttatcacaagtttgtacaaaaaagcaggctcctgcaggaccatggcagcagagcatggcttgattctggactttacaactgttctcggtgcttcagctttaggcggatacttagctaaccgattgcggcaacctgttttgctgggttatttagtgactggattggctctagggccttatgggttgaagttgttaagtgatgtaccacgtattcaatctctagcgtcaattggtgtagcttttttgttgtttgctctaggtgtggaattttccttaacagagttgaggcgggtcaagaatattgctattaacggtagcctgttgcaaattggtctaactacagctttggtggcatttttaacaattacgttgggctgggttgataacttgacgcaaggcatttttttaggggtggttctttctctttcttccacagcagtagtcttgaaaactttgggagaacgaggtgaaacaaatacgctccacggtcaagtcatgctagcaattttaattgctcaggatttagcactgggattaatattagcttttttacctgtcctcaaccaaccagaaagacttgtctgggcattaggcatagctttgctgaaagttttgctatttttagcattggcgatcgccttgggtcgttggatagtgccgaagttaatcagtaatgtagcagctacagaaagtacagagttatttgttttaaccgtaatttctttatgtttgagtgtggccttggtgacagcaaaacttggactttctatcgaaatgggtgcatttgtggccgggttaatggtttcggaaatcgaccatgcggatcatgctcttgccaaagttttaccgttaagagatacctttgcttgtctattctttgcttctattgggatgctgatcgatccaattgcactcatgcaaaatttgggtctagttttgggactggtcactttagtcatgttgggtaaggcaattgttgtaatgccaatcattttaaaatttggctactccctcaaaactactatccttaccagtttgggaattaatcagattggagagttttcctttgttctggctttggcaggtttacaactccaactgattcctgaaaaaacctatattttactcttagagacaaccgcaatcacactagttctcactcccatatcgctgaatattgcaccccagttgatagaacgtctcacccagattccgttttttgcccaatcactgcgacaatttacagaacccaacatcctctctattccagaaaccattagtggtcatgttgtggttgcaggttacggaagagtcgggcaagtgattgtcaatattttgctcaatcagggatatgtagtcttagtaattgaaaacagtgaagctgccattcaaagattgagaatgcagcgcatcccctacatttttggagatgctgattccgagctagtgttagaaaaaatccatttagaaactgccaaagccctagcaattgccttacctgatcctgccagttcacgattacttctaaaacgagcattagcgatcgcccctaaattagatgtaattgcgcgatcgcaccatgacaatgaaattgatctgctcacacaaatgggtgcaaaggaagtcgttcaaccagaatttgaagccgccctagaattaagcgcacatctcctatccactttaggagaagcaaaaagtcagattgacacagttatctctgatattcgcaccgacagatatcgtagtatccgaccgaggagatgactcgagacccagctttcttgtacaaagtggtgataaattggagctctgcagagctttcgttcgtatcatc

SEQ ID NO: 174 - DNA, 1866 bp, Escherichia coli K12
ttcttgtttgttgattaacccttaattaatccgggcgcgcctgatttatcacaagtttgtacaaaaaagcaggctcctgcaggaccatgtctgaagaaaaattaggtcaacattatctcgccgcgctgaatgaggcatttccgggcgtcgtgctggaccacgcctggcagaccaaagatcagctgactgtcaccgtaaaggtgaactacctgccggaagtggtggagtttctttactacaaacagggtggctggctgtcggtgctgtttggtaacgacgaacgcaaactgaatggtcattacgccgtttactacgtgctgtcgatggagaagggcactaagtgttggattacggttcgcgtcgaagttgacgccaacaaaccggaatatccgtccgtgacgccgcgcgttccggcggcggtgtggggcgagcgtgaagtgcgcgatatgtacggtttgattccggttggtctgccggatgaacgtcgtctggtgctgccggatgactggccggatgaactttatccgctgcgtaaagacagcatggattatcgtcagcgtccggcaccgaccaccgatgctgaaacctacgagttcatcaacgaactgggcgacaagaaaaacaacgtcgtgccgattggtccgctgcacgtcacttctgatgaaccgggccacttccgtctgttcgtcgatggcgaaaacattatcgacgccgactaccgtctgttctacgtccatcgcggcatggaaaaactggcggaaacccgtatgggttataacgaagtgaccttcctctctgaccgtgtgtgcgggatctgcggctttgcccacagcaccgcctacaccacgtcggtggaaaacgcgatgggtattcaggtgccagaacgtgcgcagatgatccgcgccattctgctggaggtagaacgcttgcactcgcatctgctcaaccttggcctggcctgtcactttaccggcttcgactccggctttatgcagttcttccgcgtgcgtgaaacctccatgaaaatggcagagatccttaccggtgcgcgtaaaacctacggcctgaacttgatcggcgggattcgtcgcgatctgctgaaagacgacatgatccagacccgccagctggcacaacagatgcgtcgtgaagtgcaggagctggtggatgtgctgctgagcactccgaacatggaacagcgcactgtcggcattggtcgtctggacccggaaatcgctcgcgacttcagtaacgtcggcccgatggtccgtgccagcggtcacgcccgtgatacccgcgccgatcacccgtttgtcggctatggcctgctgccaatggaagtccacagcgagcagggctgcgacgttatttcccgtctgaaagtgcgtatcaacgaagtctataccgcgctgaacatgatcgactacggtctggataacctgccgggtggcccactgatggtggaaggctttacctacattccgcaccgctttgcgctgggctttgccgaagcgccgcgcggcgatgatatccactggagcatgaccggcgacaaccagaagctgtaccgctggcgctgccgtgccgcgacctacgcgaactggccgaccctgcgctacatgctgcgcggcaacaccgtttccgatgcgccgctgattatcggtagcctcgacccttgctactcctgtaccgaccgcatgaccgtggtcgatgtgcgtaagaagaagagcaaagtggtgccgtacaaagaactcgagcgttacagcattgagcgtaaaaactcgccgctgaaataactcgagacccagctttcttgtacaaagtggtgataaattggagctctgcagagctttcgttcgtatcatc

SEQ ID NO: 175 - DNA, 826 bp, Zea mays
ttcttgtttgttgattaacccttaattaatccgggcgcgcctgatttatcacaagtttgtacaaaaaagcaggctcctgcaggaccatggcagaggagaagaagaggcacaagcacaagcacaaggagaaggagaaggagaagcagccgggcggcggcacggagcaggcggcgcacttcaagccgtgcggcgacgtgaagggcatccggttcgggggccagttcatcgtgaagtcgttcacggtgcggcgggcgtcgcccctggagctgctgcggctgctgggcatcccgccgtcgtacctgagcgagtgccagagcctgccgttcccgtccaccaccgcctacatgcccacgggcttcaccatcctggcgcaccaggcgtggcacacgctgacgctgggcctgggcaccaacaagtccaaggcggcgctcttcgtgttcgagtccgaggccatgaaggcggccgtggaccgcctgtggcccgccgtcatcccgctcggggacgtcaacaggaggctcatccgcggcctcacgggcagcgagatggcgcgcttcaagttccgcaagggctgcctcaccatctacgtctacgccgtgcgccggctcggcgccgccgggttcatgcgcaccgacgacctcaggcgggtgctgcagtccgtcgtcgagctcaaggacttcctggaccacacagccatgctcgccatcccgagccagaagagcatcaccctgcagtcccggacagcggtggctcactgactcgagacccagctttcttgtaccaaagtggtgataaattggagctctgcagagctttcgttcgtatcatc

SEQ ID NO: 176 - DNA, 1128 bp, Bacillus halodurans
ttcttgtttgttgattaacccttaattaatccgggcgcgcctgatttatcacaagtttgtacaaaaaagcaggctcctgcaggaccatgaaagaaacgttgttaaaaatgttgcttacggctggagatgactttgtttcaggcgaaaaaataagccaagcgattggttgctcacgtacggctgtatggaagcacattgaggagttaagaaaaagcggttatgaagtggaagccgttcaacggaaaggataccgcattgtcaaacgtccagatcaaattaagccacacgacattcaagttgtgctggaaacggaacggttcgggcgtgagattacgtaccttgaatcaacagcatcaacgcaaacggtcgctcttaagctcgctcaagaaggagcaaaggaaggtcatattgttctcgcaaatgagcaaacgtcaggaaaaggccgaatgggaagaggatggtactcaccaccaggttcaagcatttccatgagcatcattttccgcccgcaactgccgccgcaaaaagcaccgcaattaacgttgctaacagccgtggcgatcgtgagggcgatcaaggaaacgacagggttagattccgacattaaatggccgaatgaccttttaatcgatggaaagaaaatcgtcggaatcttaaccgagatgcaagcggatcaagactctgttcattcggtcattcaagggattgggattaacgtaaaccatcaggaagaagcgtttgcagaagaaatccgcaaaatcgccacttcccttgcgataaaaaaaggagaaccgattcaacgtgctccactcatcgcagctattttaaaaaacattgagctgttttacgacctttatctccaacacggcttttcccgaattaaacctttgtgggaagctcatgccattagcatcggtaagcgaattcgtgcaagaatgctaaacgacgttaaatttggagtcgcgaaagggattaccgatgatggtgttcttttgctagaggatgatgatggaaagcttcattcgatttattctgcagatatagaaattgaccaatagctcgagacccagctttcttgtacaaagtggtgataaattggagctctgcagagctttcgttcgtatcatc

SEQ ID NO: 177 - DNA, 1257 bp, Agrobacterium tumefaciens
ttcttgtttgttgattaacccttaattaatccgggcgcgcctgatttatcacaagtttgtacaaaaaagcaggctcctgcaggaccatggcctatgaccagaaacgcgttgtcgacgccatccgcgcattcgaagccggcgaaatcgttgtcgtgaccgatgatgacgaccgcgagaacgaaggcgatctgatcatttcggcggttcactgcacgccggaaaaaatggcgctgatcgtgcgccatacatccggcatcgtctgcgcgccgatgccgcgcgaagaagcgaagcgtctgaacctcaacgccatggtggcggaaaacgacagcgcccacacgacggccttcaccgtcagcgtcgatttcaagcacggcacaacgaccggcatttccgccgatgaccgcaccctaacggtgcgcaatcttgccaatcccaatgtcggcgcttccgacttcacccggccgggccatattttcccgctgatttcccgcgaaggcggcgtgttgatgcgttccggccacaccgaagcggccgtcgatctctgccggctcgccggcctgccgcccatcggtgtcatcagcgagcttgtgaatgatgatggcagcgtgatgcgcggcccgcaggttctggatttcgccgacaaacacggcatgaaacatgtgtcggttgccgacctcatcgcctatcgccagcgcaaggaaacactggtggagatggaatcctccttcaccatcgagacgcccttcgggccggccatggcgcagacctattccctgccctgggacccgatgcagcatatggcggtgattttcggcgacatcagggacggcgtcgacattcccgttcgcctgcatacggaaaatgtcgccgacgacgtattcggcgaccgtcagccagtgcggcattacatgcagaagatcgctgaagaaggccgcggcgtcatcgtctatctgcgcgagggctccgtcggcgtcggccaggtcgccggacgccgcaaggcgcgtgatcccgatgaagcgcatgcgcaggcccgctctcgcgagaatgaatggctggaaatcggccttggcgcacaaattctcaaagacctcggcatcagctccatcaagctgctgacaacccgcgaacgccattatgtcgggcttgaagggttcggcatccagatttcggcgacggatatctgctgactcgagacccagctttcttgtacaaagtggtgataaattggagctctgcagagctttcgttcgtatcatc

SEQ ID NO: 178 - DNA, 1569 bp, Chlorobaculum tepidum
ttcttgtttgttgattaacccttaattaatccgggcgcgcctgatttatcacaagtttgtacaaaaaagcaggctcctgcaggaccatgatgatcatgcctgtcattctttccggcggttccggaacgaggctctggccgctttcgagggcgatgtatccgaagcagcttttgccgctcttcggcgaaaaaaccatgcttcaggatacggtgctccgggtcgggtcgattgagggtgtcgggccggtcatctgcgtctgcaatgatgagcaccgctttctggttgccgagcaactccgacagatcggggtggccgagcaggcgatcattctggagcctttcgggcgcaatacggcgccagctgccgctattgcagcgctggtcattgctgcgacccatcccggcgcgctcatgctgcttctgcctgctgatcacgttattctcgacaggcaaggctttgttgcctcgattgaatcggcacggagcgcggctgagtccggcagtctggtgactttcggcatcgtaccgtccacgcctgaaacgaggtatggctatatccgggcggttgccggttctacgggagtgacccgtcctgtcgctgaattcgtcgagaaaccatcccttgagcgggcggaaggctacgtggtttcaggcgactatttctggaacagcggcatgttcctgttccgtccagaaatctatctcgctgagcttgaagcttcctcgcctgaaatactcgacgcatgccgcaaatccctcgaaaatgcccggcgtgatctcgactttctgaggctcgatcctgaggcctttgcagcctgtcccgcaaattcgatcgactatgccgtcatggaaaaaacttccaacgcagtggttgtgcccatgcaggcaggctggcgcgatgttggtgcgtggtcggcactttgggaggcccaggaacgcgatgccgagggcaacatcaaacgtggtgatgtgctgacgcacggagtccggaacagctacatccacgccaccagccggctagtggcggcagtcggcctcgaagagcacgtgatcgtcgaaaccgccgacgcggtgctggttgcttcaaaagagcgggtgcaggaggtcaaagccatcgttgagcaactgaagttgcagaagcgcgaagagccgctgatccaccggcgggtttaccggccatggggttcatacgaaaccgtcgatgagggcgaacgcttcaaggtcaagcgcattacggtcaagccgggcgcggcgctttctttgcagatgcacagcaggcgcgctgagcactggatcgtggtgactggcagggcgctggtgacggtcgggaaaaaacaggtgccgctggaggcgaaccagtcgatctacattccggtcgaagagcttcaccggctcgaaaatcccggcgacgagccgctcgaactcattgaagtgcagtcgggcggttacctcggcgaggacgacatcgttcgctttgaagatcactacggccgactgtgactcgagacccagctttcttgtacaaagtggtgataaattggagctctgcagagctttcgttcgtatcatc

SEQ ID NO: 179 - DNA, 1122 bp, Escherichia coli K12
ttcttgtttgttgattaacccttaattaatccgggcgcgcctgatttatcacaagtttgtacaaaaaagcaggctcctgcaggaccatgaaggataacaccgtgccactgaaattgattgccctgttagcgaacggtgaatttcactctggcgagcagttgggtgaaacgctgggaatgagccgggcggctattaataaacacattcagacactgcgtgactggggcgttgatgtctttaccgttccgggtaaaggatacagcctgcctgagcctatccagttacttaatgctaaacagatattgggtcagctggatggcggtagtgtagccgtgctgccagtgattgactccacgaatcagtaccttcttgatcgtatcggagagcttaaatcgggcgatgcttgcattgcagaataccagcaggctggccgtggtcgccggggtcggaaatggttttcgccttttggcgcaaacttatatttgtcgatgttctggcgtctggaacaaggcccggcggcggcgattggtttaagtctggttatcggtatcgtgatggcggaagtattacgcaagctgggtgcagataaagttcgtgttaaatggcctaatgacctctatctgcaggatcgcaagctggcaggcattctggtggagctgactggcaaaactggcgatgcggcgcaaatagtcattggagccgggatcaacatggcaatgcgccgtgttgaagagagtgtcgttaatcaggggtggatcacgctgcaggaagcggggatcaatctcgatcgtaatacgttggcggccatgctaatacgtgaattacgtgctgcgttggaactcttcgaacaagaaggattggcaccttatctgtcgcgctgggaaaagctggataattttattaatcgcccagtgaaacttatcattggtgataaagaaatatttggcatttcacgcggaatagacaaacagggggctttattacttgagcaggatggaataataaaaccctggatgggcggtgaaatatccctgcgtagtgcagaaaaataactcgagacccagctttcttgtacaaagtggtgataaattggagctctgcagagctttcgttcgtatcatc

SEQ ID NO: 180 - DNA, 1824 bp, Escherichia coli K12
ttcttgtttgttgattaacccttaattaatccgggcgcgcctgatttatcacaagtttgtacaaaaaagcaggctcctgcaggaccatgaacgttaattcatcgtcaaatcgtggcgaagcgattctcgccgccctgaaaacgcagttccccggcgcggtgctggatgaagagcgacaaacgcctgaacaggtcaccattacggtgaaaatcaatctgctgcctgacgttgtacagtatctttattatcaacatgatggctggcttccggtcctgtttggcaacgacgagcggacacttaacggtcattacgcggtttattatgccctttcaatggaaggggccgaaaaatgctggattgtggtgaaggcgctggtcgatgccgacagtcgggagtttccgtcagtcacaccgcgcgtccctgccgcggtctggggcgagcgagaaattcgcgatatgtacgggctgattccggttggcctgccggatcagcgtcgcctggtgttgcccgatgactggccggaagatatgcatccgctgcgcaaagatgcgatggattatcgactgcgccctgaaccgacgactgattccgaaacgtatccgtttatcaatgagggcaacagcgatgcgcgggtgatccctgtcggcccgctgcatatcacctccgatgaaccgggtcacttccgcttgtttgtggatggcgagcaaattgtcgatgctgattaccgcctgttttatgtccatcgcggcatggagaaactggcagaaacgcggatgggctacaacgaagtgaccttcttatcggaccgcgtgtgtgggatttgcggttttgcccacagtgtggcctataccaattcggttgaaaatgcactggggattgaggtgccgcaacgagcacatactattcgctcgattctgctggaagtcgaacggctacacagtcatttgcttaaccttggcctctcctgccatttcgttggttttgataccggctttatgcaatttttccgcgtgcgggaaaagtcgatgacgatggcggaattgctgatcgggtcgcgtaaaacctacggtctgaatctgattggtggtgttcgccgcgatattctcaaagagcaacgtctgcaaacgctgaaactggtgcgcgagatgcgcgccgacgtgtcggagctggtagagatgctgcttgctacgccgaatatggaacaacgcactcagggcattggcattctcgaccgacaaatcgcccgtgatttgcgctttgatcacccctacgccgactacggcaatattccaaaaacactgtttacctttaccggcggcgatgttttctcccgcgtgatggtccgtgtcaaagagacgtttgattcgctggcaatgctggaatttgccctcgacaacatgccggataccccactgctgaccgaaggctttagctataaacctcacgcattcgcgctgggctttgttgaagcgccacgcggtgaagacgtgcactggagcatgctcggtgataaccaaaaattgttccgctggcgctgccgtgccgccacctacgccaactggccggtgttgcgttacatgctgcgcggcaataccgtttctgacgcaccgctgattatcggtagccttgatccctgctactcctgtaccgaccgtgtgacgctggtagatgtgcgcaagcgccagtcaaaaaccgtgccgtataaagagatcgaacgctacggcattgatcgtaaccgttcgccgctgaagtaactcgagacccagctttcttgtacaaagtggtgataaattggagctctgcagagctttcgttcgtatcatc

SEQ ID NO: 181 - DNA, 1500 bp, Bacillus halodurans
ttcttgtttgttgattaacccttaattaatccgggcgcgcctgatttatcacaagtttgtacaaaaaagcaggctcctgcaggaccatgaaccatcgttacttaccaatgacaacggacgatcgacaggaaatgctacaggcgatcggtgtcgactcaattgaggaactgttttcggatattccgcaagatattcgcttcaaagggaagctgaacattccgaacgcgttaaaagagccagaactcattcgttattttcagcagttagcgaatgaaaatgttcacttaaaagataaagcctcttttttaggtgctggagtgtatgaccattacatcccatcaattgtcgaccatgtcatttcacgctctgaattttatactgcatataccccttaccagccggaaatttcccaaggggagttacaagccatctttgaatttcaaacgatgatttgtgaattaaccggaatggaagtggccaattcatccatgtatgacggaccgacagcattggcagaagcagcaatgatgagctgtggacatacgaaaaagaaaaaaattcttgtttccaaagctgtccatccagaggcgcgcgatgtattaatgacgaatgcttatggacaacgtttagaagtagttgagatcgacacgaacaatggtgtaacggatgtagagcatttaaaggcgttgtatgatgaggaaaccgcttgtgtgatcgtgcaacacccgaactttttcggccgacttgaaccattagcggaaattgaatcagttagtcatcaagggaaggcgacgttcgtcgtttcaagtaatcctcttgcgcttgggttattgaagccaccaggggccttcggagctgatgtggtcgttggagatgctcaaccgtttggaattccaacacaatatggcggccctcactgcggatattttgccactacgaaaaagttgatgagaaaagtacctggacggctcgttgggcaaacgaccgatgatcagggacagcgaggcttcgtgcttactctacaagcgagagagcagcatattcggcgtgaaaaagcgacatctaatatttgttcgaaccaagcccttaatgccctagccgctgcggttgctatggccacaatcggtaaacgtggcgtcaaggaaatggccttacaaaacgtacaaaaagcggcatacgctaaatcccagcttaaggccaatggtgtagaaatcgttgcagaaggaccttgctttaatgaatttatcattaagttaagcagtccgcttcatgaagtggaggaagcgttgcttgccaaaggattcattgcagggtacgacctggggaaagtgtatccagagcttgagggacatatgctcgtcgctgtgacagaggtaaggacaaaagaggagatagatcaatttgcaaaagaagtggggatgttcgcatgactcgagacccagctttcttgtacaaagtggtgataaattggagctctgcagagctttcgttcgtatcatc

SEQ ID NO: 182 - DNA, 1650 bp, Zea mays
ttcttgtttgttgattaacccttaattaatccgggcgcgcctgatttatcacaagtttgtacaaaaaagcaggctcctgcaggaccatggtggggaacaatactgttgcttccctcttctactattctttgctcatcatctgcgccgctgcttggcacgcggatgcgtcccaagcggatcgactgagagaattcatcaggtctaggaggaacagtcctagtgaggctgataagggcacgtttgaggttgccaacatggggcacagcgtagctagcagcctcctgagcacaagctactccgacagtgaacagagcgccctgaaggcagccgacaagatcactgcgctgccggggcaaccggacggcggcgtcgacttcgaccagtacgccgggtacgtgactgtcgacgagaagaatggccgggcactcttctactacttggtggaggcaccacaggatgcctcggcaaagccgctcctcctgtggcttaacggagggcccggatgctcatcgcttggctacggagcaatgcaagagctcggtccgttccgcgtaaacagcgacaacaaaacgctgagcagaaacaaggcggcttggaataacgtggctaatgtgatcttcttggagtcgccggcgggtgttggattctcctactccaacacatcctccgactacggcctcagtggagaccgaaggacagctgctgatgcgtacttgtttttggctaactggctggagcgctttcctgaatacaaaagccgtccgttctacatctccggggagagctatgccggacactatgtacccgaacttgctgccaccatcttaacccagaattcctacaacagcaagacggccataaacctccggggcatcttggttggaaatccacttctggattcgtatatgaacttgaagggtgcagttgcctactactggagccatgggttgatgtcggacgaggtctttgacaacataaccaggcactgcaagtatgacagttcagatggtgtggcatgcagtggcgctttggaggcggtagatcctggacagattgatccttacaacgtatatgctccgatctgtgttgatgcggccaacggagcatactaccccactggctacctacctggatatgatccatgcagcgattactacacctattcctacctcaatgacccagcagtgcagaatgctttccacgctaggacgacaagttggtcagcgtgcgcgaacttgaactggacggacgcaccgatttccatggtgccaacagtcgcatggctgattgagaagaagctgcccgtttggatttttagtggcgattttgattccgtgtgcccacttcctgctacgaggttttccatccatgatcttaacctgcacgtcaccactccatggcgcccgtggacagtaaacatggaggtcggaggatatgttcaacaataccagggaggattcacgtttgcctctgtcagaggagctggtcatatggttccgtcttcccaggctgatagagcattagtattattggactcctttctgaaaggggtgctcccaccatacgtacaggagcagtaactcgagacccagctttcttgtacaaagtggtgataaattggagctctgcagagctttcgttcgtatcatc

SEQ ID NO: 183 - DNA, 603 bp, Zea mays
ttcttgtttgttgattaacccttaattaatccgggcgcgcctgatttatcacaagtttgtacaaaaaagcaggctcctgcaggaccatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccccaacgaccccaactacgaggagggaggggcggcggacgaggacgacgaggcggccagggaggtggtcgtcggggaggtggaggtcgctaaggtcgccgagagcagggacggcgtcgccagggtcgacgtcgcgccgggcctgctccaggaccagaagcagtaactcgagacccagctttcttgtacaaagtggtgataaattggagctctgcagagctttcgttcgtatcatc

SEQ ID NO: 184 - DNA, 705 bp, Zea mays
ttcttgtttgttgattaacccttaattaatccgggcgcgcctgatttatcacaagtttgtacaaaaaagcaggctcctgcaggaccatggcggcggcagcagcaacaagagcaggagcgtggggcgtggcgtggctcctggcggccaccgtggcggcggcgctgctggcctcggcgtcggcgcagtccgggtgcacgaccacgctgatcagcctgtacccgtgcctcaactacatcagcggcaacgtgtcggcgccgccgtcctcgtgctgctcgcagctcgccagcgtcgtgcagaccaacccgcagtgcctctgcgccgcgctcagcggcgactcctcgtccctcggcggcgtcaccgtcgacaagacgcgcgcgctccagctcccccaggcgtgcaacgtcaagaccccgccggcgagcaagtgcaactctgctggcggcggcagcgctccgggcgccgcgacgccggccacgccgtcggccggcgtaccatcgaccgcaggaaccggcactggatcgaaggcgacgccgacggccccgttcctgacgtccggcgccgcgtcgacccggggggcggtgagcctggtgctggcattcgcgactgttgccgtctacggcatctcggccgcgtgactcgagacccagctttcttgtacaaagtggtgataaattggagctctgcagagctttcgttcgtatcatc

SEQ ID NO: 185 - DNA, 471 bp, Zea mays
ttcttgtttgttgattaacccttaattaatccgggcgcgcctgatttatcacaagtttgtacaaaaaagcaggctcctgcaggaccatgagcgcggcggcgggcggactgcggcggctgctggcggcggcggcgacggcgggagccgcggaggtgcgggcgtccatcttcggccacgcgctgaaccctacggggaggcgcgcggcgacgaagctcctgcggaagaagatggtgggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaagggtcagggaaggcgtgccgtcaagaggagcaagtagctcgagacccagctttcttgtacaaagtggtgataaattggagctctgcagagctttcgttcgtatcatc

SEQ ID NO: 186 - DNA, 1864 bp, Zea mays
ttcttgtttgttgattaacccttaattaatccgggcgcgcctgatttatcacaagtttgtacaaaaaagcaggctcctgcaggaccatggccaccatgaagctgggttccaagccggagattttcgtcctccaagacctcacatggagatgcacgaccgagctcgagagtgatgtagttgtcgaagtcggagagatgtccttttacctccacaagttcccgctgctgagccggagcggcgtgctgcagcggatgatcagcgagtaccaggctccggcggatggcggcggcatgtgcacgctgcagctggacgacatccccggaggcgccaaggccttcgagctggcggccaagttctgctacgacgtcaagatcgagctcaacgcgctcaacgtggtgtgcctccgctgcgccgccgagtacctgcgcatgacggacgactacgccgagggcaacctcatcacgcaggccgagtgcttcctcgtcgacgtgctcgccaactggaaggactccatcaaggcgctcgagacctgcgagggcgtgctccccactgccgaggacctgcacctcgtctcgcgctgcatcacggcgctggcctccaaggcctgcggctccgacgctgccgcgccagtggtcaggaacgccagcgtcgacaaggacgcgctctggaacggcatccggtcgggcgacacgacgtcctccgccgccgcggcggcggcggcggccgggatggactggtggtacgaggacgtgtccttcctcagcctgcccatgttcaagcgcctcatccaggcgatggaggccaagggcatgcgcgacgagagcatcgccggcgccatcatgttctacgccgggcggttcctcccggggctgaagcgcaacaccagcttcagcaacgcgctggccagctacggcgccgacggcagcggcggcgccggcggtggcatgagcagccgcaacatcaccccgcgcgccgccagcgtgtccgctccgtcggagggcgaccagaggtacttcctggaggagatcgtggcgctgctgccgaccaagaagggcgtggcctccaccaagttcctgctgggaatgctgcgcacggcgatgctcctccacgccagcccactgtgccgggagaatctggagcggcggatcggcgcgcagctggaggacgcgtcgctggacgacctgctcgtgcccaacctcggctaccacgcgcgccccgtcgacgacggcatctaccgcgccatcgatatatacctcaagtcgcacccgtggctgtcagaatcggagagggagcagctgtgccggctgctgaactgccagaagctgtcgctggaggcgtgcacgcacgcggcgcagaacgagcggctgccgcttcgggtggtggtgcaggtgctcttcttcgagcagctccgcctgcgaacgtccatagccgggtggttcttcgtgtcagacaacgcggcagggggcgacggcgcgcgcccacacgccggcggcgccatcgtccccaagggcaccgcggccatcgcaggctgcccgcaagcagacgccgacagtgacgtagagggcgacgcacccgatgggaaggagaccatcaccgacgtgaaagcgcgggtgtcggacctggagaaggagtgcaagagcatgaagcaggagatccggcggctcgggaagccccggcggtcctggagcctcctcacaaggaagtgcggttttggggccaaggtgcaacaagcgcagactgccatgagcggcaaatagattattttcccacttcatttgtttattaggcaggagcctcgagacccagctttcttgtacaaagtggtgataaattggagctctgcagagctttcgttcgtatcatc

SEQ ID NO: 187 - DNA, 678 bp, Zea mays
ttcttgtttgttgattaacccttaattaatccgggcgcgcctgatttatcacaagtttgtacaaaaaagcaggctcctgcaggaccatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccaggaggaggacgactggaagcgcatcgaggaccgaatcggatgcgggcaagtcgaggagctcatcgaggaggccgaggacgagctcaagctcatcgccaaaatgattgaatgggatccgtggggtgtccctgatgactacgaatgtgaggtgattgaagacgacaccccaattcctaagcatgttcctcagcaccggcccgttgctcttcctgaggagttcttcaagacactagatgccgtcaaatcagatcccgccctccaaggcgatgctcctcctcaagtgaaggcgtaactcgagacccagctttcttgtacaaagtggtgataaattggagctctgcagagctttcgttcgtatcatc

SEQ ID NO: 188 - DNA, 723 bp, Zea mays
ttcttgtttgttgattaacccttaattaatccgggcgcgcctgatttatcacaagtttgtacaaaaaagtaggctcctgcaggaccatgaggcctctcgacgagaaggagacgactcaggtattcgagaagctgttcaagttcacggggcccaacctgaagcacctcctggagcgccccgcagtggagggccccgacgcggagcccggccgctactgcctccgccttcaccgcaatcgcgtctactacgcctccgaggcgctcgtgcgccgcgccaccgccgtgtcccgaccgcgcctcgccggcgtggggacgcccatcggcaagttcacccaccacggcgcgttccaccttacggtccacgcgctcgacctcctcgctgcgcacgcgcgccgccgcgtctggctcaagcccgacaccgagcgttcctttctctttggcaactctgtgcccaagtcttctctcgctcgcatcaccgagaacaccaaggccggggacggggtggtcgtcatgtccatggctgacgtcccgctcgggttcggcattgcggcgaggtcggcgcaggattgcaggaaggccgacaccaacgccgtcgtcgtgctgcaccagtcggacgccggggagtacctccgcaaggaggaggagctcatgtgactcgagacccagctttcttgtacaaagtggtgataaattggagctctgcagagctttcgttcgtatcatc

SEQ ID NO: 189 - DNA, 651 bp, Zea mays
ttcttgtttgttgattaacccttaattaatccgggcgcgcctgatttatcacaagtttgtacaaaaaagcaggctcctgcaggaccatgaagcctgtcagtgtcgccgaacacaacaaccaccagcatcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcaaagagaaaagctagtgcgccggatgtgggatgtgtacacacgcacagataatcatgtacggctaccacggttctggcaagaagcatttgaggctgcatatgaggagcttgctggtgatgatacgcttactactgatgcagctatatctgagattgctcgcatgtcaatccataggcctgaggttgagcaatcgtcgaataaggattagctcgagacccagctttcttgtacaaagtggtgataaattggagctctgcagagctttcgttcgtatcatc

SEQ ID NO: 190 - DNA, 1893 bp, Zea mays
ttcttgtttgttgattaacccttaattaatccgggcgcgcctgatttatcacaagtttgtacaaaaaagcaggctcctgcaggaccatggcgaccccgccgccgccgctcccgcccatgccgccgaggcacgtctcctgcggctcacttctacaggaactgcaggaactatggggagaaattggtcaggatgaaatgaaaagagataggatgatactgcaactggaggaggattgtctcaatgtttacaagcaaaaagtgaatcagactaggaaacagaaggcagacctgcttcaagagctgtcccttggcgaagctgatatagacaagatcctttctgctcttggagagagagaaacatttcctaggtcagagaagcttgggggcacattaatggaacaactcgctaagatagagccagtgctagaagatttgaggcgtaggagggatgagagagtaaatgagttcaaggctattcagccaaagattgtatgtctacaagcagaaatttcaggagccattgatcatggggatcctgctgctcctgtggtagatgagaatgatttatccttgaaaagatcaggggaattgaaggagcatcttaatgatcttcagacagaaaagaatggaaggctgcaaaaaattgacatccagactaacagtattcatgaaatgtgcaacataatgtctattgatctcaaaatggcactaaaggatgttcatcccagttacgctgagctggggagaagcaaacccatgagtattagcaacagttcgcttgatagactatctgaaaaagtacatgcgttaaatcatgaaaagaaacaaaggcttcggaagcttcaagatcttggcagcacactcattgagttatggaacctcatggatacaccaactgatgaacagagattttttgaccatgtgacttctcttattaaagtctcaccaactacagcgatgccccaagggtgccttgcacacgaaataattgaaaaggtagagactgaggttaagagactgactaagttgaaagctagcaaaatgaaagagctagtcttcaagaaattgactgatcttgaggaaatctacagaagtgttcacatggatattgatagtgattctgagcggcaaaccctcaatgatctcattgattctggtagagcagatctttcagagttgctggcaagaatggatattcgaattgcggaggcaaaagaacatgcattaagtagaaaggatattttagaaaaggtggagaagtggacattggcatcagaagaggagacttggcttgatgaatacgaaagggatcaaaaccgatataatgctgtccgaggagctcacataaatctcaagcgtgcggagaaagctaggatgttggtcagcaaacttccatctcttttggagaacttgactgctaaaattaaagcctgggaaaaggaaatgggtattccatttatatttaacaaggtgaggctgttggactgtttagatgaatacacctgtacaagacagcaaaaagaagaggaaaagcgccgatcaagggaattgaagaaactgcaagaacagtttgctacagagcaaggtgccaagttcggaacggaaccaagccctatccgtcctctttcttcaaggaagcctcttgggcagagctctaatgccaatattattggtggaactccgaccagccgccgtgtttctacccccatgtcacggaagggtaggccatcttctggaagggtgcaggaagctgtcaagactgctgtggcaccagcaaactatgttgcccttcccaaggactgctcagacatttctaccctttgactcgagacccagctttcttgtacaaagtggtgataaattggagctctgcagagctttcgttcgtatcatc

SEQ ID NO: 191 - DNA, 1023 bp, Zea mays
ttcttgtttgttgattaacccttaattaatccgggcgcgcctgatttatcacaagtttgtacaaaaaagcaggctcctgcaggaccatggcgacggaccccgcgccggtgccggcgatgcgctgctactcgctgccgccagtccgcctccccgcggaggacattctcttctgcgtcgacgttgacctcgaggcccgcgccgagatgaagtccgccgccgccgccgcagcgtcctcgggctccacctccaccgcttcgccgcagccgacgcagcccgcgggggccgggggtgccccggcggcggggccccggaccgtggtcaggcggatggacgcggtcaggcaggcgctgctgctgttcgtccacagcaagctcaccatgtgcccagagcaccgcttcgccttcgcctccctcggcgagacgttctccatggtgaagaagggcttcagcagtgatgctggtttcgcaatggaggcaatccattccttgtctgcttcagaaacaagatatgctatggctgatctgacccagctctttatgacagcttgccaggaagggaaaagagcagaatcgcaaggccggattctccgggtggtgctcatatactgccgttcctctacaaagccacagcatcagtggcccgtgaagccaaagaatttcaccctcgacataatctatctccacgacaagccaaatcctgacaactgcccacagaaggtatatgatgccttggtcgatgttcttgagcatgtcagccagtatgaggggtacattctcgagactggtcaagggcttgctcgcgtgctctttcgtcagatgtgcattcttgtatcccatcctttgcaacgttgcatgcaagatgaccttgatattcccaaacaagtcgctaagaaaatcgtggcagccgaacctgcacagaatgaagatgccgctccagtctccagccaacagtagctcgagacccagctttcttgtacaaagtggtgataaattggagctctgcagagctttcgttcgtatcatc

SEQ ID NO: 192 - DNA, 1463 bp, Zea mays
ttcttgtttgttgattaacccttaattaatccgggcgcgcctgatttatcacaagtttgtacaaaaaagcaggctcctgcaggaccatgagctgcctgtgctggttcaagcggaggtccaggaaagggcgatcgtcgtcgtcggggaagcgaggggcgtcgtcgacggcgacggtgtcggtgtcgggccccgcgaccgcgaccgcgaccacgaccacgacggcgtcggcggagagcacgagccggtcggacgactcgggcgcggtgcggccggtgagcaagtcggcgggctcgtcgcagtcgcagcggagcatctcgtcgctctacgaggagcggggccacggccagctgcgcgtgttcgactacgacgagctccagggcgccacggccgagttcggccgcgcgcagaagctcggcgagggcggcttcggcagcgtctacaagggcttcatccgcgccgccgacggcaagggggaccgcgtccccgtcgccgtcaagaagctcaaccagcgtggcatgcagggacataagcaatggctggcagaagtacagttccttggtgttctggagcacccaaatcttgtaaagctacttggatattgtgctgttgatagcgaaagaggggcacagagattgttggtctacgagtttatgcccaataagagcttggaagaccacttgttcaggcgagctaatcctcctctaccgtggaacagaaggcttcaggttatcttgggagctgcagaaggattggcgtacctgcatgaaggggaagttcaggtgatctaccgggacttcaaaacgtccaacattttactggacaaggacttcagagcaaagctatcagacttcggcctagccagggaggggccaactggagcaaacactcacgtctcgactgcggtcgtcgggacgcaagggtacgccgcaccggagtacatggacacggggcacctgacgacgaagagcgacgtgtggagcttcggtgtggtgctttacgagatcctgacggggcggcggtcgctggaccggaacaggccggcggcggagcagaagctgctggagtgggtggcccagttcccgccggacagccgcaactttcggatgatcatggaccccaggctccgcggcgagtactcggtgaaggccgcccgggagatcgccaagctggccgacagctgcctgctcaagaacgccaaggagcgccccaccatgagcgaggtggtcgaggtcctcggccgggccgtgcaggcgcacgccgagcctgacagcggggctcccggccccggcgccaaggggaagaagaccgacgctgccacaccgtcccggcggcggcgtgactgactgctacatgtcgtcatcggtaaaggcgcttaccgagtccattggttagtctcgagacccagctttcttgtacaaagtggtgataaattggagctctgcagagctttcgttcgtatcatc

SEQ ID NO: 193 - DNA, 2377 bp, Arabidopsis thaliana
ttcttgtttgttgattaacccttaattaatccgggcgcgcctgatttatcacaagtttgtacaaaaaagcaggctcctgcaggaccatgagtggagctgtgcttgttgctattgctgctgctgttggcaacttgttacaaggatgggataacgcaactattgcaggagctgtgttgtacataaaaaaggagtttaatttggagagtaatccatcagtggaaggtctaattgtggcgatgtcacttattggtgctactctgattacaacatgctctggaggggtagctgattggcttggtcgccgtcccatgctaatattgtcctcaattctctactttgttggttctctagtaatgctatggtctccgaatgtttatgtgttgctcttaggaaggttgttagatggatttggggttggtcttgtggtcacacttgttcctatttatatatctgagactgcaccacctgagattaggggactgttgaatacgctaccgcagttcactggctctggagggatgttcttatcttactgtatggttttcggaatgtcgttgatgccatcacctagctggagattgatgcttggtgtccttttcatcccttcccttgtctttttcttcctcacggtcttcttcttgcccgagtccccaaggtggctcgtgagcaaaggtcgaatgcttgaagcaaagcgggttcttcagagactgcgtggtcgcgaagatgtgtctggtgagatggctttgttggttgagggtcttggaattggaggtgaaacaaccatagaggaatatataattggtcccgcggatgaagttactgatgatcatgatatagctgtggataaggatcaaattaagttatatggtgcagaagaagggctgagttgggttgctaggccagtcaaaggaggaagcactatgagtgttttgtctcgccatggaagtacaatgagcaggaggcaaggctcattgattgatcctcttgtcacactgtttgggagcgttcacgagaagatgccggacactggaagcatgaggagtgccttgttcccacattttgggagtatgttcagtgttggagggaatcaaccaagacatgaagattgggatgaagagaatcttgttggagaaggtgaggattatccatccgaccatggagatgattctgaagatgatcttcattctccgttgatctcacgtcaaacgacaagcatggagaaagacatgcctcacactgctcatggaactctttctaccttcagacatggaagtcaagtgcagggagctcaaggggaaggagcgggtagtatggggattggaggtggatggcaagtggcatggaaatggacggaaagagaagatgaatcgggacagaaagaaggtgggtttaaacggatatacttgcatcaagaaggtttcccaggatctcgacgtggctcaattgtttcattgcctggtggtgatggaaccggtgaggcagattttgtacaagcgtctgctttggttagccaaccagctctttattccaaagaccttctcaaagaacatacaattggtcctgctatggtacatccatccgaaacaactaaagggtcaatttggcatgatcttcatgatcctggagtcaagcgtgcattagtcgtaggagttggacttcaaatacttcagcagttctcaggcatcaacggagttctttactacacaccgcaaatccttgagcaggcgggtgtcgggatcctactatcgaacatggggattagttcttcctcagcatccttacttataagtgcattgacaacctttgtgatgttacctgcaatagctgttgcaatgaggctcatggatctttctggtcgaaggaccttgcttctcaccacgataccaatcctgatagcatctctattggttttagtaatctcaaatcttgttcacatgaacagcattgtgcacgcggtcttatcaaccgtaagcgttgtgctctacttctgcttcttcgtgatgggtttcggtcctgctccaaacatcctctgttcagagatttttccaactcgagtccgcggaatctgcatcgccatctgcgcactcaccttctggatctgtgacataatcgtcacttacagtctccccgtgctgctcaaatccattggactagctggtgtgtttggaatgtacgcaatcgtatgttgcatttcatgggtctttgtgttcattaaagtcccggaaactaaaggcatgccacttgaagtcatcacagagttcttttctgttggagctagacaagctgaagctgctaaaaacgagtgagctcgagacccagctttcttgtacaaagtggtgataaattggagctctgcagagctttcgttcgtatcatc

SEQ ID NO: 194 - DNA, 2387 bp, Arabidopsis thaliana
ttcttgtttgttgattaacccttaattaatccgggcgcgcctgatttatcacaagtttgtacaaaaaagcaggctcctgcaggaccaaaagatgggtacttcggtgcaagtgactcctctctgcggagtttacaacgagaatcctctctcctacttagtctccattgatggtttcaacttcctcatcgactgtggttggaacgatctcttcgacacatcgctcctcgaacctctctccagggttgcttctactatagatgcagttttgctttctcatccagatacacttcacattggtgctcttccttatgctatgaagcagcttggactctccgctcctgtttatgctactgagcctgttcatagattaggtctccttacaatgtatgatcagtttttgtccaggaagcaagtatccgactttgatctgtttacactggatgacatagattctgctttccagaatgtgatcagattgacttactctcaaaattaccatctttctggaaagggagagggtattgtaattgctcctcatgttgctggacacatgctgggaggtagcatctggaggataacaaaggatggggaggatgttatatatgctgttgactacaatcatcggaaagaaaggcatttgaatggaactgttttacagtcttttgttcggcctgctgttctgataaccgatgcatatcatgctctttataccaatcaaaccgcaagacagcaaagggacaaagaatttctagataccatttcaaaacatcttgaagttggaggaaatgttctattgccagtagacactgcgggtcgtgtcctggaacttctcttgatacttgaacagcattggtcacaaagaggtttcagctttcccatttattttctcacgtacgtgtcatctagcacaattgactatgttaagagtttcctcgagtggatgagtgactccatttcaaagtcctttgagacttcacgtgataatgcctttctattgaggcatgtcactctgttgataaacaagactgatctggataatgctccacctggtccaaaggttgttcttgcttccatggctagtctcgaagccggttttgctcgagagatattcgtggagtgggcaaatgatcccagaaatttagtcctctttactgaaacaggccagtttggcactttagctcgtatgcttcagtcagccccacctccaaaatttgttaaagtcaccatgtctaagagggttcctttggctggggaagagttaattgcatatgaggaagagcaaaacagactgaaaagggaagaagctttgcgagctagcctcgttaaagaggaggaaacaaaagcttcccatggatccgatgataattcaagtgaacctatgatcatagataccaagactactcacgatgttattggttctcacgggcctgcatataaagatatattgattgatggatttgttcccccatccagcagcgtagctccaatgttcccatattatgataacacatctgaatgggacgactttggggagattattaatccagatgactatgtgatcaaggatgaagacatggaccgaggagcaatgcataacggaggtgatgtggacggaaggcttgatgaggcaactgctagtctcatgcttgatacaagaccttcgaaagtcatgtccaatgagctcattgtgactgttagttgttcacttgttaaaatggactatgaaggtcggtcagatggccgctcaatcaagtcaatgattgcgcatgtttctcctttaaaacttgttttggtgcacgcgatagctgaggctacagagcatttgaagcaacactgcttgaacaacatctgtccacacgtgtatgctcctcaaatagaggaaacggtcgatgtgacttctgatttatgtgcttacaaggtccaactttctgaaaagctgatgagcaatgtgatcttcaagaagctgggagattcagaagtagcttgggtggattccgaagtagggaagacagagagggacatgaggtctctactaccgatgccaggtgctgcttcgccacacaaacctgttctagtaggtgatctgaaaatcgcagacttcaagcagtttctgtcgagcaagggtgttcaggtagaatttgcaggtggaggagctttacgttgtggtgaatatgtcactctacgaaaggttggaccgacgggtcaaaagggaggagcatcgggtccacagcaaattctgatagaaggaccgttgtgtgaagactattacaaaatcagggattatctctattctcagttctacctcctctgagcatgactcgagacccagctttcttgtacaaagtggtgataaattggagctctgcagagctttcgttcgtatcatc

SEQ ID NO: 195 - DNA, 2349 bp, Arabidopsis thaliana
ttcttgtttgttgattaacccttaattaatccgggcgcgcctgatttatcacaagtttgtacaaaaaagcaggctcctgcaggacctagcagaaagctatggaaggtgctgctgtggcggaagggctgtggggattagcggatcaccaccagaagcttggtgagatcggaaaaaccataaagtgcttggaagccatctgccagagtcaaatctctttccttcctcttgttgaagtcaagtctcgcctccgtttggctgctcttttactccgttactctcacaatgtcaaccatgccaagtcccatctcgagcgctctcttcttctccttaagtctattccttcctcctacgatctcaaatttcagaattatagcttgctcagccactgttatcacctccttgcttcattccctcctcaacgcaaccttcttgtcaaggctctcgaactcgcatcttctgtccctcaggatatttctgcgtacctctggtcttgcaatttcaactctcaactcgctaacacgttcattatccaagccgattttccttcttctctctccgctctcgagtctggttttctctctgcttcacacatatgttttcctgagctccagatgttcttcacagcttcaatgcttcacgttcatatcatgcaatggactgatgattattcagtggaaaaagctgtccagcgatgcgatgagatctggcagaccatttcttcagacaagactgatcgctgccccggtttgttcttctacaatgagatgttgcatgttttctatcgcctcaggctctgcgattataagaacgctcagcatcatgtcgaccgcttggaccaggcaatgaatgctcattcgcataaaatgcaggagattcagcaacttctggatgagctcagttcgttaaatcttagtctctcccgttacgaccttccctccagagaaagatcggccctctcagcaagacaatctcagcttcaagatcgtgtaaacgcattatctccatcttctagcactgttaactctctggagcccgcatactttggcaacatagatcgtggatggacagagaagctactgctttcaccatctccaattgatggagaatggctaccaaaaagtgccatcgatgctttggtccatcttatggttgtcatatcgggacgtccaaagggactctttaaagagtgttcaaaacgtatcgagtctggactgcagatcattcaagatgaactgatcaagcttggaattactgacgaagttagagaggctgatttgcggcacacagctatctggatgtctagggtttttcttatgctacagatgcagtttcttgagaatagagtggctttggaacttacaaggtctgattatgtcgaagctgaagaggctttggttgatatgaaaaattggtttacacgatttccaacgattttacaagcttctgagtgtatgattgagatgctcagggggcaatattctcattctgttggttgctacagcgaagctgctttccattgtattgaagcgaccaagttgacagagagtatttcaatgcaagcttcgtgtcaagcttttgcagctgtttcttaccttactattggagatgctgaatcatcatctaaggcacttgatttaattggaccactcaatggaatgacgaattcactatctggtgttcgagaggaagctagtattctctttgcttacggtcttctcttgatgaagcaacgagatctacaggaagcaagaaaccgtcttgccaagggtttgcagatcgctcataatcatatgggtaacctgcagctagttgcacagtatttgacactcctgggaaatttagctctttccttgcacgacaccgtacaagccagggagatcctgcgttcctctcttacacttgcaaagaaactttatgatatcccaactcagctatgggttctatccatcttcacagctctgtatcagcagttgggtgagaaaggcaacgagatggagaacgaagaattccggaagaagaaatgggatgagttgcagagtagacttgctgaagcgcgaggatcaattcatcacattgaactggttgcgaaagctaggatagaattgtatcagatcgacaacaatccacaagaacagtcactagtagcatctgcgcaatcaatgcaagggaatctggatattccagagtctgttggtatagaaggtccatcacctgctccatcatcttcaaggctcgttggtttagacaccggaaaaagatggggaaaacgaaggatgtaactcgagacccagctttcttgtacaaagtggtgataaattggagctctgcagagctttcgttcgtatcatc

SEQ ID NO: 196 - DNA, 2480 bp, Arabidopsis thaliana
ttcttgtttgttgattaacccttaattaatccgggcgcgcctgatttatcacaagtttgtacaaaaaagcaggctcctgcaggaccatagaaatcagacggcagtgttggatcggaggattttgatctgtggagacgaatatgaaaggtgaaacttatcgagtgttctgtgtcggaaccgccgataccaagcttgatgagctacgattccttgctggatcagtgcgatcaaatatcggcgcattctccaaaaactcgtcttccaaggttgaggttgtgattgtggatgtttcggcgggtgctgatcagaagcagatcgataatgttgcagactttgcgtttgtaacaagagaagaagttctctcatgctacattggatcgaaccaggaggaaaaaccggttaaacttccggatgatagaggcgaggcagttggtgtcatgagcaaatgtcttgagaattttcttaggcaagcctttgaggataattctcttgctggggctataggccttggcggaagcggaggaacatcgctcatatcatctgcttttaggtctctccctattgggattcctaaggtcattgtatccactgtggccagtggtcaaactgaaccttatgttgggacctcagatttggttttgatcccttctttagtagatgtttgtggtatcaacagtgttagcagggtggtcttttcaaacgctggggcttcttttgctggtatggtagtcgggaggcttgagttgtttagaagctccccaagcgataacggcaaatgtactgtgggcataactatgtttggagtgacaactccatgtgtaaatgcagtccaggagatattaacaagagaaggttatgagacactagtgtttcatgccactggtgttggtggcagagcaatggaatctttggttaaagaaggatttatacagggagtaatggatattacaacaaccgaggttgccgaccatctcgttggaggggtgatggcatgcgatagttcccgttttgatatcaccatagaaaaaggaataccgttggttttaagtgtaggtgccttagatatggtgaactttggtggtaaagatacaataccttctcatttccaaacgagaaagattcacgtccacaacgaacaggtttctctcatccgaacgacagcagaagagaataagaaatttgcaaggtttatagcagataaactgaacaaatcaacatcaaaagtaagggtttgcattccagagaaaggtttatctgcactggatgctccagggaagcctttctgtgatccagaagctactggtgctctcataaatgaattacaggggctcattcaaactaatgatgacagacaagtcaatatttattctcaccacatcaatgaccctgagtttgcagaggcattggttgcttcatttcttgagatttgtccaaaaacttacgcacaaatcaaaccctctgaaacgacttcgactaaacctagtactggagagcatgatgatggacatgtgagatcgaggcttgaaaggattccatacagtcctaaagagtttcccaatgcaaagccagaaaccttggaacgaactcaggccattttgggacggttgagagatcaaatagagaagggaataccaataattgggggaggtgctggtactggaatatctgcaaagtttgaggaagctggtgggattgatttgatagtgatatacaactctggacgttttcgtatggctggaagaggatccttagcaggcttacttccatttgctgatgccaatgcagtcgtgcttgaaatggcaaatgaagttttacctgtagtgaaggcggtgcctgttctggctggggtgtgcgcaacagatccatttcgtcgtatggactatttcctgaagcagttggagtccattgggttcgttggtgtccagaactttccaactgttggtctctttgatggtaattttagacaaaatcttgaggagacaggaatgggatatggtcttgaagttaaaatgatctcagaagcgcacaaaatggggctgttgaccactccatatgctttcaacccaaaagaaggagaagaaatggcaaaagcgggagctgatatcatagtagcccacatgggtctaacgacatccggaaatattggggcgaaaaccgcagtttcagtggaagaaagcgttgttcgtgtacaagctattgcagatgctgctcgtagattcaacccagacattatcgtcctctgccacggaggtccgatatcgggtccagaagaggcagagtttgtgttgaagagaacacagggttgtgtccatggcttctacggagcatcaagcatggaaaggctacctgtagaacaagcaataacaaacactgttcaaaaatacaagtccatatcgatcaagtgaagtcactcgagacccagctttcttgtacaaagtggtgataaattggagctctgcagagctttcgttcgtatcatc

SEQ ID NO: 197 - DNA, 1680 bp, Arabidopsis thaliana
atggctaatcaccaccgacttttacgcggcggcggatctccggccataatcggtggcagaatcacactcacagctttcgcttccactatcgcactcttcctcttcactctctccttcttcttcgcttcagattctaacgattctcctgatctccttcttcccggtgttgagtactctaatggagtcggatctagaagatccatgttggatatcaaatcggatccgcttaagccacggttgattcagatccggaaacaagctgatgatcatcggtcattagcattagcttatgcttcttacgcgagaaagcttaagctcgagaattcgaaactcgtcaggatcttcgctgatctttcgaggaattacacggatctgattaacaaaccgacgtatcgagctttgtatgattctgatggagcctcgattgaagaatctgtgcttaggcaatttgagaaagaagttaaggaacggattaaaatgactcgtcaagtgattgctgaagctaaagagtcttttgataatcagttgaagattcagaagctgaaagatacgattttcgctgttaacgaacagttaactaatgctaagaagcaaggtgcgttttcgagtttgatcgctgcgaaatcgattccgaaaggattgcattgtcttgctatgaggctgatggaagagaggattgctcaccctgagaagtatactgatgaagggaaagatagaccgcgggagctcgaggatccgaatctttaccattacgctatattttcggataatgtgattgcggcttcggtggttgtgaactctgctgtgaagaatgctaaggagccgtggaagcatgtttttcacgttgtgactgataagatgaatcttggagctatgcaggttatgtttaaactgaaggagtataaaggagctcatgtagaagttaaagctgttgaggattatacgtttttgaactcttcgtatgtgcctgtgttgaagcagttagaatctgcgaatcttcagaagttttatttcgagaataagctcgagaatgcgacgaaagataccacgaatatgaagttcaggaaccccaagtatttatctatattgaatcacttgaggttttatttacccgagatgtacccgaaactacataggatactgtttttggacgatgatgtggttgtgcagaaggatttaacgggtctgtgggagattgatatggatgggaaagtgaatggagctgtagagacttgttttgggtcgtttcatcggtacgctcaatacatgaatttctcacatcctttgatcaaagagaagtttaatcccaaagcatgtgcgtgggcgtatggaatgaacttctttgatcttgatgcttggagaagagagaagtgcacagaagaatatcactactggcaaaatctgaacgagaacagggctctatggaaactggggacgttaccaccgggactgatcaccttttactcaaccacaaagccgctggacaaatcatggcatgtgcttgggctgggttacaatccgagcattagcatggatgagatccgcaacgctgcagtggtacacttcaacggtaacatgaagccatggcttgacatagctatgaaccagtttcgaccactttggaccaaacacgtcgactatgacctcgagtttgttcaggcttgcaattttggcctctga

SEQ ID NO: 198 - protein, 348 aa, Arabidopsis thaliana
MKATLAAPSSLTSLPYRTNSSFGSKSSLLFRSPSSSSSVSMTTTRGNVAVAAAATSTEALRKGIAEFYNETSGLWEEIWGDHMHHGFYDPDSSVQLSDSGHKEAQIRMIEESLRFAGVTDEEEEKKIKKVVDVGCGIGGSSRYLASKFGAECIGITLSPVQAKRANDLAAAQSLSHKASFQVADALDQPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSLLRSGMKSIKGALTMPLMIEGYKKGVIKFGIITCQKPL

SEQ ID NO: 199 - protein, 69 aa, Arabidopsis thaliana
SPTLNHFQVRFHLIVCNLTYSYIIYIISSYCINSIIINMIWTCVAGTPYGGPGPYPRSYPVCYPPYCRP

SEQ ID NO: 200 - protein, 252 aa, Arabidopsis thaliana
TETQFVKFGGLRMKGLVSTGWKGPVKFRMPTAENLVPIRLDIQFEGQRYKDAFTWNPSDPDNEVVIFAKRTVKDLKLPYAFVTQIAQSIQSQLSDFRAYEGQDMYTGEKIIPIKLDLRVNQTLIKDQFLWDLNNFESDPEEFARTLCKDLGVEDPEVGPAVAFAIREQLYEIAIQSVASARESRLSKKGRRGSDHGSASKASGLSMDLMKLFSFKSSVVRKRKDLDVYEPVVDLLTSEEVDALEAREERHAR

SEQ ID NO: 201 - protein, 164 aa, Arabidopsis thaliana
MRRGGKEEDEVEQLLQAAQDEMILKLSVDSHTSRSSSDYLDPDLHSRFLALKSQKKKDQQQQQKQRPRMQPKSKDVVEETPEDLMLRFAALKTSLPSASSSSSVLLQDEIGEDGDEIGEDAEVDKLIQWAIDAARLDPSPSSDDEQSQNCDSDDENDSTRDVKP

SEQ ID NO: 202 - protein, 134 aa, Arabidopsis thaliana
MGCIGVVNVTSINPYLTRRSNKPYNSRRPSSMAAAIRAESTEKLGITIEKNPPESKLTQLGVRSWPKWGCPPSKFPWTYSAKETCYLLQGKVKVYPNGSDEGVEIEAGDFVVFPKGMSCTWDVSVAVDKHYQFE

SEQ ID NO: 203 - protein, 63 aa, Arabidopsis thaliana
MKKSTETPARPNATVKTQKPPFRPAVDDTKPVLQDPILRSDPMETEEAVLRLPSFPMIRPSES

SEQ ID NO: 204 - protein, 962 aa, Arabidopsis thaliana
MDTMRISGVSTGAEVLIQCNSLSSLVSRRCDDGKWRTRMFPARNRDLRPSPTRRSFLSVKSISSEPKAKVTDAVLDSEQEVFISSMNPFAPDAASVASSIKYHAEFTPLFSPEKFELPKAFFATAQSVRDALIMNWNATYEYYNRVNVKQAYYLSMEFLQGRALSNAVGNLGLNSAYGDALKRLGFDLESVASQEPDPALGNGGLGRLASCFLDSMATLNYPAWGYGLRYKYGLFKQRITKDGQEEAAEDWLELSNPWEIVRNDVSYPIKFYGKVVFGSDGKKRWIGGEDIVAVAYDVPIPGYKTKTTINLRLWSTKAPSEDFDLSSYNSGKHTEAAEALFNAEKICFVLYPGDESTEGKALRLKQQYTLCSASLQDIVARFETRSGGNVNWEEFPEKVAVQMNDTHPTLCIPELMRILMDLKGLSWEDAWKITQRTVAYTNHTVLPEALEKWSLELMEKLLPRHVEIIEKIDEELVRTIVSEYGTADPDLLEEKLKAMRILENVELPSAFADVIVKPVNKPVTAKDAQNGVKTEQEEEKTAGEEEEDEVIPEPTVEPPKMVRMANLAVVGGHAVNGVAEIHSEIVKQDVFNDFVQLWPEKFQNKTNGVTPRRWIRFCNPYLSDIITNWIGTEDWVLNTEKVAELRKFADNEDLQSEWRAAKKKNKLKVVSLIKERTGYTVSPDAMFDIRIKRIHEYKRQLLNILGIVYRYKKMKEMSASEREKAFVPRVCIFGGKAFATYVQAKRIVKFITDVASTINHDPEIGDLLKVIFVPDYNVSVAELLIPASELSQHISTAGMEASGTSNMKFSMNGCVLIGTLDGANVEIREEVGEENFFLFGAKADQIVNLRKERAEGKFVPDPTFEEVKKFVGSGVFGSNSYDELIGSLEGNEGFGRADYFLVGKDFPSYIECQEKVDEAYRDQKRWTRMSIMNTAGSFKFSSDRTIHEYAKDIWNIKQVELP

SEQ ID NO: 205 - protein, 509 aa, Arabidopsis thaliana
MGDFNLALVIVAIVVCVIVFISSIYLLVNYQHPDDANQAYFPKFVVVFGLSIAMISILMLPADVANRHACRHAIYNGACNLTLPMKDLWLAIYIVDAILVFFVIPFAMFFYEGDQDKTLGKRIKSALIWVVTTAVVCALVLGILYGVIGKVDFSVRHLASATSTFPTSWQFSNTQPCIGNTARQCSAFTANPTSEKTWTMRTTFPEYVVALATIVGSVLFTIFGGVGIACLPLGLITAFIRRPKAVITRSQYIKEATELGKKARELKKAADGLHQEERSGAKGRKWRKNVKAVEKELLQLEEDVNLLEEMYPQGEQAETAWAFTVLGYLAKFILGIVGLIVSIAWVAHIIIYLLVDPPLSPFLNEVFIKLDDVWGLLGTAAFAFFCFYLLLAVIAGAMMLGLKLVFITIHPMKWGATLMNSFLFNVGLILLCSISVIQFCATAFGYYAQATAAQEIFGHTLQSLRGIKYLYKYNVFQIGFVILAGLTFLYYIAFGWRRKKTSGRFQLSS

SEQ ID NO: 206 - protein, 313 aa, Arabidopsis thaliana
MGANSIPTDATIDLDEQISQLMQCKPLSEQQVRALCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGYNWAHEQKVVTIFSAPNYCYRCGNMASILEVDDCRNHTFIQFEPAPRRGEPDVTRRTPDYFL

SEQ ID NO: 207 - protein, 378 aa, Arabidopsis thaliana
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 208 - protein, 411 aa, Arabidopsis thaliana
MGKNDFLTPKAIANRIKAKGLQKLRWYCQMCQKQCRDENGFKCHCMSESHQRQMQVFGQNPTRVVDGYSEEFEQTFLDLMRRSHRFSRIAATVVYNEYINDRHHVHMNSTEWATLTEFIKHLGKTGKCKVEETPKGWFITYIDRDSETLFKERLKNKRVKSDLAEEEKQEREIQRQIERAAEKLNGGGGEGETSGNDEVVDDGDDERKKDEDLRLKSGVKVGFALGGGVKQVATGKERGESSKLLFGDEENDKVERGEKRKRSGDSGRSEKERRSALDELMKEEEKKKERMNRKDYWLFEGIIVKVMSKALAEKGYYKQKGVVKKVIDNYVGEIKMLDSKHVLRVDQKELETVLPQIGGMVKIVNGAYRGSNARLLGVDTEKFCAKVQIEKGVYDGRVIKSIEYEDICKLA

SEQ ID NO: 209 - protein, 157 aa, Arabidopsis thaliana
MANLYVKAVPPPDMNRNTEWFMYPGVWTTYMLILFFGWLVVLSVSGCSPGMAWTVVNLAHFVVTYHSFHWMKGTPFADDQGIYNGLTWWEQMDNGQQLTRNRKFLTLVPVVLYLIASHTTDYRHPWLFLNTLAVMVLVVAKFPNMHKVRIFGINGDK

SEQ ID NO: 210 - protein, 261 aa, Arabidopsis thaliana
MVVGGGGEGDQKRSSGEMMAMASLFNDQQNPIQQFQVKFKEVETNFKTWLSKQSIPVEAAVVSTMSGVQGAFIGGLMGTLSPEMPQAGVDPQAIASMKQAQALVGGPWVQARNFAAITGVNAGIASVMKRIRGKEDIESAVVAALGSGFAYSLVSQGLQGQPMNAITTAAGFAVFQGVFFKLGERFSKPSTEDPFFTRGRTMLVKLGLEKYEKNFKKGLLTDPTLPLLTDSALKDANIPPGPRLMILDHIQRDPEIKGKRK

SEQ ID NO: 211 - protein, 401 aa, Arabidopsis thaliana
MAMSGTFHLTSDYVPGYTLSDSRCFFNSAVSRRTLAILPCSSCLDHKNGRLKSVPNRSSFVCRASSGGYRRNPDFSRLNKHGYRGNNRQSGGREDFDIENSDMLSSRNGPLFNLSSSPKFQATSSPGPREKEIVELFRKVQAQLRARAAAKKEEKKIEEASKGQGKESETVDSLLKLLRKHSGEQSKRQVSKFSSQGEVQGDTVDKQDRTGNLVTSGNKDNNASSFTRPTSSFRRKSPVPRSQSPPAYSSEATFDQSSSYSVTWTQKKDTVELHDEPEHEPAYEHEHEPENESEPGPVTTMLEPDSELKPESSSFYQEEEDDDVTFDVLSQDDGILDVLSDDDESLDDADEDSDEAEEEAVKDLSELKLVELRGIAKSRGLKGLSKMKKAELVELLGSDSS

SEQ ID NO: 212 - protein, 341 aa, Agrobacterium tumefaciens
MTERLEDIAIKMVADGKGLLAADESTGTIKKRFDSINLESTETARRDYREMLFRSDDAMKKYISGVILYEETLFQKAADGTPFVDIIKAAGSLPGIKVDIGAKPMAFHPHEFITEGLDGLYERLRKYHEAGARFAKWRGVITIGEQRPSWGSIKANSQSLARYAALCQQADIVPIVEPEVLMDGEPGTHDIDRCAEVTQWVLQTVFADLFDARVNLEGMILKPNMIIDGKNARKASVEEVAEKTVKVLKATVPTAVPGIAFLSGGQSSEEATAHLSAMNAGYDLPWSLTYSYGRALQDTALKTWGGKSENVAAGQRAFTHRAAMNSLAAKGNWKQELEKAA

SEQ ID NO: 213 - protein, 614 aa, Arabidopsis thaliana
MSYQNEEEEEGGDTNDCFYESLDRLASSSSCSCSASNSDKNTSKENEDSGNSNKDNASKSKKKGSWFKSIKSVASSMTGHSKERRSSDDRDTSSERGGRRSSSATDDSQESSFHGPERVRVRQYGKSSKELTALYKTQEIQAHNGSIWSIKFSLDGKYLASAGEDCIIHIWQVVEAEKKGELLLDRPELLLLATNGSPEPTTMSPRRRGRTSISRKSLSLENIFVPDSLFGLSEKPFCSFQGHVDDVLDLAWSKSQHLLSSSMDKTVRLWNLSSQTCLKVFSHSDYVTCIQFNPVDDRYFISGSLDAKVRVWSIPDRQVVDWYDLHEMVTSACYTPDGQGVLVGSYKGSCRMYSASDNKLQQKSQINLQNKKKKAHQKKITGFQFVPGSSSEVLVTSSDSRIRVVDGTDLVNKLKGFRNTSSQISASITADGKYVVSASEDSHVYIWKYESPASRPSRSNNNKNVTVTNSYEHFHSQDVSAAISWPGMASTENWGTQNRAGFNGSTNNLDNISTANHPPTPVDQLGTVERLNSPRNGIISSATNGYFFDRMSATWPEEKLLFARNRSGNRLSTDMSSSNGNSGNVSASWGMVIVTAGLRGEIRTFQNFGLPIRI

SEQ ID NO: 214 - protein, 298 aa, Arabidopsis thaliana
MALVNDHPNETNYLSKQNSSSSEDLSSPGLDQPDAAYAGGGGGGGSASSSSTMNSDHQQHQGFVFYPSGEDHHNSLMDFNGSSFLNFDHHESFPPPAISCGGSSGGGGFSFLEGNNMSYGFTNWNHQHHMDIISPRSTETPQGQKDWLYSDSTVVTTGSRNESLSPKSAGNKRSHTGESTQPSKKLSSGVTGKTKPKPTTSPKDPQSLAAKNRRERISERLKILQELVPNGTKVDLVTMLEKAISYVKFLQVQVKVLATDEFWPAQGGKAPDISQVKDAIDAILSSSQRDRNSNLITN

SEQ ID NO: 215 - protein, 452 aa, Arabidopsis thaliana
MAAAVSSVWAKPGAWALEAEEHEAELKQQPSPTNQKSSAEDSSDFPSLAAAATTKTKKKKGQTISLAEFATYGTAKAKPAPQTERLTQAELVALPTGPRERSAEELDRSKLGGGFRSYGGGRYGDESSSSRWGSSRVSEDGERRGGGFNRDREPSRDSGPSRADEDDNWAAAKKPISGNGFERRERGSGGGFFESQSQSKADEVDSWVSTKPSEPRRFVSSNGGGGDRFEKRGSFESLSRNRDSQYGGGGGSESDTWGRRREESGAANGSPPPSGGSRPRLVLQPRTLPVAVVEVVKPESPVLVIVEKPKGANPFGNARPREEVLAEKGQDWKEIDEKLEAEKLKDIAAAMEKPNEKSTGKMGFGLGNGRKDEERIERSWRKSTEHSEEDAQEEEPAVEGAKKEETEDKPAVEEAKKEETEGEQAVEEAKKEETGGEPAVEEAKKEETEDKI

SEQ ID NO: 216 - protein, 282 aa, Arabidopsis thaliana
FLNCRAFRRPVGIVHVKVVRAVGLRKKDLMGGADPFVKIKLSEDKIPSKKTTVKHKNLNPEWNEEFKFSVRDPQTQVLEFSVYDWEQVKSYQKGDWCLGVGIYVIFVFITQVGNPEKMGMNVLALKEMVPDEHKAFTLELRKTLDGGEDGQPPDKYRGKLEVELLYKPFTEEEMPKGFEETQAVQKAPEGTPAAGGMLVVIVHSAEDVEGKHHTNPYVRIYFKGEERKTKHVKKNRDPRWNEEFTFMLEEPPVREKLHVEVLSTSSRIGLLHPKVTHSFRSE

SEQ ID NO: 217 - protein, 803 aa, Arabidopsis thaliana
MGMVLFACLLLLIIFPTCGYAAINTSSPLSIRQTLSSPGGFYELGFFSPNNTQNQYVGIWFKKIVPRVVVWVANRDTPVTSSAANLTISSNGSLILLDGKQDVIWSTGKAFTSNKCHAELLDTGNFVVIDDVSGNKLWQSFEHLGNTMLPQSSLMYDTSNGKKRVLTTWKSNSDPSPGEFSLEITPQIPTQGLIRRGSVPYWRCGPWAKTRFSGISGIDASYVSPFSVVQDTAAGTGSFSYSTLRNYNLSYVTLTPEGKMKILWDDGNNWKLHLSLPENPCDLYGRCGPYGLCVRSDPPKCECLKGFVPKSDEEWGKGNWTSGCVRRTKLSCQAKSSMKTQGKDTDIFYRMTDVKTPDLHQFASFLNAEQCYQGCLGNCSCTAFAYISGIGCLVWNGELADTVQFLSSGEFLFIRLASSELAGSSRRKIIVGTTVSLSIFLILVFAAIMLWRYRAKQNDAWKNGFERQDVSGVNFFEMHTIRTATNNFSPSNKLGQGGFGPVYKLVDGKEIGVKRLASSSGQGTEEFMNEITLISKLQHRNLVRLLGYCIDGEEKLLIYEFMVNKSLDIFIFDPCLKFELDWPKRFNIIQGIARGLLYLHRDSRLRVIHRDLKVSNILLDDRMNPKISDFGLARMFQGTQYQDNTRRVVGTLGYMSPEYAWAGLFSEKSDIYSFGVLMLEIISGKRISRFIYGDESKGLLAYTWDSWCETGGSNLLDRDLTDTCQAFEVARCVQIGLLCVQHEAVDRPNTLQVLSMLTSATDLPVPKQPIFAVHTLNDMPMLQANSQDFLSVNEMTESMIQGR

SEQ ID NO: 218 - protein, 253 aa, Arabidopsis thaliana
MASSAVSLQSISMTTLNNLSCNQQFHRSSLLGSSKSFQNLGISSNGSDFSYPSSFTAKKNLTASRALSQNGNIENPRPSKVQELSVYEINELDRHSPKILKNAFSLMFGLGDLVPFTNKLYTGDLKKRVGITAGLCVVIEHVPEKKGERFEATYSFYFGDYGHLSVQGPYLTYEDSFLAITGGAGIFEGAYGQVKLQQLVYPTKLFYTFYLKGLANDLPLELTGTPVPPSKDIEPAPEAKALEPSGVISNYTN

SEQ ID NO: 219 - protein, 170 aa, Arabidopsis thaliana
MRKLRGIKIRRPIKQISRWILRRIKIRRSRYTRLSPNRPVCKPRAITKLISWGRSLTSHSARFIGSKCSNSGYIPIGQEPIREKPDPVPKGHSAVYIGKKDGDFQRVLVPIVYFNHPLFGELLREAEEEFGFSQEGGITIPCPYSDFKRVQTRIESGSGFCKFPWSRRWQ

SEQ ID NO: 220 - protein, 186 aa, Arabidopsis thaliana
MAGGGTEAFPDLGEHCQDPDCKLLDFLPFTCDGCKLVFCLEHRSYKSHNCPKSDHGSRTVSICETCSIAIETTGFDEKGIKSLLEKHERSGDCDPNKKKKPTCPVKRCKEILTFANNLTCKYCGVKFCLKHRFPTDHVCNKKIINTAGTSSRWNERFMEALSLRNQKGCGRGSSVSSKSSPSVRSF

SEQ ID NO: 221 - protein, 375 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVTRTKSRWKCSLKDGIMHINDKDILFNKAAGEFDF

SEQ ID NO: 222 - protein, 184 aa, Arabidopsis thaliana
MEKSTRTLFITIVITSMLLGFGNSDLAQDREECTNQLIELSTCIPYVGGDAKAPTKDCCAGFGQVIRKSEKCVCILVRDKDDPQLGIKINATLAAHLPSACHITAPNITDCISILHLPRNSTLAKEFENLGRIEDNYNSTSPTQIHKDGTGGGKAEPVKSNGWKEKSWLGVELLIYLLVSLIFF

SEQ ID NO: 223 - protein, 419 aa, Arabidopsis thaliana
  misc_feature (152)..(152): Xaa can be any naturally occurring amino acid
  misc_feature (167)..(167): Xaa can be any naturally occurring amino acid
  unsure (1)..(419): unsure at all Xaa locations
MRKKKTRFQFLLNPNSKFVFFPRAISSSSSSSSDNNNDGSVSSSRQNNRQMGYDPSEELFGVDFKPRFISGDSREPRSWFGPNGQYIRELPCPTCRGRGYTSCSNCGIERSRLDCPQCKGKGIMTCLRCLGDCVIWEESIDERPWEKARSRXCCYSRVEVLILFNVXLINLIFFCHSSPFRVKEDDEVDNLEIKFSKRRKSKRIYQSPTPEVGQKISRSLKSLNAKTGLFSKRMKIIHRDPVLHAQRVAAIKKAKGTPAARKHASESMKAFFSNPVNREQRSLSMKGTKFYCKNCGQEGHRRHYCPELGTNADRKFRCRGCGGKGHNRRTCPKSKSIVTKGISTRYHKCGICGERGHNSRTCRKPTGVNPSCSGENSGEDGVGKITYACGFCKKMGHNVRTCPSKQVSDSDSCLEQEGS

SEQ ID NO: 224 - protein, 459 aa, Arabidopsis thaliana
MEEDYQQPRFTIGRQSSMAPEKIPEPSVHSEEEVFEDGEEIDGGVRLMYLANEGDIEGIKELIDSGIDANYRDIDDRTALHVAACQGLKDVVELLLDRKAEVDPKDRWGSTPFADAIFYKNIDVIKILEIHGAKHPMAPMHVKTAREVPEYEINPSELDFTQSKEITKGTYCMAMWRGIQVAVKKLDDEVLSDDDQVRKFHDELALLQRLRHPNIVQFLGAVTQSNPMMIVTEYLPRGDLRELLKRKGQLKPATAVRYALDIARGMSYLHEIKGDPIIHRDLEPSNILRDDSGHLKVADFGVSKLVTVKEDKPFTCQDISCRYIAPEVFTSEEYDTKADVFSFALIVQEMIEGRMPFAEKEDSEASEAYAGKHRPLFKAPSKNYPHGLKTLIEECWHEKPAKRPTFREIIKRLESILHHMGHKRQWRMRPLTCFQNFEHKKKHNWDLSSHDGSSSGSHL

SEQ ID NO: 225 - protein, 230 aa, Arabidopsis thaliana
MKILLASLCLISLLVILPSVFSASSSSEDFDFFYFVQQWPGSYCDTQKKCCYPNSGKPAADFGIHGLWPNYKDGTYPSNCDASKPFDSSTISDLLTSMKKSWPTLACPSGSGEAFWEHEWEKHGTCSESVIDQHEYFQTALNLKQKTNLLGALTKAGINPDGKSYSLESIRDSIKESIGFTPWVECNRDGSGNSQLYQVYLCVDRSGSGLIECPVFPHGKCGAEIEFPSF

SEQ ID NO: 226 - protein, 334 aa, Glycine max
  misc_feature (323)..(323): Xaa can be any naturally occurring amino acid
  unsure (1)..(334): unsure at all Xaa locations
MMMMTMEGMMDKGVLDDVIRRLLEGKGGKQVQLSESEIRQLCVNARQIFLSQPILLDLRAPIRICGDIHGQYQDLLRLFEYGGYPPAANYLFLGDYVDRGKQSLETICLLLAYKIRYPDKIYLLRGNHEEAKINRIYGFYDECKRRFNVRLWKIFTDCFNCLPVAALIDEKILCMHGGLSPELENLDQIREIQRPTEIPDSGLLCDLLWSDPDASIEGWAESDRGVSCTFGADVVAEFLDKNDVDLVCRGHQVVEDGYEFFAKRRLVTIFSAPNYGGEFDNAGALLSVDDSLVCSFEILKPADRASGSGSSKMNFKKPPKLGXDIVIGKDFRFK

SEQ ID NO: 227 - protein, 334 aa, Glycine max
MSSGSVRRVSRQDIQLVQNLIERCLQLYMSQKEVVETLLAQAKIEPGFTELVWQKLEEENEEFFKAYYARLVLKQQIMQFNKLLDQQVQLMQLHSSTVASLPTSNGSHIPAVSSLPSSNGSHIPAIPENPACYTADRTQTSLKPENMQHHVDSRLSNVFNNGGSSLHTSMHAAVDMSAHGNRINGPSSMLSAQSANMGLIQGINGGGMIKSEPGYSGCSPYMFGTDGNVLETRPTIGGASVTSFTNVESNSHSLNEVVLDPDTSSFGFLGQIPRNFSLSDLTADFSQSSDILETYSRSPFLATDNENFLDRGEQDNNRLDSISEGLSYEDFGSE

SEQ ID NO: 228 - protein, 305 aa, Glycine max
MLLQTRQFGTACPWVRLTPASKRNSSVSLRRSNCGPKCSVSQLELKSESESKTKPYPAEASRTIMELAKVGTLCTLTQEGLPLGTGVRFAVDPEHGTPLFCFNSTDNTNIPSSLHVQFEQFGLRTPQCTIQGTLTKPQDPKRLVSVWRKRFGEEVDRDFIYIIAVDRVLQLEDIQEDGIWVTSSDYKNAQPDPLRDSAHNLVTEINTNNMEDITRFCNVYVDLDFLVSEAKMLWVDRLGFDMRLSSPHKGVFDVRIPFPREVTDEKGAKSTFNCMSQLAWEVERNFQHPDFSKVKELKPVKSPFL

SEQ ID NO: 229 - protein, 263 aa, Glycine max
MATFSKERENFVYVAKLAEQAERYDEMVDAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 230 - protein, 337 aa, Glycine max
MSEAPPPPTADASPPPYWCYHCEKRVSVETLANLPDVVRGECKNGFVESMPTPSRSRSPSASSDDPYFGSQFLQVLRLIAQSARDDDASPPPPPSRSPENDFLRIELGGWDNDEENENDDDNGDEEFEEHEEAEDRSGNEDPHGGDDEDLRRRRRELLRLRIRDLATRTRSMRNRILDWAEILMGLEDNSIEFRLQLPESDRYVGNPEDYVDAAEYEALLQTLAESDGGGRRGAPPASKAALEALPTVKIASESEAVACAICKDLLGVGDAAKRLPCGHRYHGDCIVLWLSSRNSCPVCRFELPTDDKEYEEERVVIAASSNSNGASSSGGGGSAIV

SEQ ID NO: 231 - protein, 810 aa, Glycine max
MEETREDAGPAEQGPSNVSWWPSDFVEKFGSVSLGSQDEILSNKESPRHFDKDVLSSQKASQTLWRIGVLSEPIPNGFYSVIPETRLKELFDSIPTLDELHALGGEGFKADIILVDSEKDKKLSMLKKLIMALVRGLNSNPAAIIKKIAGLVSDFYKRPNVESPAKAALDESSHMFENRGVQMLGQIKHGSCRPRAILFKVLADTVGLESRLMVGLPNDGAIECQDSYKHMSVIVVLNSVEMLVDLMRFPGQLLPRSTKAVFMTHISAGESDSAENDSCDSPLEPNSPLFGVSESAEKEENLQFHRRFEASSNVSGLSLRNVMLRSNSSLSLSHSEPNIATAFGRRSRRKVIAEQRTASSSPEHPSFRARGRSMLSGDRTTFRDFADDQATSRSSYRSDNTSSSEARRIRRRSISITPEIGDDIVRAVRAMNETLKQNRLLRERGDDNSFPNSPNNSSSDANLQKNVSNFHLDGHDERSALYSFQRDQGASQKAMSLPSSPHDYGGQASERSGSSRYGVNDEMESTWNKVLESPMFNNKPLLPYEKWNIDFSELTVGTRVGIGFFGEVFRGIWNGTDVAIKVFLEQDLTAENMEDFCNEISILSRLRHPNVILFLGACTKPPRLSMVTEYMELGSLYYLIHLNGQKKKLNWRRRLRMLRDICKGLMCIHRMKVVHRDLKSANCLVNKHWTVKICDFGLSRIMTESPMRDSSSAGTPEWMAPELIRNEPFTEKCDIFSLGVIMWELCTLNRPWEGVPPERVVYSVANEGSRLEIPEGPLGRLISECWAECHERPSCEEILSRLVDIEYSLC

SEQ ID NO: 232 - protein, 363 aa, Glycine max
  misc_feature (22)..(22): Xaa can be any naturally occurring amino acid
  unsure (1)..(363): unsure at all Xaa locations
SPLPYRNKVVLSSAEGTVGCSXAMDLASNLGGKIDKAEVLSAVQKYEKYHVCYGGQEEERKANYTDMVNKYYDLVTSFYEFGWGESFHFAPRWKGESLRESIKRHEHFLASQLGLKPGQKVLDVGCGIGGPLREISRFSLTSITGLNNNEYQITRGKELNRIAGVDKTCNFVKADFMKMPLPDNSFDAVYAIEATCHAPDAYGCYKEIFRVLKPGQCFAAYEWCMTDSFDPQNPEHQKIKAEIEIGDGLPDIRLTAKCLEALKQAGFEVIWEKDLAVDSPLPWYLPLDKSHFSLSSFRLTAVGRLFTKNMVKVLEYVGLAPKGSLRVQDFLEKAAEGLVEGGKREIFTPMYFFLARKPDSDRN

SEQ ID NO: 233 - protein, 438 aa, Glycine max
MGEKSNVGGDAINTTLLHGKYELGRLLGHGTFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYAVTPSFLVVEVKKDNGDTLEYNQFCSKELRPALKDIVWRTSPAENPTLA

SEQ ID NO: 234 - protein, 259 aa, Glycine max
MHKLGRGHRDKLQQFITITGASEKLALQALKASDWHLEGAFDFFYSQPQLKTFTDSRHLEELYNRYKDAYVDMILADGITLLCNDIQVDPQDIVMLVLSWHMKAGTMCEFSKKEFIEGLQSLGIDSLEKFREKIPYMRSELKDEQKFREIYNFAFGWAKEKGQKSLALDTAIGMWQLLFAEKQWPLVDHWCQFLQARHNKAISRDTWSQLLEFAKTVGSNLSDYDAEGAWPYLIDEFVEYLNENGIIQNDLINDSSLKR

SEQ ID NO: 235 - protein, 388 aa, Glycine max
MGKREKQKQRHEKGHRGRGSFNYLQEDRDFDDTPRPSPSEEECADDSNEEKEEEEEEEGHENQSHDMPSKFLLYQQSVQSPKGDISYLQKFFLMYVGGRMPLHLQEDFCGTALLSTEWLRSDSRRTVVGLDLDLEALNWCMESNIPKVGADGFSRMSLFHGNVLQPLQSKLVKIDPQQLVSDISLSQNEENLQTDVPESDAPTGSVAQDDKYTKRNIILPGRDIVCAFNYSCCCLHKRAELVLYFKHAREALSTKGGIFVMDLYGGTSSEHKLRLQRRFPNFTYVWEQAEFDIIQRKTRISLHFHMKKEQRKLRHAFSYSWRLWTLPEIRDCLEEAGFRSVHFWVREMPDTTEIMRTEGFGAGKNVKYEEATSFQQQDSWNAYIVGVA

SEQ ID NO: 236 - protein, 440 aa, Glycine max
MEAKLATTIILIFSVIWLMRVNGIDPCASQADNSDLNVIPIYSKCSPFKPPKSDSSWDNRIINMASKDPLRFKYLSTLVGQKTVSTAPIASGQTFNIGNYVVRVKLGTPGQLLFMVLDTSTDEAFVPCSGCTGCSDTTFSPKASTSYGPLDCSVPQCGQVRGLSCPATGTGACSFNQSYAGSSFSATLVQDSLRLATDVIPNYSFGCVNAITGASVPAQGLLGLGRGPLSLLSQSGSNYSGIFSYCLPSFKSYYFSGSLKLGPVGQPKSIRTTPLLRSPHRPSLYYVNFTGISVGRVLVPFPSEYLGFNPNTGSGTIIDSGTVITRFVEPVYNAVREEFRKQVGGTTFTSIGAFDTCFVKTYETLAPPITLHFEGLDLKLPLENSLIHSSAGSLACLAMAAAPDNVNSVLNVIANFQQQNLRILFDTVNNKVGIAREVCN

SEQ ID NO: 237 - protein, 323 aa, Glycine max
MWWPFSRIGSSGFSSYSTAEEVTHGIDGSGLTAIVTGASSGLGAETARVLALRGVHVIMGVIDMIGAKTIKEAILKEIPIAKVDVMELDLSSMTSIRNFASNFNSSGLSLNILINNAGICAAPFALSKDNIELQFAINYLGHFLLTNMLLDTMKKATSESKKQGRIINVSSIGYRFTYREGIIFDKINDQSSYNNWCAYGQSKLANILHANELARRLKEDGIDITANSVHPGATVSTNIHIHSGLLNGLHKIAWLFGLEKILGYMAKNVQQGASTTCYVALHPQVSGISGKYFEDNNLAEVYSHGRDMNLAKKLWDFSINLTK

SEQ ID NO: 238 - protein, 322 aa, Glycine max
MATSNGFVDGTPSESALIFLGTGCSSMVPNLMCLLQPSDPPCPVCVQSLSIPPERNPNYRCNTSLLIDYGAAAANGGDRKYILIDVGKTFRETVLRWFVAHRIPRIDSIILTHEHADAVLGLDDIRAVQAFSPTNDIDPTPIYLSQHSMDSIAEKFPYLVQKKRKEGAEIRRVAQIDWNIIADDCNQQFFASGLKFTPLPVMHGEDYICLGFLFGEKNRVAYISDVSRFPASTEYVISKSGAGQLDLLILDSLYRTGSHNVHLCFPQTLETVKRLCPKQTLLIGMTHEFDHHKDNEFLMEWSRREGIPVKLAHDGLRVPINL

SEQ ID NO: 239 - protein, 543 aa, Glycine max
MSVNNNNPSKGIGASSSSFGNAGVPSNSIPSNPGFSQSQGQAQIPVGYQGQFPLSQAHAIVQAQSKAQAQAQAQAAAAAHAQLQAHLQAQGLSLNQNQAGGLGVSSPLISTPGNASGKRIPLKPPMRPVGFSPPNSFSPLRPVELTPAARRKKQKLPEKQLQDKVAAILPESALYTQLLEFESRVDAALARKKADIQEALKNPPCIQKTLRIYVFNTFANQIRTIPKKPNAELPTWTLKIVGRILEDGVDPDQPGVVQKSSPLYPKFSAFFKRVTISLDQRLYPDNHIIMWENARSPAPHEGFEVKRKGDKEFTVNIRLEMNYVPEKFKLSPALTEVLGIEVDTRPRIVAAIWHYVKARKLQNPNDPSYFHCDQPLLKVFGEEKMKFTMVSQKISSHLFPPQPILLEHKIKLSGNNPAGTACYDVMVDVPFPIQRELSALLANVEKNKEIETCDEAICGIIRKIHEHRRRRAFFLGFSQSPVEFINALIESQSKDLKLVSGEPSRNAEKERRSDFFNQPWVEDAVIRYLNRKPAVGSDAPGST

SEQ ID NO: 240 - protein, 291 aa, Glycine max
MMLKAAPRAVIYYLSEHPAIVGFRWSHAQSWGATWSFLFSSIASYLFLSVFLYFSLSLLFRRRQIPLGPLPAVHSLSMSLISATIFAGILLSAAAEISDTRWFWRRSKTPLQWLLCFPLGTRPSGRVFFWSYVYYLSRFLHMLRTLLRILRHRRLSFFHLLSNSISALASFLWLEFSQSFQVLAILFATLVYAAVYGYRFWTAIGLRGACFPFVLSCQIVLLACNVACHVAVFFLHFFLKGGCNGIGAWVFNSILNLALLMLSLNFYVRMHVHKRRRKVRDVTVTVATALS

SEQ ID NO: 241 - protein, 348 aa, Glycine max
MNAESPPGLLMSVSCLSDYDLLCGEDSSGILSGESPECSFSDIDSSPPPPSPTTEDCYSIASFIEHERNFVPGFEYLSRFQSRSLDANAREESVGWILKVHAYYGFQPLTAYLAVNYMDRFLDSRRLPETNGWPLQLVSVACLSLAAKMEEPLVPSLLDLQIEGAKYIFEPRTIRRMELLVLGVLDWRLRSVTPLCFLAFFACKVDSTGTFIRFLISRATEIIVSNIQEASFLAYWPSCIAAAAILTAANEIPNWSVVKPENAESWCEGLRKEKVIGCYQLMQELVINNNQRKLPTKVLPQLRVTTRTRMRSSTVSSFSSSSSTSFSLSCKRRKLNNRLWVDDKGNSE

SEQ ID NO: 242 - protein, 169 aa, Glycine max
MGLQNQLNDVSSGSIPLLVLAQIATCVNYLRSMLFALLQTLGLSRFHSDQIVDERFLAAVGSGLAGLIMLSDQLTLSSQFFHHHHGTAAGHDHDHDHHPCVVCQATFEDGDQVRMLSCRHVFHRRCFDGWLHHYKFNCPLCRSPLFSDERVALTERRLGQQLISWFSLH

SEQ ID NO: 243 - protein, 495 aa, Glycine max
VMMEMDSMCMWVVLVAIAGALLVLRSMLKNVNWWLYESKLGVKQYSLPPGDMGWPFIGNMWSFLRAFKSKDPDSFISSFVSRYGRTGMYKTLMFGNPSVIVTTPETCKRVLTDDDKFTTGWPQSTIELIGKRSFISMSYEEHKRLRRLTSSSINGMESLSLYLTYIEENVKNSLEKWANMGQIEFLTEIRKLTFKIIMHIFLSSESEPVMEALEREYTALNHGVRAMCINIPGFAYHKAFKARKNLVAIFQSIVDERRNLRKGYLPGKAKDMMDALIDVEDDDGRKLSDEDIIDIMLMYLNAGHESSGHITMWATFFLQKHPEYLQKAKAEQEEIIRRRPPTQKGLTLKEVREMDFLYKVIDETLRVITFSLVVFREAKSDVNINGYTIPKGWKALVWFRSVHLDPEIYPNPKEFNPYRWNKEHKAGEFLPFGGGSRLCPGNDLAKMEIAVFLHHFLLNYRFEQHNPNCPVRYLPHTRPMDNCLGRVRKCSSTTT

SEQ ID NO: 244 - protein, 362 aa, Glycine max
MPPKQQQSKADLAKKQKIVEDKTFGLKNKNKSKNVQKYVQNLKQSVQPRPDAAKVDAKKKKEEDKAKEKELNELFKIAVTQPKVPVGVDPKSILCEFFKVGQCAKGFKCKFSHDLNVQRKGEKIDIYSDKRDEETMEDWDQETLEKVVESKKTEYNQNKPTDIVCKYFLDAVEKKQYGWFWACPNGGKNCHYRHALPPGYVLKSQMKALLEEESEKISIEEEIENQRAKVATTTPMTPELFFEWKKKKIEERDANIAAQQAERAKNDRMSGRELFLSNASLFVDDAEAYDVYQREPESYETEQNGNRNAAEDGPCSSATAASDGEDLDDIDDDDELDMDELDELEASLSKTSIQIKETGAEA

SEQ ID NO: 245 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 246 - protein, 90 aa, Arabidopsis thaliana
MSSTSKAWTVAVSIGAVEALKDQLGLCRWNYILRSVNQHLRNNVRSVSQGKRFSSSSVSAAVTSSGESEKAKKAEESLRTVMYLSCWGPN

SEQ ID NO: 247 - protein, 93 aa, Arabidopsis thaliana
MVTKEQVEASLTSKLKPIHLEVIDISGGCGSSFEVEVVSEQFEGKRLLERHRMVNAALEEEMKEIHALSIKKAQTPQQWKPPSQDSATLTKDA

SEQ ID NO: 248 - protein, 624 aa, Arabidopsis thaliana
MAFSSSCSSVKAVNSRWTSPSPSPSSRFAVLPAFLHRRYATSVKLTAISAALKTVEQTTLTEDNRFSTVGSDSDEYNPTLPKPRILVTEKLGEAGVNLLREFGDVDCSYDLSPEDLKKKVAESDALIVRSGTKVTREVFEAAKGRLKVVGRAGVGIDNVDLQAATEHGCLVVNAPTANTVAAAEHGIALLASMARNVAQADASIKAGKWERSKYVGVSLVGKTLAVMGFGKVGTEVARRAKGLGMTVISHDPYAPADRARALGVDLVSFDQAISTADFVSLHMPLTPATKKVFNDETFSKMKKGVRLINVARGGVIDEDALVRALDAGIVAQAALDVFCEEPPSKDSRLIQHENVTVTPHLGASTKEAQEGVAIEIAEAVAGALKGELSATAVNAPMVAPEVLSELTPYIVLAEKLGRLAVQLASGGKGVQSIRVVYRSARDRDDLDTRLLRAMITKGIIEPISDSYVNLVNADFIAKQKGLRISEERMVVDSSPEYPVDSIQVQILNVESNFAGAVSDAGDISIEGKVKYGVPHLTCVGSFGVDVSLEGNLILCRQVDQPGMIGQVGNILGEQNVNVNFMSVGRTVLRKQAIMAIGVDEEPDNKTLERIGGVSAIEEFVFLKL

SEQ ID NO: 249 - protein, 449 aa, Arabidopsis thaliana
  misc_feature (170)..(170): Xaa can be any naturally occurring amino acid
  unsure (1)..(449): unsure at all Xaa locations
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLVPLFNXDLQDVFQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFWVET

SEQ ID NO: 250 - protein, 512 aa, Arabidopsis thaliana
MAESAGESYRLLSVSSSTTFLAFIIIFLLAGIARRKRRAPHRLPPGSRGWPLIGDTFAWLNAVAGSHPSSFVEKQIKKFVSLLCSVLLLILKRPDNSGFNEIRYGRIFSCSLFGKWAVVSADPDFNRFIMQNEGKLFQSSYPKSFRDLVGKDGVITVHGDQQRRLHSIASSMMRHDQLKTHFLEVIPVVMLQTLSNFKDGEVVLLQDICRKVAIHLMVNQLLGVSSESEVDEMSQLFSDFVDGCLSVPIDLPGFTYNKAMKARKEIIRKINKTIEKRLQNKAASDTAGNGVLGRLLEEESLPNESMADFIINLLFAGNETTSKTMLFAVYFLTHCPKAMTQLLEEHDRLAGGMLTWQDYKTMDFTQCVIDETLRLGGIAIWLMREAKEDVSYQDYVIPKGCFVVPFLSAVHLDESYYKESLSFNPWRWLDPETQQKRNWRTSPFYCPFGGGTRFCPGAELARLQIALFLHYFITTYKWTQLKEDRISFFPSARLVNGFKIQLNRRDSDPPNQ

SEQ ID NO: 251 - protein, 266 aa, Arabidopsis thaliana
LILICCSVSLCVIGKKKKMLAIFDKNVAKTPEALQGQEGGSVCALKDRFLPNHFSSVYPGAVTINLGSSGFIACSLEKQNPLLPRLFAVVDDMFCIFQGHIENVPILKQQYGLTKTATEVTIVIEAYRTLRDRGPYSAEQVVRDFQGKFGFMLYDCSTQNVFLAGDVDGSVPLYWGTDAEGHLVVSDDVETVKKGCGKSFAPFPKGCFFTSSGGLRSYEHPSNELKPVPRVDSSGEVCGVTFKVDSEAKKEAMPRVGSVQNWSKQI

SEQ ID NO: 252 - protein, 104 aa, Arabidopsis thaliana
MGIQLIGLSQAKQKLQRSLSARIASLLATSGTNNVPKGHVAVYVGETYHRKRFVIPISYLNHPLFQGLLNLAEEEFGFDHPMGGLTIPCTEDYFTALASILSGS

SEQ ID NO: 253 - protein, 389 aa, Arabidopsis thaliana
MSPSWLRPTADHNHPPPQPPSQSPSPLSSGDPNLTTCLYQTDHGVFYLTWSRTFLGGHSVNLFLHSQDYYNHSSPLSFSSADLSLSSAVSFHLNLNTLAFWKKRGSRFVSPKIQVFWDLSKAKFDSGSEPRSGFYIAVVVDGEMGLLVGDSVKEAYARAKSAKPPTNPQALLLRKEHVFGARVFTTKARFGGKNREISIDCRVDEDAKLCFSVDSKQVLQIKRLRWKFRGNEKVEIDGVHVQISWDVYNWLFQSKSSGDGGGGGGHAVFMFRFESDPEAEEVCETKRKEEEDEKNRNGIVLWKPKKQCGNSFGIKGIVEWRKMRKRFVKSKRSSSSSSISMSSASSACSSSVMEWASSADEAEYGGGGCSGSGSGNGLGFSLLVYAWIK

SEQ ID NO: 254 - protein, 253 aa, Arabidopsis thaliana
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTNKKPVDLIRKSQLERLQGSKSCKTSDSQNQGSFFVLPDLNMAPSEEEILYGTS

SEQ ID NO: 255 - protein, 351 aa, Arabidopsis thaliana
MQGGSSGIGYGLKYQSRCISDVKADTDYTSFLTGTLSLKEENEVHLLRLSSGGSELICEGLFSHPNEIWDLASCPFDQRIFSTVFSTGESFGAAIWQIPELYGQLNSPQLERVASLDAHVGKINCVLWWPSGRCDKLISIDEQNIFLWSLDCSKKSAEVLSKDSAGMLHSLSGGAWDPHDVNAVAATGESSVQFWDLRTMKKVNSIEHAHVRGVDYNPKREHILVTAEDESGIHVWDLRKAKVPVQELPGHTHWTWAVRCNPEYDGLILSAGTDSVVNLWYASATSSDDKTSESPVESTRQRVNPLLNSYTDYEDSVYGLAWSSREPWVFASLSYDGRVIIESVKPFLPRI

SEQ ID NO: 256 - protein, 353 aa, Arabidopsis thaliana
MEIDLGANAFGIDFHPSTNLVAAGLIDGHLHLYRYDSDSSLVRERKVRAHKESCRAVRFIDDGQRIVTASADCSILATDVETGAQVAHLENAHEDAVNTLINVTETTIASGDDKGCVKIWDTRQRSCSHEFNAHEDYISGMTFASDSMKLVVTSGDGTLSVCNLRTSKVQSQSEFSEDELLSVVIMKNGRKVICGTQNGTLLLYSWGFFKDCSDRFVDLAPNSVDALLKLDEDRLITGCDNGIISLVGILPNRIIQPIGSHDYPIEDLALSHDKKFLGSTAHDSMLKLWNLEEILEGSNVNSGNASGAAEDSDSDNDGMDLDNDPSKSSKGSKRKTKSKANTLNATNNFFADL

SEQ ID NO: 257 - protein, 430 aa, Arabidopsis thaliana
MSPIPKPLFFFFFLNYVSLSTSLSLHLPLTSLPISTTTNSHRFTTSLLSRKNPSPSSPPYNFRSRFKYSMALIISLPIGTPPQAQQMVLDTGSQLSWIQCHRKKLPPKPKTSFDPSLSSSFSTLPCSHPLCKPRIPDFTLPTSCDSNRLCHYSYFYADGTFAEGNLVKEKITFSNTEITPPLILGCATESSDDRGILGMNRGRLSFVSQAKISKFSYCIPPKSNRPGFTPTGSFYLGDNPNSHGFKYVSLLTFPESQRMPNLDPLAYTVPMIGIRFGLKKLNISGSVFRPDAGGSGQTMVDSGSEFTHLVDAAYDKVRAEIMTRVGRRLKKGYVYGGTADMCFDGNVAMIPRLIGDLVFVFTRGVEILVPKERVLVNVGGGIHCVGIGRSSMLGAASNIIGNVHQQNLWVEFDVTNRRVGFAKADCSRVV

SEQ ID NO: 258 - protein, 159 aa, Arabidopsis thaliana
MGKARTVGVGMDYSPTSKLALRWAAENLLEDGDTVILIHVQPQNADHTRKILFEETGSPLIPLEEFREVNLSKQYGLAYDPEVLDVLDTLSRAKKVKVVAKVYWGDPREKLCDAVENLKLDSIVLGSRGLGSLKRILLGSVSNHVVTNATCPVTVVKAN

SEQ ID NO: 259 - protein, 295 aa, Arabidopsis thaliana
MADPRVAVVTGSNKGIGFEICRQLANNGITVVLTARDENKGLAAVQKLKTENGFSDQAISFHPLDVSNPDTIASLAAFVKTRFGKLDILVNNAGVGGANVNVDVLKAQIAEAGAPTDISKIMSDTYEIVEECVKTNYYGVKRMCEAMIPLLQSSDSPRIVSIASTMGKLENVSNEWAKGVLSDAENLTEEKIDEVINEYLKDYKEGALQVKGWPTVMSGYILSKAAVIALTRVLAKRHKSFIINSVCPGFVNTEINFNTGILSVEEGAASPVKLALVPNGDPSGLFFDRANVSNF

SEQ ID NO: 260 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSYSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 261 - protein, 597 aa, Arabidopsis thaliana
MASTSIMLSSFFSFFFLTFFVTYAQQNVTVHTICYYDGGNFTSNTSYSLNLNRLISSLPDLTPTINGFYNISINGEVNAIALCRGDVKPNQDCISCITTAAKQLVESCPNIIEANIWLEKCMFRYTSRIILGQMEPVPFSYTSSNVSVTDKEGFSKGLGDLLDSLGAKIDAANETKEVKFAAGVKGTIYALAQCTPDLSESDCRICLAQIFAGVPTCCDGKTGGWWTNPSCYFRFEVYPFFDLSVTSEQKQPLSSHNNNTRRSDQGKSKDRSKTLIFAVVPIVAIILGLVFLFIYLKRRRKKKTLKENAENEFESTDSLHFDFETIRVATDDFSLTNKIGEGGFGVVYKSLIRSFLLPMISFSLFHFFPLLMNLDPIKQKQLDWEKRYNIIVGVSRGLLYLHEGSEFPIIHRDLKSSNVLLDEQMLPKISDFGMARQFDFDNTQAVTRRVVGTYGYMAPEYAMHGRFSVKTDVYSFGVLVLEIITGKRNSGLGLGEGTDLPTFAWQNWIEGTSMELIDPVLLQTHDKKESMQCLEIALSCVQENPTKRPTMDSVVSMLSSDSESRQLPKPSQPGFFRRSASFSISLNDVSLTDLSAR

SEQ ID NO: 262 - protein, 336 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMFQEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 263 - protein, 550 aa, Arabidopsis thaliana
MNLSFSSYNLTATAVSSSCFGSDELLVSRRLFSLRDVQILELFIAFFVFATIHSLRQKKHQGMPVWPLVGMLPSLISAVRSNIYEWLSDVLISQNGTFRFRGPWFSTLNCVVTCDPRNVEHLLKTRFSIYPKGSYFRETMQDLLGDGIFNTDDGTWQRQRKAASVEFHSAKFRQLTSQSLHELVHNRLLPVLETSGKIDLQDILLRLTFDNVCMIAFGVDPGCLSPKLPEIPFAKAFEDATEATVVRFVMPKFVWKLMRSLNLGTEKKLKESINGVDDFAEEVIRTRKKEMSLETEIAKRPDLLTIFMGLRDENGQKFSDKFLRDICVNFILAGRDTSSVALSWFFWLIEKNPEVEEKIMMGICKILEQRVDHGDTKKNMEYEPVFRPEEIKKMDYLQAALSETLRLYPSVPVDHKEVLEDDVFPDGTKLKKGEKVIYAIYAMGRMETIWGKDCREFKPERWLRDGRYMSESAYKFTAFNGGPRLCLGKDFAYYQMRYVAAAIIYRYKVRVDDKGGHKVEPKMALTMYMKHGLKVNMVKRSVSEIDHYYC

SEQ ID NO: 264 - protein, 506 aa, Arabidopsis thaliana
MAFLLSFLILAFLITIIFFLSSSSTKKVQENTTYGPPSYPLIGSILSFNKNRHRLLQWYTELLRLSPSQTILVPLLGNRRTIITTNPLNVEYILKTNFFNFPKGKPFTDLLGDLLGGGIFNVDGHSWSSQRKLASHEFSTRSLRSFAFEVLKDEVENRLVPVLSTAADVGTTVDLQDVLKRFAFDVVCKVSLGWDPDCLDLTRPVNPLVEAFDTAAEISARRATEPIYAVWKTKRVLNVGSERKLREAIRTVHVLVSEIVRAKKKSLEIGTGAEAKQDLLSRFLAAGHNGEAVRDMVISFIMAGRDTTSAAMTWLFWLLTENDDVERKILEEVDPLVSLGLGFEDLKEMAYTKACLCEAMRLYPPVSWDSKHAANDDVLPDGTRVKRGDKVTYFPYGMGRMETLWGTDSEEFNPNRWFDSEPGSTRPVLKPISPYKFPVFQAGPRVCVGKEMAFMQMKYVVGSVLSRFEIVPVNKDRPVFVPLLTAHMAGGLKVKIKRRSHILNNV

SEQ ID NO: 265 - protein, 316 aa, Arabidopsis thaliana
MGFLRCLQLLLLLFLSLRLQKLSAQSSSPNASSSSSLDALLQDYSFRALLRPRTGILYEATTVPSNLTGIKLAAMRLRSGSFRKRGVTPFNEFSIPSGVIVKPYVTRLVLVYQNLANFSHLYYPLSGYDYVAPVLGLLAYDAKNLSALNLPQLDLRVSNDPIRIDFSDLERIPQGSSAKCVRFDSKGEASFSDSIQPGNTCETEHQGHFSVVVKSVASAPSLAPPGIESKKKKKSSDSNSKTWIIVGSVVGGLILLGLLLFLVLRCRNYKKQEKMREMERAGETGEALRMTQVGETRAPTATTTRTQPMLETEYAA

SEQ ID NO: 266 - protein, 76 aa, Arabidopsis thaliana
MIGRRAGTNRVGMRRDDSLLTRFVDSVFYFFRLAEFEILFVLFMLITYVIFKDLTSRPEYNRILVEKPGGSDIWPF

SEQ ID NO: 267 - protein, 181 aa, Arabidopsis thaliana
MAASLTSLPTGFCLSHGDECCNRSPTKSPFPGHHPLAGRRKGHLLHYERSTVRRLVVTAATEGSKKSKESEPSWANPDSDEPPPWARNEGRSSTSQESFEVPFFVYLLASAITAIAAIGSVFEYTSKNPVFGILESDSIFYTPVLGFFALTGIPTSVFLWFKSVEAANKEAQEQDKRDGFL

SEQ ID NO: 268 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESSYKFLAFNAGPRTCLGKRLTFLQMKTVAVEIIRNYDIKVVEGHKPKPVPSVLLRMQHGLKVSVTKI

SEQ ID NO: 269 - protein, 434 aa, Saccharomyces cerevisiae
MSLPGSKLEEARRLVNEKQYNEAEQVYLSLLDKDSSQSSAAAGASVDDKRRNEQETSILELGQLYVTMGAKDKLREFIPHSTEYMMQFAKSKTVKVLKTLIEKFEQVPDSLDDQIFVCEKSIEFAKREKRVFLKHSLSIKLATLHYQKKQYKDSLALINDLLREFKKLDDKPSLVDVHLLESKVYHKLRNLAKSKASLTAARTAANSIYCPTQTVAELDLMSGILHCEDKDYKTAFSYFFESFESYHNLTTHNSYEKACQVLKYMLLSKIMLNLIDDVKNILNAKYTKETYQSRGIDAMKAVAEAYNNRSLLDFNTALKQYEKELMGDELTRSHFNALYDTLLESNLCKIIEPFECVEISHISKIIGLDTQQVEGKLSQMILDKIFYGVLDQGNGWLYVYETPNQDATYDSALELVGQLNKVVDQLFEKASVLY

SEQ ID NO: 270 - protein, 487 aa, Arabidopsis thaliana
MGKQQDWSVTACIFLSLSLASQIHCSSQTHFPSHKGGAGLSGDTSHFNSVSRENVLSLKEKDLIEKLPGQPSGISFRQYGGYVAVNEPATRFLYYYFVEAIKPSKSTPLVLWFNGGPGCSSVGFGAFEELGPFRVHSDGKTLYRNPYSWNNEANMLFFEGPISVGFSYSSTPFDWEIFGEQADKLTAEDNYMFLVNWLERFPEYKGRDVYISGQSYAGHYIPQLAQIILHRNNQTFINLRGISIGNPGLDLLIEADNENKFILSHGLVSQKDFEEYSKVCDFANYDMDECPKIMPKFSIEHNKHLDVYNIYAPVCLNSTLSSEPKKCTTIMEVDPCRSNYVKAYLNSENVQEAMHANTTKLPYEWKACNHYLNSVWIDADKDASMVPILHDLMGEGVRVLVYSGDVDAAIPFTATMAVLKTMNLTVVNEWRPWFTGGQLGGFTEDYERNLTYATVKGSGHSVPLDQPVHALNLFTSFIRNTPLPQTP

SEQ ID NO: 271 - protein, 289 aa, Arabidopsis thaliana
MSLFNTENTWAFVFGLLGNLISFAVFLSPVPTFYRIWKKKTTEGFQSIPYVVALFSATLWLYYATQKKDVFLLVTINAFGCFIETIYISMFLAYAPKPARMLTVKMLLLMNFGGFCAILLLCQFLVKGATRAKIIGGICVGFSVCVFAAPLSIIRTVIKTRSVEYMPFSLSLTLTISAVIWLLYGLALKDIYVAFPNVLGFALGALQMILYVVYKYCKTSPHLGEKEVEAAKLPEVSLDMLKLGTVSSPEPISVVRQANKCTCGNDRRAEIEDGQTPKHGKQSSSAAAT

SEQ ID NO: 272 - protein, 261 aa, Saccharomyces cerevisiae
MPQNDYIERHIKQHGKRLDHEERKRKREARESHKISERAQKLTGWKGKQFAKKRYAEKVSMRKKIKAHEQSKVKGSSKPLDTDGDALPTYLLDREQNNTAKAISSSIKQKRLEKADKFSVPLPKVRGISEEEMFKVIKTGKSRSKSWKRMITKHTFVGEGFTRRPVKMERIIRPSALRQKKANVTHPELGVTVFLPILAVKKNPQSPMYTQLGVLTKGTIIEVNVSELGMVTAGGKVVWGKYAQVTNEPDRDGCVNAVLLV

SEQ ID NO: 273 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 274 - protein, 240 aa, Saccharomyces cerevisiae
MWSSLFGWTSSNAKNKESPTKAIVRLREHINLLSKKQSHLRTQITNQENEARIFLTKGNKVMAKNALKKKKTIEQLLSKVEGTMESMEQQLFSIESANLNLETMRAMQEGAKAMKTIHSGLDIDKVDETMDEIREQVELGDEISDAISRPLITGANEVDEDELDEELDMLAQENANQETSKIVNNNVNAAPISENKVSLPSVPSNKIKQSENSVKDGEEEEDEEDEDEKALRELQAEMGL

SEQ ID NO: 275 - protein, 546 aa, Saccharomyces cerevisiae
MEPLLFNSGKANPSQDVFIDVEVGDITTKYGSTNTGSFSSMDTVEAQAIKAETARFMEVPQGRHLGVFSTVVLFVSRIMGSGIFAVPSVILLNTGGNKLIYFAIWVFSAAIAFAGLYLFLEFGSWIPKSGGRKNFLERSFERPRLLISVVFSCYSVLTGYALTGSIVFGKYVLSAFGVTDDSWSKYVSISFIIFAVLIHGVSVRHGVFIQNALGGLKLIMIVLMCFAGLYTLFFYKSTGQVAWDLPVTQVEKDSLLSVSSIATAFISSFFCFSGWDTVHTVTSEIKNPVKTLKVSGPLSLIICFVCYTMMNVAYLKVLTYEEIVSAGPLVGSVLFTKLFGPRVGGKFIAFSIAISAASNILVVIYSISRVNQEIFKEGYLPFSIHMSKNWPFDAPLPSISLCGFITIAWILILPKEGESFNYLVSMDGYGNQFFLLLVAIGLFIWRFKHKNEVPEIRASTFGVLAIITLSLYMLMAPFFADPSLNRVGFLPPYQIMSLLVIVACFFFWLVKFVLLPKFFHYKLLPKITYLHDGLIVTEWVKKPCLC

SEQ ID NO: 276 - protein, 1057 aa, Arabidopsis thaliana
MVKSGARASDSFIKQRSGSGSILRIKVENFMCHSNLQIEFGEWVNFITGQNGSGKSAILTALCVAFGCRARGTQRAATLKDFIKTGCSYAVVQVEMKNSGEDAFKPEIYGGVIIIERRITESATATVLKDYLGKKVSNKRDELRELVEHFNIDVENPCVVMSQDKSREFLHSGNDKDKFKFFFKATLLQQVNDLLQSIYEHLTKATAIVDELENTIKPIEKEISELRGKIKNMEQVEEIAQRLQQLKKKLAWSWVYDVDRQLQEQTEKIVKLKERIPTCQAKIDWELGKVESLRDTLTKKKAQVACLMDESTAMKREIESFHQSAKTAVREKIALQEEFNHKCNYVQKIKDRVRRLERQVGDINEQTMKNTQAEQSEIEEKLKYLEQEVEKVETLRSRLKEEENCFLEKAFEGRKKMEHIEDMIKNHQKRQRFITSNINDLKKHQTNKVTAFGGDRVINLLQAIERNHRRFRKPPIGPIGSHVTLVNGNKWASSVEQALGTLLNAFIVTDHKDSLTLRGCANEANYRNLKIIIYDFSRPRLNIPRHMVPQTEHPTIFSVIDSDNPTVLNVLVDQSGVERQVLAENYEEGKAVAFGKRLSNLKEVYTLDGYKMFFRGPVQTTLPPLSRRPSRLCASFDDQIKDLEIEASKEQNEINQCMRRKREAEENLEELELKVRQLKKHRSQAEKVLTTKELEMHDLKNTVAAEIEALPSSSVNELQREIMKDLEEIDEKEAFLEKLQNCLKEAELKANKLTALFENMRESAKGEIDAFEEAENELKKIEKDLQSAEAEKIHYENIMKNKVLPDIKNAEANYEELKNKRKESDQKASEICPESEIESLGPWDGSTPEQLSAQITRMNQRLHRENQQFSESIDDLRMMYESLERKIAKKRKSYQDHREKLMACKNALDSRWAKFQRNASLLRRQLTWQFNAHLGKKGISGHIKVSYENKTLSIEVKMPQDATSNVVRDTKGLSGGERSFSTLCFALALHEMTEAPFRAMDEFDVFMDAVSRKISLDALVDFAIGEGSQWMFITPHDISMVKSHERIKKQQMAAPRS

SEQ ID NO: 277 - protein, 207 aa, Arabidopsis thaliana
MENMSNLTSKFLLNPLNVHKHCAVSDENGDRKSHVLKQVCSCICCCNRRNKTQARSQKGSYFIKGKVHPVSRMEKWEEKITEANSHGKIIARHDLILCNMEQLVVNFKASWCLPSKTILPIYQELASTYTSMIFVTIDVEELAISKLSDLGVKICLIQEFSHEWNVDATPTVVFLKDGRQMDKLVGGDAAELQKKTAAAANLLLRQS

SEQ ID NO: 278 - protein, 153 aa, Arabidopsis thaliana
MDSGTKVKKGAAGRRSGGGPKKKPVSRSVKSGLQFPVGRIGRYLKKGRYSKRVGTGAPVYLAAVLEYLAAEVLELAGNAARDNKKNRIIPRHVLLAVRNDEELGTLLKGVTIAHGGVLPNINPILLPKKSEKAASTTKTPKSPSKATKSPKKS

SEQ ID NO: 279 - protein, 335 aa, Saccharomyces cerevisiae
MASSMLSSATMVASPAQATMVAPFNGLKSSAAFPATRKANNDITSITSNGGRVNCMQVWPPIGKKKFETLSYLPDLTDSGGRVNCMQAMAKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 280 - protein, 395 aa, Bacillus halodurans
MKLAKRVSTLTPSSTLAITAKAKELKEQGHDVIGLGAGEPDFNTPQYIIDAAVRSMEEGHTKYTPSGGLPKLKEAIIEKFKQDQGLTYTAKEIFVGTGAKHVLYTLFQALLNEGDEVIIPSPYWVSYPEQVKLAGGEPVFVEGKESNDFKLTPAQLEPVLTDRTKAIIINSPSNPTGSLYTQEELAALGEVCLKHNVLIISDEIYEKLVYDGAKHTSVAEISPQLKENTVVINGVSKSHSMTGWRIGYAAGPEALIQAMTNLASHSTSNPTTSAQYGAIAAYTEDDGSVEKMRVAFEERLHTIYDKLVAIPGVSCVKPKGAFYLFPNVEEAAALTGHETVDDFVKVLLEEEKVALVPGSGFGAPDNVRLSYATSLELLEAAIDRIFRFVEAKRSK

SEQ ID NO: 281 - protein, 510 aa, Bacillus halodurans
MSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 282 - protein, 444 aa, Bacillus subtilis subsp. subtilis str. 168
MTKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 283 - protein, 426 aa, Escherichia coli K12
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 284 - protein, 470 aa, Escherichia coli K12
MEKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 285 - protein, 341 aa, Sinorhizobium meliloti
MSERLEDIAVAMVANGRGLLAADESTATIKKRFDSIGLESTETSRRDYREMLLRSDDAMREYISGVILYEETLFQKAADGTPLADVIRNAGSIPGIKVDTGAKPMAHFPNETITEGLDGLAARLARYHEAGARFAKWRGVIAISDALPTWGAIRANAHALARYAALCQEAKIVPIVEPEVLMDGAPGDHSIERSEEVTEWVLRTVFEELGELRVRLEGMILKPSMVIDGKKARKASVDEVAERTIKVLKRTVPAAVPGIAFLSGGQSTEEATAHLSAMNAAHDLPWKLTFSYGRALQQEALNAWGGKSENVAAGQRAFAHRAKMCSLAAKGSWTKDFEKAA

SEQ ID NO: 286 - protein, 255 aa, Xenorhabdus nematophila
MGHPLVMGNWKLNGSTHMVNDLIAGLRKELSNVDGCGVAIAPPTVYVSLAKNALAGSRIALGAQDVDVNLSGAFTGETSAEMLKDVGAKYIIIGHSERRTYHKESDELIAKKFTILKEQGLIPVLCIGETEQENEAGQTEAVCARQIDAVLNTLGAEAFKDTVIAYEPVWAIGTGKSATPAQAQAVHKFIRDHIAKQDAAIAGQVIIQYGGSVNAGNAAELFTQPDIDGALVGGASLKADAFAVIVKAAAEAKKA

SEQ ID NO: 287 - protein, 149 aa, Synechocystis sp. PCC 6803
MERTFIMIKPDGVQRQLIGEIVGRFEKKGFKLVAMKVMTVSQELAEKHYEALNDKPFFSGLVNFICSSPVVAMVWEGNSIVSTSRQMIGATDPHAAAPGTIRGDYGVSVGRNIIHGSDAIETAKREISLWFKDEEVNEWDATLNPWLYE

SEQ ID NO: 288 - protein, 141 aa, Pseudomonas fluorescens PfO-1
MAVQRTFSIIKPDAVAKNVIGKITTRFEDAGLRVVASKLKQLSKAEAEGFYAEHSARGFFGELVAFMTSGPVVVQVLEGENAIARNRELMGATNPKEAAPGTIRADFAESIDANAVHGSDSEAAAAREIAYFFAATEVTTR

SEQ ID NO: 289 - protein, 219 aa, Xenorhabdus nematophila
MTQDELKKAVGWAALEYVKPGTVVGVGTGSTASHFIDALGTMKDQIEGAVSSSEASTEKLKSLGIPVFDCNEVDSLDIYVDGADEINAQMQMIKGGGAALTREKIIAAVAKKFICIIDESKQVDVLGKFPLPVEVIPMARSYVARELLKLGGTPVYRQNVITDNGNVILDVHNLAILNPIELENKINAIAGVVTVGLFANRGANVVLVGSSNGVKTITE

SEQ ID NO: 290 - protein, 809 aa, Arabidopsis thaliana
METSSIEINELPLATKTQTPPASVEPIPMETSSIDELPSSDSNATDNIEAVGEKRKRADEDEKTNLESSDTKITTPSPWWKTSLCSYFRREASCSHGNECKYAHGEAELRMKPDNTWDPTSERGKKAKAMKMSEHEEKEEDEVLFTEQMMESIDGDEGGGGSVSVVDLSLSKCLVHLPNKWQSDELKKFLGEQGVLYKSAKKRRGMIVGFVTFENAEQLQSGVEILDGKTVNSSNLKIADVLPRTFDKNDARKSVKSARDAVTPLAYLSYADQLEQKKTSIGQMLKKLARNARKACPNGNSLPQWVLTSRDRGGLACNLEGIIESPITNGYRNKCEFSVGLSLQGKPTVGFSLGSFCAGVTAVEEPVDCPNVSKIASQYASIFQKFIENSKFQVWNRFQHSGFWRQLTVREGRKPGVFSNDEDAITRIAEVMLMVQVCLTGSDEAEVATEFEELAKAFAEGARASSPTLPLTVLVVQNHSGISNVAPPDAPLQVLAIPISDNGTDQEQTTNVLTEARIHDHINNLRFSISPTAFFQVNTVTAEKLYSIAGDWADLGPDTLLFDVCCGTGTIGLTLAHRVGMVIGIEMNASAVADAERNATINGISNCKFICSKAEDVMSSLLKQYLDVTQMEEAKPLSNANDDLNKQIPSTEEMTNSEHVADQNLPPSNTQVEELQDNEQKDSSSLEPEKTTKPQFKNVVAIVDPPRSGLHPAVIKALRTHPRLKRLVYISCNPETLVANAIELCTPSFDEPDRGNKNYRGRKKIGIAALARHRAKSMPTSEAFRPVKAMAVDLFPHTDHCEMVMLLER

SEQ ID NO: 291 - protein, 587 aa, Saccharomyces cerevisiae
MANRLLIYGLILWVSIIGSFALDRNKTAQNAKIGLHDTTVITTGSTTNVQKEHSSPLSTGSLRTHDFRQASKVDIRQADIRENGERKEQDALTQPATPRNPGDSSNSFLSFDEWKKVKSKEHSSGPERHLSRVREPVDPSCYKEKECIGEELEIDLGFLTNKNEWSEREENQKGFNEEKDIEKVYKKKFNYASLDCAATIVKSNPEAIGATSTLIESKDKYLLNPCSAPQQFIVIELCEDILVEEIEIANYEFFSSTFKRFRVSVSDRIPMVKNEWTILGEFEARNSRELQKFQIHNPQIWASYLKIEILSHYEDEFYCPISLIKVYGKSMMDEFKIDQLKAQEDKEQSIGTNNINNLNEQNIQDRCNNIETRLETPNTSNLSDLAGALSCTSKLIPLKFDEFFKVLNASFCPSKQMISSSSSSAVPVIPEESIFKNIMKRLSQLETNSSLTVSYIEEQSKLLSKSFEQLEMAHEAKFSHLVTIFNETMMSNLDLLNNFANQLKDQSLRILEEQKLENDKFTNRHLLHLERLEKEVSFQRRIVYASFFAFVGLISYLLITRELYFEDFEESKNGAIEKADIVQQAIR

SEQ ID NO: 292 - protein, 489 aa, Saccharomyces cerevisiae
MSNAALQVYGGDEVSAVVIDPGSYTTNIGYSGSDFPQSILPSVYGKYTADEGNKKIFSEQSIGIPRKDYELKPIIENGLVIDWDTAQEQWQWALQNELYLNSNSGIPALLTEPVWNSTENRKKSLEVLLEGMQFEACYLAPTSTCVSFAAGRPNCLVVDIGHDTCSVSPIVDGMTLSKSTRRNFIAGKFINHLIKKALEPKEIIPLFAIKQRKPEFIKKTFDYEVDKSLYDYANNRGFFQECKETLCHICPTKTLEETKTELSSTAKRSIESPWNEEIVFDNETRYGFAEELFLPKEDDIPANWPRSNSGVVKTWRNDYVPLKRTKPSGVNKSDKKVTPTEEKEQEAVSKSTSPAANSADTPNETGKRPLEEEKPPKENNELIGLADLVYSSIMSSDVDLRATLAHNVVLTGGTSSIPGLSDRLMTELNKILPSLKFRILTTGHTIERQYQSWLGGSILTSLGTFHQLWVGKKEYEEVGVERLLNDRFR

SEQ ID NO: 293 - protein, 453 aa, Saccharomyces cerevisiae
MIQTQSTAIKRRNSVHKNLFDPSLYQIPEPPRGGFQHQKKEYSKETFSNQVFGYDITSLKKRFTQLFPSNIQGYLPEVDLRITIICSIWYVTSSISSNLSKAILRTFNHPIALTELQFLVSAVLCVGFASIVNLFRLPRLKHTKFSKALNSFPDGILPEYLDGNFRSSILHKFLVPSKLVLMTTFPMGIFQFIGHITSHKAVSMIPVSLVHSVKALSPIITVGYYKFFEHRYYNSMTYYTLLLLIFGVMTTCWSTHGSKRASDNKSGSSLIGLLFAFISMIIFVAQNIFAKNILTIRRKVGILPSSSTDDVTSKEGQPSLDKTRFSPLQVDKITILFYCSCIGFSLTLLPFLTGELMHGGSVINDLTLETVALVAIHGIAHFFQAMLAFQLIGLLSSINYSVANIMKRIVVISVALFWETKLNFFQVFGVILTIAGLYGYDKWGLSKKDGRQA

SEQ ID NO: 294 - protein, 627 aa, Saccharomyces cerevisiae
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 295 - protein, 602 aa, Saccharomyces cerevisiae
MPEQEPLSPNGRKRSEVHYISIPLNRGSAFSPDDSVSQFQSDGFMTRRQSILDHPVGSFKGVNSLSRFATSLRRANSFRNIELNADNERSFFKESNDETYDPDTLAPALDGRRLSVTLNNAGRPRITNLANNDRVSTASMAIHDDDYGSIQNSTIGDSGSILRPTASLTEMMSGGAGRRFTNNDMDSIVVKRVEGVDGKVVTLLAGQSTAPQTIFNSINVLIGIGLLALPLGLKYAGWVIGLTMLAIFALATFCTAELLSRCLDTDPTLISYADLGYAAFGTKGRALISALFTLDLLGSGVSLVILFGDSLNALFPQYSTTFFKIVSFFIVTPPVFIPLSVLSNISLLGILSTTGTVLVICCCGLYKSSSPGSLVNPMETSMWPIDLKHLCLSIGLLSACWGGHAVFPNLKTDMRHPDKFKDCLKTTYKITSVTDIGTAVIGFLMFGNLVKDEITKNVLLTEGYPKFVYGLISALMTIIPIAKTPLNARPIVSVLDVLMNVQHIDEAASAIKRRAAKGLQVFNRIFINVVFVLIAINFPEFDKIIAFLGAGLCFTICLILPCWFYLRLCKTTIKPWERVACHVTICISVVLSTLGVGAAIIS

SEQ ID NO: 296 - protein, 414 aa, Arabidopsis thaliana
MNCFSCFYFHEKKKVPRDSDNSYRRNGEVTGRDNNKTHPENPKTVNEQNKNNDEDKEVTNNIAAQTFSFRELATATKNFRQECLIGEGGFGRVYKGKLEKTGMIVAVKQLDRNGLQGNKEFIVEVLMLSLLHHKHLVNLIGYCADGDQRLLVYEYMSRGSLEDHLLDLTPDQIPLDWDTRIRIALGAAMGLEYLHDKANPPVIYRDLKAANILLDGEFNAKLSDFGLAKLGPVGDKQHVSSRVMGTYGYCAPEYQRTGQLTTKSDVYSFGVVLLELITGRRVIDTTRPKDEQNLVTWAQPVFKEPSRFPELADPSLEGVFPEKALNQAVAVAAMCLQEEATVRPLMSDVVTALGFLGTAPDGSISVPHYDDPPQPSDETSVEDSVAAEERERAVAEAMEWGVASRAHSRNPSAS

SEQ ID NO: 297 - protein, 603 aa, Arabidopsis thaliana
MLETESSVCDNIAGNEKWRAEAEIGGNERALQALRELIIFPFRYPLEARTLGLKWPRGLLLYGPPGTGKTSLVRAVVQECDAHLIVLSPHSVHRAHAGESEKVLREAFAEASSHAVSDKPSVIFIDEIDVLCPRRDARREQDVRIASQLFTLMDSNKPSSSAPRVVVVASTNRVDAIDPALRRAGRFDALVEVSTPNEEDRLKILQLYTKKVNLDPSVDLQAIAISCNGYVGADLEALCREATISASKRSSDSLILTSQDFKIAKSVVGPSINRGITVEIPKVTWDDVGGLKDLKKKLQQAVEWPIKHSAAFVKMGISPMRGILLHGPPGCSKTTLAKAAANAAQASFFSLSCAELFSMYVGEGEALLRNTFQRARLASPSIIFFDEADVVACKRGDESSSNSSTVGERLLSTLLTEMDGLEEAKGILVLAATNRPYAIDAALMRPGRFDLVLYVPPPDLEARFEILQVHTRNMTLGDDVDLRKIAEETDLFTGAELEGLCRESGTVSLRENIAATAVFNRHFQTAKSSLKPALTIEEVETYSSFRKAAKRSDSKPIPINKKKATSTVFGFSWQLGVLSLLLLATGNYYFNHTKHELLVASAT

SEQ ID NO: 298 - protein, 355 aa, Arabidopsis thaliana
MVAEALPKCPEAPLVLGLQPAALIDNVAPVDWSLLDQIPGDRGGSIAVQKDELEHMLKELDAHISVAPLKKMAGGSVTNTVRGLSVGFGVATGIIGAYGDDEQGQLFVSNMGFSGVSISRLRKKKGSTAQCVCLVDDSGNRTMRPCLSSAVKIQADELSKEDFTGSKWLVLRYAVLNLQVIQAAIRFAKQEGLSVSLDLASFEMVRNSKSELRQLLESGNIDLCFANEDEAAELLRGEQEAGPEAALEFLGRHCRWAVVTLGSKGCIAKHDKEVVHISAIGETVATDATGAGDLFASGFLYGLIKGLSLEECCKVGSCSGGSVIRALGGEVTPENWQWMHKQLQLKGLPVPDIHN

SEQ ID NO: 299 - protein, 385 aa, Arabidopsis thaliana
MIGIGRTLTSSSPSKIILEDLPPGIYRYGTEIFTSVPRKTFHHIKFLRLDSAQSSRILKPVPLRSSSIKDSQVNVEDEEIEASNKTVRVRFQLRKECVFGEHFFIVGDDPVFGGLWDPETALPLNWSDGNVWTVDLDLPVGRLVEFKLLLKAQTGEILWQPGPNRALETWETNKTIRICEDWDNADLQMMIEEDFVPYTNISSIGSEDEDEVLGSVQQNSSVVAVENAGYVSDESAQNSSFSIQSEKTMEPSNGALTAREVIKEAMFTEEESPVLVPGLIPLSDLDNEQVEVINEGKAETFPEVDKKQEPKAERNKKAKVKAISLFEKSEQEAVKSVEQRQYNAVEEEQQRLETEPLGTPDVLFENDIQWGRRTLYKLLSNFRLF

SEQ ID NO: 300 - protein, 325 aa, Arabidopsis thaliana
MTSGTRMPTWRERENNKRRERRRRAIAAKIFTGLRMYGNYELPKHCDNNEVLKALCNEAGWIVEPDGTTYRKGCSRPVERMEIGGGSATASPCSSYQPSPCASYNPSPGSSNFMSPASSSFANLTSGDGQSLIPWLKHLSTTSSSSASSSSRLPNYLYIPGGSISAPVTPPLSSPTARTPRMNTDWQQLNNSFFVSSTPPSPTRQIIPDSEWFSGIQLAQSVPASPTFSLVSQNPFGFKEEAASAAGGGGGSRMWTPGQSGTCSPAIPPGADQTADVPMSEAVAPPEFAFGSNTNGLVKAWEGERIHEESGSDDLELTLGNSSTR

SEQ ID NO: 301 - protein, 91 aa, Arabidopsis thaliana
MARSLANAKIQSVFGSEKLSNAVFRRGFAAAAKTALDGSVSTAEMKKRAGEASSEKAPWVPDPKTGYYRPETVSEEIDPAELRAILLNNKQ

SEQ ID NO: 302 - protein, 295 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 303 - protein, 302 aa, Arabidopsis thaliana
MSPSKQRHRSSTGENKSKPVRSASSSAIPEWITESTNGGSLRRVDPDTGTDGWASPPGDVFSLRSDSYLSKKQKTPAGDYLLSPAGMDWLKSSTKLENALARPDNRVAHALRKAQSRGQSLKSFIFAVNLQIPGKDHHSAVFYFATEEPIPSGSLLHRFINGDDAFRNQRFKIVNRIVKGPWVVKAAVGNYSACLLGKALTCNYHRGPNYFEIDVDISSSAIATAILRLALGYVTSVTIDMGFLAEAQTEEELPERLIGAVRVCQMEMSSAFVVDAPPPQQLPSQPCRTLSSAKVNHDEDED

SEQ ID NO: 304 - protein, 157 aa, Arabidopsis thaliana
MQASRARLFKEYKEVQREKVADPDIQLICDDTNIFKWTALIKGPSETPYEGGVFQLAFSVPEPYPLQPPQVRFLTKIFHPNVHFKTGEICLDILKNAWSPAWTLQSVCRAIIALMAHPEPDSPLNCDSGNLLRSGDVRGFNSMAQMYTRLAAMPKKG

SEQ ID NO: 305 - protein, 579 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEEEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGPEKEKAKSLLRGIRMAQTGFPSMDLEHFPI

SEQ ID NO: 306 - protein, 558 aa, Arabidopsis thaliana
MASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 307 - protein, 514 aa, Arabidopsis thaliana
MEEIRKEIDVGDWHSNLAHDEWTPLPVSGSRASARYKHAAVVVDEKLYIVGGSRNGRYLSDVQVFDLRSLTWSSLKLKTESSSADNIQEDDGSSLREAFPAISDHRMIKWGNKLLLIGGHSKKSSDNMLVRFIDLETHSCGVIDVFGNVPASRGGHSITLVGSRVLVFGGEDKNRRLLNDLHVLHLETMTWDVVETKQTRPVPRFDHTAATHSDRYLLIFGGCSHSIFYSDLHILDLQTMEWSQPHVQGDVVTPRAGHAGITIDENWYIVGGGDNSTGCLETLVLNMSKLVWSTSTHVEARHPLASEGLSVCSASVFGENILVAFGGYNGKYNNDIFVMRLKPGESSHPKIFKSPAAAAAAASVTAAYAIAKSDKSDYPPPANPTLNGNGNSLPERDIRNRIDTIKEEKRALESSIAETQVENAKLREKIDEVNSSHTELSQELQSVEGQLISERSRCFKLEAQIAELQKALESGQSIEAEVEMLRRQRSASDEEEDGTVQRQGSAGVWGLFGR

SEQ ID NO: 308 - protein, 333 aa, Nitrosomonas europaea
MAIRIGINGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNEWGYSCKLLEMVRVIASK

SEQ ID NO: 309 - protein, 345 aa, Xenorhabdus nematophila
MKALVYHGAGKKLWEEKAPPQLIEPTDAIVRIVKTTICGTDLHILKGDVPTVEQGRTLGHEGIGIVELIGDSVRNLKVGDKVIISCITVCGSCPYCKRQLYAHCKDGGWILGHKIDGTQAEKVRIPHADNSLHRLPEDVDEEAALMLSDILPTGLEIGVINGRVQPGHTIALIGAGPVGLSALLASQFYSPAHIIMIDTDDNRLSVAQQFGANTIINPTRQNVVETIHKLTDGIGVDVAIECVGIPATFQICQDIIAAGGFIANVGVHGKSVDLHLENLWIKNITITTGLVNTSSTPMLLKSVQSGKISPEKLVTHHYSLSEIETAYDIFGNAAKEKALKIVLSA

SEQ ID NO: 310 - protein, 585 aa, Bacillus subtilis subsp. subtilis str. 168
MGKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 311 - protein, 484 aa, Sinorhizobium meliloti
MNLKDPSLFRQAALVGETWIEADPKNAIEVNNPATGEIIGRVPKLGAADTRTAIEAAARVQKEWAARTAKERSAVLRRWFELMIENKDDLGRILTMEQGKPLAEATGEIVYGASFIEWFAEEARRVYGDLVPGHQKDKRILVMKQPIGVVAAITPWNFPNAMITRKAGPALAAGCAMVLKPAAQTPFSAIAIAVLAERAGMPKGLFSVITGSAREIGAEMTSNPTVRKLTFTGSTEVGAELYRQSAATIKKLGLELGGNAPFIVFDDADLDAAVEGALIAKFRNNGQTCVCANRIYVQDGVYEAFSDKLAQAVAKLKTGNGMEDGVILGPLIDQPALKKVEEHVADALAKGARVVQGGRRHSLGGTFYEATVLADVTQAMAVAREETFGPVAPLFRFKDESDVIAQANDTEFGLASYFYAKDLARVFRVAEALEYGMVGVNTGLISTAEAPFGGVKLSGLGREGSKYGIEEFMEIKYVCLGGIA

SEQ ID NO: 312 - protein, 1004 aa, Arabidopsis thaliana
MMKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQLRHLHLGGNYFAGKIPPSYGSWPVIEYLAVSGNELVGKIPPEIGNLTTLRELYIGYYNAFEDGLPPEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNLVDLSSNKLTGTLPPNMCSGNKLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 313 - protein, 337 aa, Nitrosomonas europaea
MASSMLSSATMVASPAQATMVAPFNGLKSSAAFPATRKANNDITSITSNGGRVNCMQVWPPIGKKKFETLSYLPDLTDSGGRVNCMQAMEKLVLLRHGESIWNQENRFTGWTDVDLTPKGLKEAEEAGRLLRENGFSFDIAYTSLLKRAIRTLWIALDEMDQMWTPIELNWRLNERHYGALQGLNKAETAKQYGDEQVLVWRRSYDIRPPSITINDERYPGFDLRYRNMSSGDIPLAESLKDTVARFLPYWNQSIAPQIKAEKKVIIAAHGNSLRALIKHLDNISDQDILNCNIPTGIPLVYELDDDLKPLNSYYLGDAGQIGEAISAVANQGKSGA

SEQ ID NO: 314 - protein, 299 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMSGTLVLVRHGQSDWNLKNLFTGWRDPDLTELGIEEAKAGGKALADYGIKFDIAFTSVLIRAQRTCQLVLDAVGQSSLETIRDQALNERDYGDLSGLNKDDARAKWGEEQVHIWRRSYDVPPPGGESLRDTGARVWPYYLTDILPRVLSGEKVLVAAHGNSLRSLVMVLDKLTKEQILKLNLATGVPMVYKLNADSTVASKEVLGDMSGAH

SEQ ID NO: 315 - protein, 435 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMAVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 316 - protein, 544 aa, Sinorhizobium meliloti
MKEAPWFSSSVIYGIDVRRFSDGNGDGIGDFIGLKERVSYLHYLGIDCVWLSPFFRSPFADNGYDVSDYYSIDPVLGTLDDFLDFLHAAGEQGIRVVVDLVANHTSSEHPWFQAARRDARCRFRDYYVWSESPPPVAPDNKTAFPGEESSVWTYDDLAQAYYFHKFRHFQPDLNIANPAVRDELLRVVDYWLTLGVDGFRVDAAPFVIGETGIEHADPRDPQGFLREMRKLVDGRRQDGLLLGEADLAPEKLRSYFGDGKLDLLFNFVLCAAFAASLAGQKADPIGQALSIMPEPPPHRGWANFLRNLDELNLDRLPEDIREETFAAFAPDEEMRIYGRGIRRRLAPMLDGNRARIELAFSLLLSSPGVPLILYGDEIGLGEDLSRPGREPVRVPMQWNAGSNAGFSTAQRAKLVQPPVTDGPFSFKRVNVEAQREDPGSLLNRVRAMILARRRHELFNRGRPVMLHTGDPALFALAYSDGTELFVVLHNLSDGKRRAELELPGAIDARLNDILGEGEVELSGQRLAIGLGPFGYVWLHSGKKD

SEQ ID NO: 317 - protein, 415 aa, Arabidopsis thaliana
MKGVLLDESVLFSPESEDSSPSLRESVPSLLRLLRYSMIRTGISYGLDLPENKVDLLRKTAAEYSINCLPLETSLTSVTFGDTLKAWYSDGSILYVASSRKEEILRELSPSQLVVLLDVEGDSLEDPNIIHIHSLEELPMTICCINKKAMGDGAAIVAYIMKPSRVEDFAKRGALPMYPTSCGLIFLPLMFEFPLASQLKHADIIFHKATDEILSIELNCSDSKSSVAVTFSTGMEKLKKYMEDQNACAIVDPIRNIYPVVDRLKMQHILLGLEGLGAAGRKIRGACFLKQINIRVPYLQIDSYDEPDLAQNLSRAGLSLPCIVKPQVACGVADAHSMAIVFRVEDFKNLNTPVPAIIQEYVDHSSRIFKFYVLGETIFHAVKKSIPSSSSLRKSAEENGLKPILFDRQDFITVP

SEQ ID NO: 318 - protein, 575 aa, Arabidopsis thaliana
MLEKVETFDMNRVIDEFDEMTRNAHQVQKQTLKEILLKNQSAIYLQNCGLNGNATDPEEAFKSMVPLVTDVELEPYIKRMVDGDTSPILTGHPVPAISLSSGTSQGRPKFIPFTDELMENTLQLFRTAFAFRNRDFPIDDNGKALQFIFSSKQYISTGGVPVGTATTNVYRNPNFKAGMKSITSPSCSPDEVIFSPDVHQALYCHLLSGILFRDQVQYVFAVFAHGLVHAFRTFEQVWEEIVTDIKDGVLSNRITVPSVRTAMSKLLTPNPELAETIRTKCMSLSNWYGLIPALFPNAKYVYGIMTGSMEPYVPKLRHYAGDLPLVSHDYGSSEGWIAANVTPRLSPEEATFAVIPNLGYFEFLPVSETGEGEEKPVGLTQVKIGEEYEVVITNYAGLYRYRLGDVVKVIGFYNNTPQLKFICRRNLILSINIDKNTERDLQLSVESAAKRLSEEKIEVIDFSSYIDVSTDPGHYAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 319 - protein, 129 aa, Arabidopsis thaliana
TQPKQKHHFSQQNSLRLCETKRKPWSQLTMLRHWKLKERLQPLFGRHLKSSRRLSIFRGLSAMTADTSSTIYLGISLNSPQSISHRLGLLAEVLVASFGNILLTELIVSFLFLIILSTLECRCHDHFCV

SEQ ID NO: 320 - protein, 165 aa, Arabidopsis thaliana
LILVLCDSLSSSIMDNIAAQLKRGISRQFSTGSMRRTLSRQFTRQNSLDPRRNNMRFSFGRQSSLDPIRRSPESLSCEPHMSVPENLDSTMQLLFMASKGDVNGVEELLNEGIDVNSIDLDGRTALHIASCEGHYDVVKVLLSRRANIDARDRWGSTVCSLLPLF

SEQ ID NO: 321 - protein, 97 aa, Arabidopsis thaliana
MAWRGSISKSMKELRILLCQSSPASAPTRTFVEKNYKDLKSLNPKLPILIRECSGVQPQMWARYDMGVERCVNLDGLTEPQILKALENLVKSGATKA

SEQ ID NO: 322 - protein, 500 aa, Arabidopsis thaliana
MKDFPIAISLLFALLSPVLLPCSGDSTGGVEDDSPATVCIVGSGIGGSSVAHFLRNYSVSTGLNQAKILMFERHEIVGGRMRTVTVAGDTFEAGGSILHPKNYHVKDFVERFNLTVRLPTPIEESSAIGIWDGKRFVVKTFGSGTKFPFLDTIVSWVNDLYLFLRYGLSLLRMSSFIENTVDNFLKYYESLESRPIFDNVEGMLKWSGLYNLTKLTLQEKLSEAQLSPLLVNELVTVITRINYGQSVLISGLAGAVSLAGSGGGLWSVEGGNWQMAAKLINHSDVTLHLNEKIESISYLENHYELKSTKGNSYKCDVTVVATPLDEVDIQFSPTISIPKRELQHTHTTFVRGLLNPGYFGMKSLSDVPALVGTLEDPLIPFSCISILRKYSKTDMTYKIFTRQPASDSLLDELFSRRTETVRIDWGAYPKYHAPEVFAPFILDDHHLYYVNAFENAASTMETSAVAGENIARLIISRFMTKESLSSSDKRSCSSGLHSDS

SEQ ID NO: 323 - protein, 306 aa, Arabidopsis thaliana
MAEKEVVSASTLESKITEDHHDIWIRGAMEKSRSSNISVLKDRFIAAEDSALVSKDVAQKDIEILLRRVKTATALLTYLKSKATTVAAADLANLSLETDQLQDTIDEHDGTYVTEMLQHVETVTGVMESLARRAFIAESEAAIEKGKVVLSQEEIQRKVGQLENMSVKLEDMEKFALGTSSILCEMRQRVDDLVEETSRQKQRATENELELSRVRRDFESLKSYVTSLISVRETLVSSEKQFQTIERLFERLVAKTTQLESEKVQKEAEVQKLMEENVRLTALVDKKEAQLLAMNEQCKMMALSSI

SEQ ID NO: 324 - protein, 326 aa, Arabidopsis thaliana
MSLTTVPTLAIRSGPSGHHSMPVLGFGTAASPLPEPTMLKETVIEAIKLGYRHFDTSPRYQTEEPIGEALAEAVSLGLVRSRSEFFVTTKLWCADAHGGLVVPAIKRSLKNLKLDYLDLYIIHWPVSSKPGKYKFPIDEDDFMPMDFEVVWSEMEECQRLGLAKCIGVSNFSCKKLQHILSIATIPPSVNQVEMSPIWQQRKLRELCRSNDIVVTAYSVLGSRGAFWGTPKIMESDVLKEIAEAKEKTVAQVSMRWAYEQGVSMVVKSFTKERLEENLKIFDWSLTEDETQRISTEIPQFRNVHGEVYTSKKGPIKSVAEMWDGEI

SEQ ID NO: 325 - protein, 136 aa, Arabidopsis thaliana
MQTFAPGTRVYHLIIIVFFFFFCLSSFFASIVMADEYTGEATGSSEAKVHIIYTEKPTDEEPKTYHLRTLSSALGSEEAAKDALIYSYKEAASGFSAKLTPEQVAEISKQPGVIQVVPSQTYQLHKPGGGGGFKLT

SEQ ID NO: 326 - protein, 179 aa, Arabidopsis thaliana
MNVSHASVHPVEDPPAAATEVENPPRVRMDDMEGMPGTLLGLALRFFQFLFAAAALCVMASTSDFPSVTAFCYLVAATGLQSLWSLALAMVDVYAIMVKRSLQNRRLVSLFAIGDGVTSTLTFAAACASAGITVLIDNDLNSCAQNHCVQFETSTALAFISWFAALPSFLFNFWSLASR

SEQ ID NO: 327 - protein, 255 aa, Arabidopsis thaliana
LIRSLPTETSVSRSWLNSFGSERERPGKERKGWSITVHDLSGSPVAMASIVTPFVASPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRRGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 328 - protein, 237 aa, Arabidopsis thaliana
MVAQGFTVDLKKPLVFQVGHLGEDYEEWVHQPIATKEGPRFFQSDFWEFLTLTVWWAVPVIWLPVVVWCISRSVSMGCSLPEIVPIVVMGIFIWTFFEYVLHRFVFHIKTKSYWGNTAHYLIHGCHHKHPMDHLRLVFPPTATAILCFPFWNIAKAISTPSTAPALFGGGMLGYVMYDVTHYYLHHAQPTRPVTKNLKKYHLNHHFRIQDKGFGITSSLWDIVFGTLPTTKAPRKEQ

SEQ ID NO: 329 - protein, 272 aa, Pseudomonas fluorescens
MSNTRIAFIGAGNMAASLIGGLRAKGLEAAHIRASDPGEETRAKVSAEHGIETFADNAQAIDGADVVVLAVKPQAMKLVCEAIRPSLKPNQLVVSIAAGITCASMTAWLGEQPIVRCMPNTPALLRQGVSGLYATGKVSAEQRQQAEELLSAVGIALWLNEEQQLDAVTAVSGSGPAYFFLLIEAMTAAGVKLGLPKETAEQLTLQTALGAAQMAVSSDVDAAELRRRVTSPAGTTEAAIKSFQAGGFEALVEKALGAAAHRSAEMAEQLGK

SEQ ID NO: 330 - protein, 279 aa, Saccharomyces cerevisiae
MSIVSLLGIKVLNNPAKFTDPYEFEITFECLESLKHDLEWKLTYVGSSRSLDHDQELDSILVGPVPVGVNKFVFSADPPSAELIPASELVSVTVILLSCSYDGREFVRVGYYVNNEYDEEELRENPPAKVQVDHIVRNILAEKPRVTRFNIVWDNENEGDLYPPEQPGVDDEEEEDDEEEDDDEDDEDDEDDDQEDGEGEAEEAAEEEEEEEEKTEDNETNLEEEEEDIENSDGDEEEGEEEVGSVDKNEDGNDKKRRKIEGGSTDIESTPKDAARSTN

SEQ ID NO: 331 - protein, 222 aa, Glycine max
MDSNSVVSWPRMPENINGFGLKQNQSEEVHVLAVDDSTVDRKVIEHLLKVLACKVTAVDSGLRALQLLGLLDEQKIPSETNGFVGLKVDLIITDYCMPGMTGYELLKRIKESSTFKETPVVIMSSENVLPRIDRCLEEGAEDFIVKPVKLSDVKRLKDYMTTKEVRGELSQEEREGINKRKLLDTSDVSPSSPPSISSSPLPSSLSSVIDSPIRRLKMTNTD

SEQ ID NO: 332 - protein, 418 aa, Agrobacterium tumefaciens
MASSMLSSATMVASPAQATMVAPFNGLKSSAAFPATRKANNDITSITSNGGRVNCMQVWPPIGKKKFETLSYLPDLTDSGGRVNCMQAMAKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSSLKALGEKHGLI

SEQ ID NO: 333 - protein, 271 aa, Zea mays
MEVATATEASAPAASGGAAGQSHPFPWLDAAISEPYYFLHLLAFFSYFAARSAALSADDGGELHDRLLRREIQAVLVFLVLFVVKIVKEETWEAVIADSLLYAKGLLLAVTLVIDCWLAFAYFLGFLVIYAVAQQPPYDGLGHSNHLTPLQLESLLTEEPTSRFWLVEFRTSFSAKCVQASSILPELSIVYSNKNISFGTIDLGHFPNAAAKFGISMWDHLPTYILFDKVTEVSRFPEITSESKVFVPKVTKKLLCQHFDLDRRLIGYLST

SEQ ID NO: 334 - protein, 89 aa, Zea mays
MPSLQKALPPELADNVLRLYRECLRRAKYIGHQKHNTELLVAMVRQQFKKNMHETDPEKIQKMKDDAARGLINHILYESEKITGRKFSG

SEQ ID NO: 335 - protein, 128 aa, Zea mays
MSWSAPDDILLSTSLAGFLDKKLIVLLRDGRKLLGTLCSFDQFANVVLQGACERVIVGEQYCDVPLGLYVIRGENVVLIGELDREKDELPAHMTCVSEAEIRKAEKAEREARDLKGTMRKRMEFLDFD

SEQ ID NO: 336 - protein, 476 aa, Glycine max
MSLSICSTNSSQPSLNLTIAKNHHQSSRISLAIVADFNIPISLWTSRPFKPSTKTMRLNDDETLSNLLVNFIEEILHYGSNKHSIIPYIKFPKLDSVSNFQDIFNLAFLTLLFLVCIYEAPSDLRSGCLSTLKEQLAGCQSRQASKFLMKLLGSNLEEQWMRSVNLAITNWIVEIQEAHHTDHTTFRTPSPLFSYAFSTFGLWKVQLYCPVINMDVVNANNHPADERLQFSLKYQQLEGVLQFNYKVTIRERWVEIVVNIDNIRCDVFKLVNDILMRERGAGAAEKHFPSRISLQLTPTIQQQVLTVSVGKSSENPRIEFGVEKGIEASFEPPNPYIGLSVSAGESTTVSLKPWKFEQSVHGYSANLNWFLHDSTDGKEVFSTKPSKVALFNPKSWFKDRYSSAYRPFTRQGGVIFAGDEYGESVCWKVDKGAVGKTMEWEIRGWIWITYWPNKHKTFYHETRRFEFRETVYLKIA

SEQ ID NO: 337 - protein, 422 aa, Zea mays
MGMFFSKAEPPPPMVLVPPLFDYPPIAARTRMAVPAYELMFGKVSLHNLFEDYFDQAGNMTSRIMLKPLEDPHVDLIATVSAAADRNSGTEVKGDALFRWQRELDDPHTFVDLLVSTSNPLLQLRLCAYHPKYRIGAFGTLPLLMGNRVRSEDYGVMGVRYGSENLSVGASFVPISLSSEVPFGAWLVGRKGSLSAGVQYKPLSGSKYPMPFTELENWNYAISYGVGSTSPLSPSFIFSLELARSTQLTASFYQHLVVQRRVKNPFEDDQVVGITNYIDFGLELAARVDKDKVSGDGNSFQLAGSWQANKNFLLKGKLGPSTSSVALAFKSWWRPSFTFSVTAVNDHSKGTTSYGFGLRVEDLRRASYQRADPNYVMLTPSKEHLAPGVLREYGKRPMFQTQIDSGNYDHLPTELKPLGRIF

SEQ ID NO: 338 - protein, 680 aa, Arabidopsis thaliana
MSDDPGQMLLIYDDPSDQRSLSLDDASSTEESPDDNNLSLEAVHNAIPYLGQIFLTHDTAYEFYSTFAKRCGFSIRRHRTEGKDGVGKGLTRRYFVCHRAGNTPIKTLSEGKPQRNRRSSRCGCQAYLRISKLTELGSTEWRVTGFANHHNHELLEPNQVRFLPAYRSISDADKSRILMFSKTGISVQQMMRLLELEKCVEPGFLPFTEKDVRNLLQSFKKLDPEDENIDFLRMCQSIKEKDPNFKFEFTLDANDKLENIAWSYASSIQSYELFGDAVVFDTTHRLSAVEMPLGIWVGVNNYGVPCFFGCVLLRDENLRSWSWALQAFTGFMNGKAPQTILTDHNMCLKEAIAGEMPATKHALCIWMVVGKFPSWFNAGLGERYNDWKAEFYRLYHLESVEEFELGWRDMVNSFGLHTNRHINNLYASRSLWSLPYLRSHFLAGMTLTGRSKAINAFIQRFLSAQTRLAHFVEQVAVVVDFKDQATEQQTMQQNLQNISLKTGAPMESHAASVLTPFAFSKLQEQLVLAAHYASFQMDEGYLVRHHTKLDGGRKVYWVPQEGIISCSCQLFEFSGFLCRHALRVLSTGNCFQVPDRYLPLRWRRISTSFSKTFRSNAEDHGERVQLLQNLVSTLVSESAKSKERLDIATEQTSILLSRIREQPVSSLAIRDISSSVQRNF

SEQ ID NO: 339 - protein, 306 aa, Zea mays
MFGLRARAAAQLQRPTPSPSSASSASFSLARLGCASPLAALAPLASAPPSPSARETQPTSLSARWPAAPMRPWGTRGHSRPTTRVLCTAAGSVQREGKELLVQHLLVGEKDVRLLVDLEKNIIAEGADLSDLAVEHSLCPSKENGGMLGWVRRGQMVPEFEEAAFSAPLNKVVRCKTKFGWHLVQVLAERDQCVLQDIDPEELHSKLQDPSFLEEAQLIDVREPDEVEKASLPGFKVLPLRQFGTWGPVMTDEFNPQKDTYVLCHHGMRSMQVAKWLQSQGFKKVYNVAGGIHAYAVKADSSIPTY

SEQ ID NO: 340 - protein, 177 aa, Zea mays
MVLTSNISVQKTLYEVLSVSEDATYDEIRAAYRSAALNTHPDKAQTTLESSSVPSTEQQEFSSVQKAWEVLRHPTSRAYYDKQLQSSRQSIEIIASEIQVGDMIVESAAGALELLYPCRCGDYFSITSGELSGMGIVVTGDGEEVEGLQASDSGSASVVLGCGSCSLKIRLVIDGTS

SEQ ID NO: 341 - protein, 94 aa, Zea mays
MGSLGPTVSLSIMARPGGQQPAEMERKKDSGVFFGGGCGFRMPLHYPRYKKADYESMPEWRVDCLLREYGLPADGDVDSKRRFAMGAFLWPDQY

SEQ ID NO: 342 - protein, 259 aa, Arabidopsis thaliana
KVRRTRGSYSTGDEYEEERPKWLDRWMASKPWDKRASTDQRVPPVYKTVEIDTSQPYLTRGNSRTGASPSRSQRPSSPSRTSHHYQQHNFSSATPSPAKSRPIQIRSASPRIQRDDRSAYNYTSNTPSLRSNYSFTARSGYSVCTTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 343 - protein, 618 aa, Arabidopsis thaliana
LYIGDEDCLLGGSMYLSPGSCPGVYYPARKRLRVAATSFYSGFEEKQTSIDVLPEECLFEILRRLPSGQERSACACVSKHWLNLLSSISRSEVNESSVQDVEEGEGFLSRSLEGKKATDLRLAAIAVGTSSRGGLGKLQIRGSGFESKVTDVGLGAVAHGCPSLRIVSLWNLPAVSDLGLSEIARSCPMIEKLDLSRCPGITDSGLVAIAENCVNLSDLTIDSCSGVGNEGLRAIARRCVNLRSISIRSCPRIGDQGVAFLLAQAGSYLTKVKLQMLNVSGLSLAVIGHYGAAVTDLVLHGLQGVNEKGFWVMGNAKGLKKLKSLSVMSCRGMTDVGLEAVGNGCPDLKHVSLNKCLLVSGKGLVALAKSALSLESLKLEECHRINQFGLMGFLMNCGSKLKAFSLANCLGISDFNSESSLPSPSCSSLRSLSIRCCPGFGDASLAFLGKFCHQLQDVELCGLNGVTDAGVRELLQSNNVGLVKVNLSECINVSDNTVSAISVCHGRTLESLNLDGCKNITNASLVAVAKNCYSVNDLDISNTLVSDHGIKALASSPNHLNLQVLSIGGCSSITDKSKACIQKLGRTLLGLNIQRCGRISSSTVDTLLENLWRCDILY

SEQ ID NO: 344 - protein, 266 aa, Arabidopsis thaliana
RKPKKSLHLFSLRLLHHLVGKNKTSPAMDPGDPTSIIFSKIRTFELENASRVIDYFLLQDMEQRDLIRIAFGPDSLIQTFCQKAKVDLGFSSNGFSRPINIHGQSLSSSSPRNGFLEFSRNPSNPLSSSLTLNTLRDNKPNFNSSPFRESSSLFASSSGDEQQQQQFSNNFLFTNDEDPFANSHKRSFSANDACFESEEPWFGGGNGCHQFPQGGLVDGFGSSGVFGSPSEMDYMLEGMMRMKLAQQKSMVAAQFMAACGSPMLHR

SEQ ID NO: 345 - protein, 184 aa, Arabidopsis thaliana
PAIDETSNEILGKHETGNGCFKCGSTDHIAKDCVGGPSSKFIVKDQNRQHGGGEGYEMVFEGDVHETPKHNSHERERSEKIQRRSPHGNGEGKRQHRDERDDGRRQHDREDARELERKHRERKERESREDEDRRRRRRREESRDKESRRERDEDDHRSHRDYKERRRERDDRHGREARHERRDR

SEQ ID NO: 346 - protein, 107 aa, Arabidopsis thaliana
HIILNMRFGAGVNHISLDEGNSILTVVGTMDPVCVATRLKKIKQKPVIISVGPPPKPPEPPKPPEPEKPKPPPAPEPPKHVCKPPYCNSCDVVSVTTYESGSGCTIL

SEQ ID NO: 347 - protein, 127 aa, Arabidopsis thaliana
FLKLLSTKTPEASAYSERSEDSSTKILFSSTMEALFTSTHTPNLQTKPLLKSPLPTSSQSSCWFCNSLPKTQFPKLRLSNGSSHGLRIQALLRNETPSEGEDNNGFGFFPGDIFSLSQVLFLLSCDE

SEQ ID NO: 348 - protein, 117 aa, Arabidopsis thaliana
YVFRSDLESFLVVILKSVFSTESSDAESSDYKKMVDALLNAATFSKSDDGSEKGMSFEDFRSWCSFVPTIRKFLGSLLMPPSTGLFFVFSHLNSFLVNKIGKHFPFFTFLYPLNLVI

SEQ ID NO: 349 - protein, 158 aa, Arabidopsis thaliana
MAYFSTATSLLLLVLSVSSPYVHGASDCDTLVITLFPCLPFISIGGTADTPTASCCSSLKNILDTKPICLCEGLKKAPLGIKLNVTKSATLPVACKLNAPPVSACDSLPPASPPTANGQAPVWGSGWAPAPSPSKGNSLIPISGFSFVIVTALAMFRI

SEQ ID NO: 350 - protein, 280 aa, Arabidopsis thaliana
MASTFRLSISFLTLILFSLWVVEAHTSRKLISIKEKEGQDISHLLKDGEFDDPSLYMYFTLNDLKLGTKLLIYFYKNDLQKLPPLLTRQQADLIPFTKSKLDFLLDHFSITKDSPQGKAIKETLGHCDAKAIEGEHKFCGTSLESLIDLVKKTMGYNVDLKVMTTKVMVPAQNSISYALHNYTFVEAPKELVGIKMLGCHRMPYPYAVYYCHGHKGGSRVFEVNLVTDDGRQRVVGPAVCHMDTSTWDADHVAFKVLKMEPRSAPVCHFFPLDNIVWVTK

SEQ ID NO: 351 - protein, 140 aa, Arabidopsis thaliana
DQPKKHFSIFNLIKTVSVYVVVSSAFLCNKLGIILLLFNLRLLPIRFRLGEDRSTQYLSSATAWFHRSLKACSSHVDCLRICSQNTHITLLLYRRKKVPKADSSSGNNNSPLFLNQKSQNRVSVHKKKVTKVVNFLFVLQ

SEQ ID NO: 352 - protein, 126 aa, Arabidopsis thaliana
FLHIQFVSHITKFSFRLSITLSIRFQRGLSQLRPKSSTYGEGRGIPESSYSCQIRKGVLLSFNFDCLCCLVMEQSPNLALFLFFCRYLQGRLLEQWMVIVMESHVWRRTQITSKESSLLLWMEVII

SEQ ID NO: 353 - protein, 124 aa, Arabidopsis thaliana
LVVQILILNALILLSDCIGIKGINRGIFGVKSDKKTEIEGLVKLLECRNPTPEPTGELDKIGGCWKLIYSTITVLGSKRTKLGLRDFVSLGDLLQQIDIAQVDKKEIDQFSFLVMTFLMCFFFN

SEQ ID NO: 354 - protein, 178 aa, Arabidopsis thaliana
SAMTEVLHFPSSPSASHSSSSSSSSPSPSSLSYASRSNATLLISSDHNRRNPVARFDQDVDFHASIEEQDLRRRSSTDGGEEDDGGEDQISLLALLVAIFRRSLISCKSNRRELCSMEIGWPTNVRHVAHVTFDRFNGFLGLPVEFEPEVPRRAPSARYIVQRSYLFIELLLKVSSQQ

SEQ ID NO: 355 - protein, 109 aa, Arabidopsis thaliana
FLIKPHFFPPLNHKPFDQTKSQPFNLIIPKMFEIIQAVFSAGVALALLTFAGITLGGSVVACIISTPLFVIFSPVLVPATIATTLLASGFTASGSFGATAFTILSWLYK

SEQ ID NO: 356 - protein, 795 aa, Zea mays
VDQQAHPWFLMEASSSLRFQVSRFSSFKIWLCLFLVLVLQNCSPALSDSPYLVGMGSYDITGPAADVNMMGYANAEQIASGIHFRLKARAFIVAEPNGKRVVFVNLDACMASQLVTIKVLERLKARYGDLYNENNVAISGIHTHAGPGGYLQYVVYIVTSLGFVRQSFDVIVNGIEQCIVEAHNNLHPGKIYVNKGDLLDASVNRSPSAYLNNPAEERGKYKYNVDKEMTLIKFVDDESGPIGSFNWFATHGTSMSRTNSLISGDNKGAAARFMEDWAEQNGIPKQAAHVNHDGLESSHMTSRLPRRVSPIIPEPNEITDDLVQLASSYEASGGRRLSSSSITKRIRSTQQNRPKFVSAFCQSNCGDVSPNVLGTFCIDTGLPCDFNHSTCNGKNELCYGRGPGYPDEFESTHIIGNRQFQKAVDLFSSASEEIQGKIDYRHTYLDFSKLEVNVRTSTGSQQVVKTCPAAMGFAFAAGTTDGPGAFDFKQGDVKGNPFWRLVRNLLKTPGKEQVECQAPKPILLDTGEMKEPYDWAPAILPIQIIRIGQLAILCVPGEFTTMAGRRLRDAVKAVLTSDNSGEFNNIHVVLAGLTNTYSQYITTFEEYEIQRYEGASTLYGPHTLSAYIQEFQKLATAMVANKEVPTNFQPPDMLDKQIGLLPGVVFDSTPPGVEFGDVSSDVPASSTFRKGSVVNATFYSACPRNDLLTDGTFALVEKLDGSNSWVPAYDDDDWSLRFKWSRPSKLSPRSFATLEWTVPGDAPSGVYRLRHFGASKPLIGSIKHFTGTSRAFAVR

SEQ ID NO: 357 - protein, 894 aa, Arabidopsis thaliana
MTTIPFCFLFVAFFFSSSTADQRHHSRHLLHQPFFPVVTAAPPPYQPPVSSQPPSPSPHTHHHHKKHLTTTTPPPHEKHLFSSVANPPPPPPSPPHPNPFFPSSDPTSTASHPPPAPPPPASLPTFPANISSLLFPTHNKQSKPPSNGHIARLVTITASVISAAALLSLFAVFIIFIRRTRHRRRSSPADDTKSTRSDALQLFNASPSDGSKKQKQHQQPPKYTSSHTSSEFLYLGTLVNSRSNGLEQQKSPISLSGGITGVLELPPPASSSSSSSYSQYHKLGSPELRPLPPLPKLQSFTPVYKSTEQLNPKRQDFDGDDNENDEFFSPRGSSGRKQSPTRVSDVDQIDNRSINGSGSNSCSPTNFAPSLNASPGTSLKPKSISPPVSLHSQISSNNGIPKRLCPARPPPPPPPPPQVSEVPATMSHSLPGDDSDPEKKVETMKPKLKTLHWDKVRASSSRVMVWDQIKSNSFQVNEEMIETLFKVNDPTSRTRDGVVQSVSQENRFLDPRKSHNIAILLRALNVTADEVCEALIEGNSDTLGPELLECLLKMAPTKEEEDKLKELKDDDDGSPSKIGPAEKFLKALLNIPFAFKRIDAMLYIVKFESEIEYLNRSFDTLEAATGELKNTRMFLKLLEAVLKTGNRMNIGTNRGDAHAFKLDTLLKLVDIKGADGKTTLLHFVVQEIIKFEGARVPFTPSQSHIGDNMAEQSAFQDDLELKKLGLQVVSGLSSQLINVKKAAAMDSNSLINETAEIARGIAKVKEVITELKQETGVERFLESMNSFLNKGEKEITELQSHGDNVMKMVKEVTEYFHGNSETHPFRIFAVVRDFLTILDQVCKEVGRVNERTVYGSMPLHSPSNQTATPLFPVVINNNSRLSPSGSLDDDDGSF

SEQ ID NO: 358 - protein, 381 aa, Zea mays
MATAAAASRVAVSAPVFGSDGGARSSGIKGNNNVSFGSKSWVGGTLAWESSCSVRPRRASKVLCMSVQQASRSKVSVAPLHLESAKEPPLNTYKPKEPFTATIVSVESLVGPKAPGETCHIVIDHGGNVPYWEGQSYGVIPPGENPKKPGAPQNVRLYSIASTRYGDNFDGRTGSLCVRRAVYYDPETGKEDPSKNGVCSNFLCNSKPGDKIQLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAERRGESWDQKLAQLKKNKQWHVEVY

SEQ ID NO: 359 - protein, 765 aa, Zea mays
MPKGYIQQKDRMKVVSIHLAAAVVAVLLLLAAKRTPAIAVPSPQCQWQCGGVDIAFPFGIGDNCSLSAGFNLSCQEVQSGVYRPFQGNIEVLNISLINGTVRELNPVSTYCYDSSSGSMEPSTWSFDASRTPYRFSDVQNKFTVIGCQTLAYITDNTDKSYQSGCVSTCQNVSDLTDGSCSGMGCCQTDIPKKMGFYNVSFDPASDTSQISRLGLGSCSYAVLMEAEEFSFSTTYITNTTAFNDTNSGRVPVVMDWAIRDDGAPSCELATRNETGTYACRSGNSKCVESPNGPGYLCNCSDGYEGNPYLSDGCHDVDECKKNNSPCPSVGGVCHNTVGAYRCSCRAGRKLNKQNNTCDPDTTLITGVTIGFLVLVIFSSFGYMILQKRKLNQVKQDHFRQHGGMILFERMRSENGLTFTVFSEAELVKATDSYDKSRIIGKGGHGTVYKGIVKGNVPIAIKRCALIDERQKKEFGQEMLILSQINHKNIVKLEGCCLEVEVPMLVYEFVPNGTLYELIHGKNQALQIPFSTLLRIAHEAAEGLSFLHSYASPPIIHGDVKSANILLDGNYMAKVSDFGASILAPSDKEQYVTMVQGTCGYLDPEYMQTCQLTEKSDVYSFGVILLEVLTGQEPLKLDGPETQRSLSSKFLSAMKENNLDAILPSHVNGGQESNELIRGLAQLAKQCLDMCGCNRPSMKEVADELGRLRKLSLHPWVQINAEMIESQSLLSGTTTASFEIEVGTTGYPTQEAENLPMNPRSSYYAR

SEQ ID NO: 360 - protein, 349 aa, Zea mays
MGGGADRSAPVRAEESVSGGVDVWSDAVSSHAPDHLLVMVHGILGSTADWQYGANEFVKQLPDHVIVHCSEKNASMLTLDGVDVMGERLANEVLDVISRRPEITKISFLAHSVGGLAARYAIARLYRHPDSVSDGNTKGTICGLEGINFITVATPHLGSRGNKQVPLLFGSVAMEKVACHIVHWIFRRTGRHLFLTDDDEGLPPLLQRMVEDHDDLYFISALRAFRRRVVYANADCDHIVGWRTSSIRRNNELPELPVSSSDKYPHIVHEEHSEETDDDKWQDCMAECDMDVLEEKMVTGLGKVSWEKVDVSFHSSMTSFAAHSIIQVKYAFMNEGADVIQHIIDHFQL

SEQ ID NO: 361 - protein, 594 aa, Zea mays subsp. mexicana
MVKRSKKSKSKRVTLRQKHKVQRKVKEHHRKKRKEAKKAGKAGQRRKVEKDPGIPNEWPFKEQELKALEARRAQALQELELKKQARKERAQKRKAGLLEDEDIASLASAASAQGSEFAAKENAPLLVAKINDHSERSFYKELVKVIEASDVIMEVLDARDPLGTRCIDMEKMVRKADPSKRIVLLLNKIDLVPKEAAEKWLTYLREELPTVAFKCNTQEQRTKLGWKSSKLDKTSNIPQSSDCLGAENLIKLLKNYSRSHELKLTITVGIVGLPNVGKSSLINSLKRSRVVNVGSTPGITRSMQEVQLDKKVKLLDCPGVVMLKSSNSGVSVALRNCKKVEKIEDPVAPVKQILSICPHEKLLSLYKVPNFGSVDDFLQKVATVRGKLKKGGVVDVEAAARIVLHDWNEGKIPYFTLPPKRDAGEDSDAVIISEDGKEFNIDEIYKAESSYIGGLKSIEEFHHIEIPPNAPLAIDEEMLEDGGKKPSEAIQESRDREEQMPDVKDSGGSKAASASTQNDKLYTAEGVLDPRKSKAEKKRRKASRPSALNDMDADYDFKVDYRMEDGGSEGAHADDEDGGDGSEDNEPMTGVDDA

SEQ ID NO: 362 - protein, 636 aa, Zea mays
MMTRCGVQLLVARGISSSPCLSRRINQTESEIVRMFHPPIRQSEEAIATIVPRYTYSMRVLDERFIRILKIFKWGPDAEKALEVLMLRVDHWLVREVMKTDVGVNVKMQFFRWAAKRRNYEHDTSTYMALIHCLEVVEQYGEMWKMIQEMVRNPICVVTPTELSDVVRKLGNAKMVSKAIAIFYQIKTRKCQPTAQAYNSMIIMLMHEGQYEKVHQLYNEMSTEGHCFPDTMTYSALISAFCKLGRRDSAIQLLNEMKEIGMQPTTKIYTMLIALFFKFNDAHGALSLFEEMRHQYCRPDVFTYTELIRGLGKAGRIDEAYHFFCEMQREGCRPDTVFMNNMINFLGKAGRLNDATKLFQEMETLRCIPSVVTYNTIIKALFESKSRASEVPSWFERMKASGISPSSFTYSILIDGFCKTNRMEKAMMLLEEMDEKGFPPCPAAYCSLIDALGKAKRYDLACELFQELKENCGSSSARVYAVMIKHLGKAGRLDDAINMFDEMNKLGCAPDVYAYNALMSGLARTGMIDEALSTMRRMQEHGGIPDINSYNIILNGLAKTGGPHRAMEMLSNMKQSTVRPDVVSYNTVLGALSHAGMFEEASKLMKEMNTLGFEYDLITYSSILEAIGKVDHECDP

SEQ ID NO: 363 - protein, 488 aa, Zea mays
MGEFCPSPQGDSALAAPPLTLSSPSPATAVRPSYGSCDRRYVKLVFDNLHGSISVDPLALQFVDTEEFQRLRDLKQLGLTYLVYPGAVHTRFEHSLGVYSLAGKAINNLKTYQGEELGIDHVDMQTVKLAGLLHDIGHGPFSHLFEHEFLPRVDPGSSWSHEDMSVLLLDSIVDKHAIDIENGYLKMVKEMITASAKPTSTESANEKHFLYDIVANGRNGIDVDKFDYVGRDCRACGLGCNFQYWRLLEGMRVMGDEICYPAKDYLSIHKLFSTRADLHRTVYTHAKVKAAELMLVDALIEANDYLGISLHAHDPEEFWKLDDTIIKTIETAPNNELKKAKEIIQRIRRRELYKFCNQYSVPKDKLGHFKSITAQDIVCSQKSSEVLLKEEDVAVSNVKIDLTRGKDNPLESIKFFKDFGCDEKFPITDDRVSHLLPAYNEDRIVRVYAKKPELVDVVSEAFENLQMRMYGEKTQVHETPKRKRIRSN

SEQ ID NO: 364 - protein, 338 aa, Zea mays
MVELTSLSPGPPRPSRLTPRRRPPPPTPHVHTSSRRRGRILGAATATPGADDYHSTIRSLNSRGRHVPRKSLGQNYTLNSKVNEELVAAAGVEEGDVVLEIGPGTGSLTSALLQAGATVFAVEKDKHMATLVKDRFGSTEQLKVIEEDITKFHIRSHFLPFMKEKYGATKKLAKVASNLPFNVSTEVVKLLLPMGDVFSVVVLMLQDETAVRLADASIQSPEYRSINVFVDFYSEPEYKFRVDRENFFPRPKVDGAVISFKLKNAEEYPPVSSPKSFFSMVNSAFMGKRKMLRKSLQHICSSSEIEAALDNIGLPVTARPSDLILDDFVRLHNHLAKV

SEQ ID NO: 365 - protein, 352 aa, Zea mays
MRRSLPLLLARQVARRRRLSNVPESTVYGGPRPQESSAARRVTVTTLRGKHRRGEPITVVTAYNYPSAVHVDSAGIDVCLVGDSAAMVVHGHDTTLPITLDIMLEHCRAVARGAPRPLLVGDLPFGCYESSAAQAVDSAVRVLKEGGMDAIKLEGGAPSRITAAKAIVEAGIAVMGHVGLTPQAISVLGGFRPQGKTVDSAIKVVETALALQEAGCFSVVLECVPAPVAAAATSALKIPTIGIGAGPFCSGQVLVYHDLLGMLQHPHHAKVTPKFCKQFGNVGDVINKALSEYKQEVEAQAFPGPSHTPYKITPTDVDGFADALQKMGLSEAADAAAAAAENREKGGEPKGE

SEQ ID NO: 366 - protein, 483 aa, Zea mays
MAARFLLVVAVALLLRPGDASVHEYRGLSFANKGNAFILHAGSEGLYAASHANTTAEDAAAVAEAFIRFDKITFRRSEDTNNSVKETSSAKVQVLIFEIEDREMIGGSAYGGQKAICCTSDLAKLGACTEGSVIYRPSQVNPGWPKLFVASFDGSDLIATLPSRTIPITKTGIYNMYFIHCDPSLASLEIEGKTIWKNPTGYLPGRMAPLKNFFGLMSFAFVVLGIYWFYQYMKSWREVLPLQNCITLVITLGMFEMALWYFEYAEFNETGVRPKGITFWAVTFGTVKRTAAEVIVLIVSMGYGVVTPTLGGLTSKVVMLGGTFFLATEILELVENLGAVNDLSGKARLFLVYPVAILDAAFVIWIFISLAKTIGKLQIYSKSTDVFNERWQHARIIPAFWHVLSFLLLCVICYLWAPSQNSMRFSYDASEFFDRKDNISLIRPAPSASKNGWNLSSTPEPKATKDVNTVADFEGDDEENKRE

SEQ ID NO: 367 - protein, 435 aa, Zea mays
MPVPKPMERKQAAYSNLDERYAIQGEKYQGQQYSHIYFTRLHHMRNLLHALVPSWKPQLPVTTVLGLEEGKDCIIVGTLYKHMKLKPSILDEYAKERSAIPLVKPHNFMHPDDHLILEDESGRVTLAGAIPPAAFVTGVVVALHGKETSAGNFLVEDVLEAGLPPQSALSSAEEDKYVVFISGLSVGSDTFNPLQFQLLIDHVTGHLGDENEQSIASNIVRIVVVGNSVHISPRFVNGQTVPSKDQSRIAEPIKELDIMLTQLVASLPVDMMPGCHDPANFSLPQQPLHRCLFSGASTYNTFSSCSNPHQFELDSVQFLGTSGQNIDDLYKYSDAKDKLEFMERTLRWRHLAPTAPNSLGCYPYTDKDPFLVESCPHVYFVGNQDKYETRLLEGQEKQKVRLISIPRFSESGVAVMLNLRNLECSTLSFSTSFDA

SEQ ID NO: 368 - protein, 511 aa, Zea mays
MEMVPWLLGFLGRYPELMVSLACFLLLFRRLNQRDGLPTNWPVVGALPAITVNAGRMHEWVTEFLRAAGLSYVMKGPWGSPVDVIMTADPANVAHVFTSNFGNYPKGQEFAALFDVLGDGIFNADGESWAFQRRKAHALLSDARFRAGVAASTARKLRDALVPLLDGIAASGAVVDLQDVFVRLTFDLTAMFVFGIDPGCLAPDFPYVPFAAAMDTVEEVLFYRHVAPVPWLMLQKYLRTGHSKKMWNARRVLDASIAEFISLRRERAAEAEAEADLLTSYLACHDEIGKSGAELERFLRDTTLNLMVAGRDTTSSALTWFFWLLTKHPDVEAKVLEELRAHPPLSGAGGHRTAAELKQLVYLHAALSESLRLYPPVPFEHKAAARTDTLPSGARVGPSRRVIVSFYSMGRMEAVWGKDCSEFRPERWLTAAGRFRHEPSYKFVAFNVGPRTCLGRDLAYSQMKAVVAAVLPRFRVEVDAGAVVRPKLSIILHMKDGLKVRVHKREEDGLC

SEQ ID NO: 369 - protein, 381 aa, Zea mays
MSLPIALVVGIAGGATLLAVAAVLLALWCAARMRARRNRNSDTGSSDPSTLVEWGKGGRSSLAPDLEHQVARQFSLEDLVQATKNFSDTNIIGAGSFGLVYMGLLLDGTVVAIKRRVGAATQVFADEVRLLSEIRHRNIVTLIGYCQEGGLQMLVYEYLPNGSVCGHLYDNRKGSATRLEFKQRLSIAIGAAKGLNHLHSLDPPLIHKDFKTNNVLVDENFIAKVADAGLVRLIRGSDDAGPSRGFSNSVYQDPEVQSMTQFSESSDVYSFGVFLLELITGREAASLIPTESREYLAHWMEAHFSSNELIDPRLAGNFTAEGMKELVGLAFQCLNPSSRRRPRMRLVATELDRILETEMSMTTFMGDGTTIVTLGSQLFSS

SEQ ID NO: 370 - protein, 573 aa, Nostoc sp. PCC 7120
MAAEHGLILDFTTVLGASALGGYLANRLRQPVLLGYLVTGLALGPYGLKLLSDVPRIQSLASIGVAFLLFALGVEFSLTELRRVKNIAINGSLLQIGLTTALVAFLTITLGWVDNLTQGIFLGVVLSLSSTAVVLKTLGERGETNTLHGQVMLAILIAQDLALGLILAFLPVLNQPERLVWALGIALLKVLLFLALAIALGRWIVPKLISNVAATESTELFVLTVISLCLSVALVTAKLGLSIEMGAFVAGLMVSEIDHADHALAKVLPLRDTFACLFFASIGMLIDPIALMQNLGLVLGLVTLVMLGKAIVVMPIILKFGYSLKTTILTSLGINQIGEFSFVLALAGLQLQLIPEKTYILLLETTAITLVLTPISLNIAPQLIERLTQIPFFAQSLRQFTEPNILSIPETISGHVVVAGYGRVGQVIVNILLNQGYVVLVIENSEAAIQRLRMQRIPYIFGDADSELVLEKIHLETAKALAIALPDPASSRLLLKRALAIAPKLDVIARSHHDNEIDLLTQMGAKEVVQPEFEAALELSAHLLSTLGEAKSQIDTVISDIRTDRYRSIRPRR

SEQ ID NO: 371 - protein, 569 aa, Escherichia coli K12
MSEEKLGQHYLAALNEAFPGVVLDHAWQTKDQLTVTVKVNYLPEVVEFLYYKQGGWLSVLFGNDERKLNGHYAVYYVLSMEKGTKCWITVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGHARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 372 - protein, 222 aa, Zea mays
MAEEKKRHKHKHKEKEKEKQPGGGTEQAAHFKPCGDVKGIRFGGQFIVKSFTVRRASPLELLRLLGIPPSYLSECQSLPFPSTTAYMPTGFTILAHQAWHTLTLGLGTNKSKAALFVFESEAMKAAVDRLWPAVIPLGDVNRRLIRGLTGSEMARFKFRKGCLTIYVYAVRRLGAAGFMRTDDLRRVLQSVVELKDFLDHTAMLAIPSQKSITLQSRTAVAH

SEQ ID NO: 373 - protein, 323 aa, Bacillus halodurans
MKETLLKMLLTAGDDFVSGEKISQAIGCSRTAVWKHIEELRKSGYEVEAVQRKGYRIVKRPDQIKPHDIQVVLETERFGREITYLESTASTQTVALKLAQEGAKEGHIVLANEQTSGKGRMGRGWYSPPGSSISMSIIFRPQLPPQKAPQLTLLTAVAIVRAIKETTGLDSDIKWPNDLLIDGKKIVGILTEMQADQDSVHSVIQGIGINVNHQEEAFAEEIRKIATSLAIKKGEPIQRAPLIAAILKNIELFYDLYLQHGFSRIKPLWEAHAISIGKRIRARMLNDVKFGVAKGITDDGVLLLEDDDGKLHSIYSADIEIDQ

SEQ ID NO: 374 - protein, 366 aa, Agrobacterium tumefaciens
MAYDQKRVVDAIRAFEAGEIVVVTDDDDRENEGDLIISAVHCTPEKMALIVRHTSGIVCAPMPREEAKRLNLNAMVAENDSAHTTAFTVSVDFKHGTTTGISADDRTLTVRNLANPNVGASDFTRPGHIFPLISREGGVLMRSGHTEAAVDLCRLAGLPPIGVISELVNDDGSVMRGPQVLDFADKHGMKHVSVADLIAYRQRKETLVEMESSFTIETPFGPAMAQTYSLPWDPMQHMAVIFGDIRDGVDIPVRLHTENVADDVFGDRQPVRHYMQKIAEEGRGVIVYLREGSVGVGQVAGRRKARDPDEAHAQARSRENEWLEIGLGAQILKDLGISSIKLLTTRERHYVGLEGFGIQISATDIC

SEQ ID NO: 375 - protein, 470 aa, Chlorobaculum tepidum
MMIMPVILSGGSGTRLWPLSRAMYPKQLLPLFGEKTMLQDTVLRVGSIEGVGPVICVCNDEHRFLVAEQLRQIGVAEQAIILEPFGRNTAPAAAIAALVIAATHPGALMLLLPADHVILDRQGFVASIESARSAAESGSLVTFGIVPSTPETRYGYIRAVAGSTGVTRPVAEFVEKPSLERAEGYVVSGDYFWNSGMFLFRPEIYLAELEASSPEILDACRKSLENARRDLDFLRLDPEAFAACPANSIDYAVMEKTSNAVVVPMQAGWRDVGAWSALWEAQERDAEGNIKRGDVLTHGVRNSYIHATSRLVAAVGLEEHVIVETADAVLVASKERVQEVKAIVEQLKLQKREEPLIHRRVYRPWGSYETVDEGERFKVKRITVKPGAALSLQMHSRRAEHWIVVTGRALVTVGKKQVPLEANQSIYIPVEELHRLENPGDEPLELIEVQSGGYLGEDDIVRFEDHYGRL

SEQ ID NO: 376 - protein, 321 aa, Escherichia coli K12
MKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 377 - protein, 569 aa, Escherichia coli K12
FITSLYKKAGSCRTMNVNSSSNRGEAILAALKTQFPGAVLDEERQTPEQVTITVKINLLPDVVQYLYYQHDGWLPVLFGNDERTLNGHYAVYYALSMEGAEKCWIVVKALVDADSREFPSVTPRVPAAVWGEREIRDMYGLIPVGLPDQRRLVLPDDWPEDMHPLRKDAMDYRLRPEPTTDSETYPFINEGNSDARVIPVGPLHITSDEPGHFRLFVDGEQIVDADYRLFYVHRGMEKLAETRMGYNEVTFLSDRVCGICGFAHSVAYTNSVENALGIEVPQRAHTIRSILLEVERLHSHLLNLGLSCHFVGFDTGFMQFFRVREKSMTMAELLIGSRKTYGLNLIGGVRRDILKEQRLQTLKLVREMRADVSELVEMLLATPNMEQRTQGIGILDRQIARDLRFDHPYADYGNIPKTLFTFTGGDVFSRVMVRVKETFDSLAMLEFALDNMPDTPLLTEGFSYKPHAFALGFVEAPRGEDVHWSMLGDNQKLFRWRCRAATYANWPVLRYMLRGNTVSDAPLIIGSLDPCYSCTDRVTLVDVRKRQSKTVPYKEIERYGIDRNRSPLK

SEQ ID NO: 378 - protein, 447 aa, Bacillus halodurans
MNHRYLPMTTDDRQEMLQAIGVDSIEELFSDIPQDIRFKGKLNIPNALKEPELIRYFQQLANENVHLKDKASFLGAGVYDHYIPSIVDHVISRSEFYTAYTPYQPEISQGELQAIFEFQTMICELTGMEVANSSMYDGPTALAEAAMMSCGHTKKKKILVSKAVHPEARDVLMTNAYGQRLEVVEIDTNNGVTDVEHLKALYDEETACVIVQHPNFFGRLEPLAEIESVSHQGKATFVVSSNPLALGLLKPPGAFGADVVVGDAQPFGIPTQYGGPHCGYFATTKKLMRKVPGRLVGQTTDDQGQRGFVLTLQAREQHIRREKATSNICSNQALNALAAAVAMATIGKRGVKEMALQNVQKAAYAKSQLKANGVEIVAEGPCFNEFIIKLSSPLHEVEEALLAKGFIAGYDLGKVYPELEGHMLVAVTEVRTKEEIDQFAKEVGMFA

SEQ ID NO: 379 - protein, 497 aa, Zea mays
MVGNNTVASLFYYSLLIICAAAWHADASQADRLREFIRSRRNSPSEADKGTFEVANMGHSVASSLLSTSYSDSEQSALKAADKITALPGQPDGGVDFDQYAGYVTVDEKNGRALFYYLVEAPQDASAKPLLLWLNGGPGCSSLGYGAMQELGPFRVNSDNKTLSRNKAAWNNVANVIFLESPAGVGFSYSNTSSDYGLSGDRRTAADAYLFLANWLERFPEYKSRPFYISGESYAGHYVPELAATILTQNSYNSKTAINLRGILVGNPLLDSYMNLKGAVAYYWSHGLMSDEVFDNITRHCKYDSSDGVACSGALEAVDPGQIDPYNVYAPICVDAANGAYYPTGYLPGYDPCSDYYTYSYLNDPAVQNAFHARTTSWSACANLNWTDAPISMVPTVAWLIEKKLPVWIFSGDFDSVCPLPATRFSIHDLNLHVTTPWRPWTVNMEVGGYVQQYQGGFTFASVRGAGHMVPSSQADRALVLLDSFLKGVLPPYVQEQ

SEQ ID NO: 380 - protein, 148 aa, Zea mays
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPNYEEGGAADEDDEAAREVVVGEVEVAKVAESRDGVARVDVAPGLLQDQKQ

SEQ ID NO: 381 - protein, 182 aa, Zea mays
MAAAAATRAGAWGVAWLLAATVAAALLASASAQSGCTTTLISLYPCLNYISGNVSAPPSSCCSQLASVVQTNPQCLCAALSGDSSSLGGVTVDKTRALQLPQACNVKTPPASKCNSAGGGSAPGAATPATPSAGVPSTAGTGTGSKATPTAPFLTSGAASTRGAVSLVLAFATVAVYGISAA

SEQ ID NO: 382 - protein, 104 aa, Zea mays
MSAAAGGLRRLLAAAATAGAAEVRASIFGHALNPTGRRAATKLLRKKMVGDQVAQWYPYDIKRDDPLVMAREEKERLAKLEMLKRRGKGPPKKGQGRRAVKRSK

SEQ ID NO: 383 - protein, 556 aa, Zea mays
MATMKLGSKPEIFVLQDLTWRCTTELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTTSSAAAAAAAAGMDWWYEDVSFLSLPMFKRLIQAMEAKGMRDESIAGAIMFYAGRFLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGCPQADADSDVEGDAPDGKETITDVKARVSDLEKECKSMKQEIRRLGKPRRSWSLLTRKCGFGAKVQQAQTAMSGK

SEQ ID NO: 384 - protein, 173 aa, Zea mays
MFLRRILTGGGGLAALRAARAVKETTGIVGLEVAPNAREVLIGLYTRTLKEIEAVPKDEGYRKAVESFTNHRLQICQEEDDWKRIEDRIGCGQVEELIEEAEDELKLIAKMIEWDPWGVPDDYECEVIEDDTPIPKHVPQHRPVALPEEFFKTLDAVKSDPALQGDAPPQVKA

SEQ ID NO: 385 - protein, 188 aa, Zea mays
MRPLDEKETTQVFEKLFKFTGPNLKHLLERPAVEGPDAEPGRYCLRLHRNRVYYASEALVRRATAVSRPRLAGVGTPIGKFTHHGAFHLTVHALDLLAAHARRRVWLKPDTERSFLFGNSVPKSSLARITENTKAGDGVVVMSMADVPLGFGIAARSAQDCRKADTNAVVVLHQSDAGEYLRKEEELM

SEQ ID NO: 386 - protein, 164 aa, Zea mays
MKPVSVAEHNNHQHRLHSPTPASATKISIPISSSEAALFGKGRYKVWALAAIALLALWSMFAASVTLRLSSVDLATTFGDASDPLIDELDPLEMEQREKLVRRMWDVYTRTDNHVRLPRFWQEAFEAAYEELAGDDTLTTDAAISEIARMSIHRPEVEQSSNKD

SEQ ID NO: 387 - protein, 578 aa, Zea mays
MATPPPPLPPMPPRHVSCGSLLQELQELWGEIGQDEMKRDRMILQLEEDCLNVYKQKVNQTRKQKADLLQELSLGEADIDKILSALGERETFPRSEKLGGTLMEQLAKIEPVLEDLRRRRDERVNEFKAIQPKIVCLQAEISGAIDHGDPAAPVVDENDLSLKRSGELKEHLNDLQTEKNGRLQKIDIQTNSIHEMCNIMSIDLKMALKDVHPSYAELGRSKPMSISNSSLDRLSEKVHALNHEKKQRLRKLQDLGSTLIELWNLMDTPTDEQRFFDHVTSLIKVSPTTAMPQGCLAHEIIEKVETEVKRLTKLKASKMKELVFKKLTDLEEIYRSVHMDIDSDSERQTLNDLIDSGRADLSELLARMDIRIAEAKEHALSRKDILEKVEKWTLASEEETWLDEYERDQNRYNAVRGAHINLKRAEKARMLVSKLPSLLENLTAKIKAWEKEMGIPFIFNKVRLLDCLDEYTCTRQQKEEEKRRSRELKKLQEQFATEQGAKFGTEPSPIRPLSSRKPLGQSSNANIIGGTPTSRRVSTPMSRKGRPSSGRVQEAVKTAVAPANYVALPKDCSDISTL

SEQ ID NO: 388 - protein, 288 aa, Zea mays
MATDPAPVPAMRCYSLPPVRLPAEDILFCVDVDLEARAEMKSAAAAAASSGSTSTASPQPTQPAGAGGAPAAGPRTVVRRMDAVRQALLLFVHSKLTMCPEHRFAFASLGETFSMVKKGFSSDAGFAMEAIHSLSASETRYAMADLTQLFMTACQEGKRAESQGRILRVVLIYCRSSTKPQHQWPVKPKNFTLDIIYLHDKPNPDNCPQKVYDALVDVLEHVSQYEGYILETGQGLARVLFRQMCILVSHPLQRCMQDDLDIPKQVAKKIVAAEPAQNEDAAPVSSQQ

SEQ ID NO: 389 - protein, 418 aa, Zea mays
MSCLCWFKRRSRKGRSSSSGKRGASSTATVSVSGPATATATTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSLEDHLFRRANPPLPWNRRLQVILGAAEGLAYLHEGEVQVIYRDFKTSNILLDKDFRAKLSDFGLAREGPTGANTHVSTAVVGTQGYAAPEYMDTGHLTTKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGAKGKKTDAATPSRRRRD

SEQ ID NO: 390 - protein, 739 aa, Arabidopsis thaliana
MSGAVLVAIAAAVGNLLQGWDNATIAGAVLYIKKEFNLESNPSVEGLIVAMSLIGATLITTCSGGVADWLGRRPMLILSSILYFVGSLVMLWSPNVYVLLLGRLLDGFGVGLVVTLVPIYISETAPPEIRGLLNTLPQFTGSGGMFLSYCMVFGMSLMPSPSWRLMLGVLFIPSLVFFFLTVFFLPESPRWLVSKGRMLEAKRVLQRLRGREDVSGEMALLVEGLGIGGETTIEEYIIGPADEVTDDHDIAVDKDQIKLYGAEEGLSWVARPVKGGSTMSVLSRHGSTMSRRQGSLIDPLVTLFGSVHEKMPDTGSMRSALFPHFGSMFSVGGNQPRHEDWDEENLVGEGEDYPSDHGDDSEDDLHSPLISRQTTSMEKDMPHTAHGTLSTFRHGSQVQGAQGEGAGSMGIGGGWQVAWKWTEREDESGQKEGGFKRIYLHQEGFPGSRRGSIVSLPGGDGTGEADFVQASALVSQPALYSKDLLKEHTIGPAMVHPSETTKGSIWHDLHDPGVKRALVVGVGLQILQQFSGINGVLYYTPQILEQAGVGILLSNMGISSSSASLLISALTTFVMLPAIAVAMRLMDLSGRRTLLLTTIPILIASLLVLVISNLVHMNSIVHAVLSTVSVVLYFCFFVMGFGPAPNILCSEIFPTRVRGICIAICALTFWICDIIVTYSLPVLLKSIGLAGVFGMYAIVCCISWVFVFIKVPETKGMPLEVITEFFSVGARQAEAAKNE

SEQ ID NO: 391 - protein, 739 aa, Arabidopsis thaliana
MGTSVQVTPLCGVYNENPLSYLVSIDGFNFLIDCGWNDLFDTSLLEPLSRVASTIDAVLLSHPDTLHIGALPYAMKQLGLSAPVYATEPVHRLGLLTMYDQFLSRKQVSDFDLFTLDDIDSAFQNVIRLTYSQNYHLSGKGEGIVIAPHVAGHMLGGSIWRITKDGEDVIYAVDYNHRKERHLNGTVLQSFVRPAVLITDAYHALYTNQTARQQRDKEFLDTISKHLEVGGNVLLPVDTAGRVLELLLILEQHWSQRGFSFPIYFLTYVSSSTIDYVKSFLEWMSDSISKSFETSRDNAFLLRHVTLLINKTDLDNAPPGPKVVLASMASLEAGFAREIFVEWANDPRNLVLFTETGQFGTLARMLQSAPPPKFVKVTMSKRVPLAGEELIAYEEEQNRLKREEALRASLVKEEETKASHGSDDNSSEPMIIDTKTTHDVIGSHGPAYKDILIDGFVPPSSSVAPMFPYYDNTSEWDDFGEIINPDDYVIKDEDMDRGAMHNGGDVDGRLDEATASLMLDTRPSKVMSNELIVTVSCSLVKMDYEGRSDGRSIKSMIAHVSPLKLVLVHAIAEATEHLKQHCLNNICPHVYAPQIEETVDVTSDLCAYKVQLSEKLMSNVIFKKLGDSEVAWVDSEVGKTERDMRSLLPMPGAASPHKPVLVGDLKIADFKQFLSSKGVQVEFAGGGALRCGEYVTLRKVGPTGQKGGASGPQQILIEGPLCEDYYKIRDYLYSQFYLL

SEQ ID NO: 392 - protein, 726 aa, Arabidopsis thaliana
MEGAAVAEGLWGLADHHQKLGEIGKTIKCLEAICQSQISFLPLVEVKSRLRLAALLLRYSHNVNHAKSHLERSLLLLKSIPSSYDLKFQNYSLLSHCYHLLASFPPQRNLLVKALELASSVPQDISAYLWSCNFNSQLANTFIIQADFPSSLSALESGFLSASHICFPELQMFFTASMLHVHIMQWTDDYSVEKAVQRCDEIWQTISSDKTDRCPGLFFYNEMLHVFYRLRLCDYKNAQHHVDRLDQAMNAHSHKMQEIQQLLDELSSLNLSLSRYDLPSRERSALSARQSQLQDRVNALSPSSSTVNSLEPAYFGNIDRGWTEKLLLSPSPIDGEWLPKSAIDALVHLMVVISGRPKGLFKECSKRIESGLQIIQDELIKLGITDEVREADLRHTAIWMSRVFLMLQMQFLENRVALELTRSDYVEAEEALVDMKNWFTRFPTILQASECMIEMLRGQYSHSVGCYSEAAFHCIEATKLTESISMQASCQAFAAVSYLTIGDAESSSKALDLIGPLNGMTNSLSGVREEASILFAYGLLLMKQRDLQEARNRLAKGLQIAHNHMGNLQLVAQYLTLLGNLALSLHDTVQAREILRSSLTLAKKLYDIPTQLWVLSIFTALYQQLGEKGNEMENEEFRKKKWDELQSRLAEARGSIHHIELVAKARIELYQIDNNPQEQSLVASAQSMQGNLDIPESVGIEGPSPAPSSSRLVGLDTGKRWGKRRM

SEQ ID NO: 393 - protein, 754 aa, Arabidopsis thaliana
MKGETYRVFCVGTADTKLDELRFLAGSVRSNIGAFSKNSSSKVEVVIVDVSAGADQKQIDNVADFAFVTREEVLSCYIGSNQEEKPVKLPDDRGEAVGVMSKCLENFLRQAFEDNSLAGAIGLGGSGGTSLISSAFRSLPIGIPKVIVSTVASGQTEPYVGTSDLVLIPSLVDVCGINSVSRVVFSNAGASFAGMVVGRLELFRSSPSDNGKCTVGITMFGVTTPCVNAVQEILTREGYETLVFHATGVGGRAMESLVKEGFIQGVMDITTTEVADHLVGGVMACDSSRFDITIEKGIPLVLSVGALDMVNFGGKDTIPSHFQTRKIHVHNEQVSLIRTTAEENKKFARFIADKLNKSTSKVRVCIPEKGLSALDAPGKPFCDPEATGALINELQGLIQTNDDRQVNIYSHHINDPEFAEALVASFLEICPKTYAQIKPSETTSTKPSTGEHDDGHVRSRLERIPYSPKEFPNAKPETLERTQAILGRLRDQIEKGIPIIGGGAGTGISAKFEEAGGIDLIVIYNSGRFRMAGRGSLAGLLPFADANAVVLEMANEVLPVVKAVPVLAGVCATDPFRRMDYFLKQLESIGFVGVQNFPTVGLFDGNFRQNLEETGMGYGLEVKMISEAHKMGLLTTPYAFNPKEGEEMAKAGADIIVAHMGLTTSGNIGAKTAVSVEESVVRVQAIADAARRFNPDIIVLCHGGPISGPEEAEFVLKRTQGCVHGFYGASSMERLPVEQAITNTVQKYKSISIK

SEQ ID NO: 394 - protein, 559 aa, Arabidopsis thaliana
MANHHRLLRGGGSPAIIGGRITLTAFASTIALFLFTLSFFFASDSNDSPDLLLPGVEYSNGVGSRRSMLDIKSDPLKPRLIQIRKQADDHRSLALAYASYARKLKLENSKLVRIFADLSRNYTDLINKPTYRALYDSDGASIEESVLRQFEKEVKERIKMTRQVIAEAKESFDNQLKIQKLKDTIFAVNEQLTNAKKQGAFSSLIAAKSIPKGLHCLAMRLMEERIAHPEKYTDEGKDRPRELEDPNLYHYAIFSDNVIAASVVVNSAVKNAKEPWKHVFHVVTDKMNLGAMQVMFKLKEYKGAHVEVKAVEDYTFLNSSYVPVLKQLESANLQKFYFENKLENATKDTTNMKFRNPKYLSILNHLRFYLPEMYPKLHRILFLDDDVVVQKDLTGLWEIDMDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 395 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 396 - protein, 278 aa, Chlamydophila abortus S26/3
MSRSSPEQLSRFLAEVHGRPKKGLSQNFLIDGNILRKILAVSCVQAGDWVLEIGPGFGALTEVLVNQGAHVVALEKDSMLEETLKQLPIHLEITDACKYPLSQLQDQGWQGKGRVVANLPYHITTPLLRKLFLEAPNQWKTVTVMIQDEVARRITAQPGGKEYGSLTIFLQFFVDVHYAFKVSPGCFLPKPQVASAVVHMTVKENFPLEEPLRTKFFSLTRAAFGQRRKLLANALKDLYPKERVFEALSQLHFSDKTRPETLSLDDYLKLFYLLSLPA

SEQ ID NO: 397 - protein, 386 aa, Candidatus Kuenenia stuttgartiensis
MKALIVDGEWNPRKNYPLSNEEQAKKRANVGSQVWQHTQFEVKDVSVPNLQDDEILVRIKSCGICGSDTHLYETDKDGYIIFSGVTELPRIIGHELSGIVEQTGKNVRNVSKGDWIAAESIMWCGMCHACRSGSPNQCKYIKLMGLSADGAFAEYIAINERYCWEINDFREIYSEDEAFDIGALIEPVGCAYNGLFIVGGGFQPGATVVVYGTGPIGLGAIALAKIAGASQIIAFDIIDERANIALEMGADYAFNTNKMRDCLSGEKVMEITKGWGADIQIEAAGAAPATIPEMEKSMAINGKIIYLGRAATTTSMHLDHLVSGANKIVGARGHSGYAIFPSIIKLIATGRLKLDKMITARYPFAGIMEAIKASSERTDGKILIHI

SEQ ID NO: 398 - protein, 388 aa, Legionella pneumophila subsp. pneumophila str. Philadelphia 1
MNHYEKMSLLKDSATVAINSLAQQKINAGIKIHNLSAGEPKLPPHPSIINAVTQAMEQGHTLYPPIMGIPELRHMGCEWMYRSYDCSFQNEQCLVVNGGKLGIYLLMQLLLQPNDEVIIPSPYWVSYPAMVSLFGGTPVPVETTEAEEWKLTPQALQKACTTKSKILILNNATNPTGALYTQSELIHLLQTAKKHNLLVISDEVYSELTYDGHHYVSCGSLPQFRERVIIIQSCSKNFSMTGWRVGFIFAPEIFIKPLSALVSQSTSGVTTLSQWAAVAALQEVNQVNIWVQQNMEKRRNCLLRTLHDYLGLTITPPISSLYVFLSLKDIGCKNQNSEEFCKQALDKANVAMVPGIAFGKEGYVRLSFGGNEDDLKSGIYALAQWLHR

SEQ ID NO: 399 - protein, 286 aa, Bradyrhizobium sp. BTAi1
MSAIDDLPPLREVIREHQLSARKALGQNFLLDLNLTARIARAAGPLEDATVVEIGPGPGGLTRALLALGARHVIAVEHDERAIPALQAIAERYPGRLEIVCTDARTFDVRPYLGSTKAKIVANLPYNIATHLLIGWLSAEPWPPWYDMMVLMFQREVAERIVARENEEAYGRLGVLANWRCETKILFDISPSAFVPPPKVTSSVVRLVPRTAPEPCDRRALEQVAAAAFGQRRKMLRQSLKSLPTDPARLAAAAGVDPTRRAETIPVSGFVAMARELTNSRDDNKT

SEQ ID NO: 400 - protein, 426 aa, Sulfolobus solfataricus P2
MDKGRCTILNSEELWAQAKQLFAGGVNSPVRAAVKPFPFYVERGKGAYIYTVDGKKFIDYVLGYGPLILGHSPESVKRRIVEQLERGWLFGTPSELEIELARKIRSHIPSAQKIRFVNSGTEATMAAIRLARGYTKRSKILKFSGNYHGAHDYALVEAGSAATEYNVATSDGVPMEIMKTVEICEFNDLDCVDKKLRNEDIATVILEPVMGNAGVILPEKDFLFGLRELTKTYNSLLIFDEVITGFRISIGGAQSYYQIYPDITTLGKIIGGGFPIGAVAGKAEIIDNFTPAGKVFNAGTFNANPISMIAGIATIEELEKEYPYIIANQAAKTLVEELERLLKTKHTINHVGSMFQIFFGIDEVRNYSDAKRADKEYYIKFHERLLKEGVFIPPSQYETIFTSAAHKDDVIADTIDKLMKVIGELN

SEQ ID NO: 401 - protein, 306 aa, Arabidopsis thaliana
MAEKEVVSASTLESKITEDHHDIWIRGAMEKSRSSNISVLKDRFIAAEDSALVSKDVAQKDIEILLRRVKTATALLTYLKSKATTVAAADLANLSLETDQLQDTIDEHDGTYVTEMLQHVETVTGVMESLARRAFIAESEAAIEKGKVVLSQEEIQRKVGQLENMSVKLEDMEKFALGTSSILCEMRQRVDDLVEETSRQKQRATENELELSRVRRDFESLKSYVTSLISVRETLVSSEKQFQTIERLFERLVAKTTQLESKKVQKEAEVQKLMEENVRLTALVDKKEAQLLAMNEQCKMMALSSI

SEQ ID NO: 402 - protein, 483 aa, Agrobacterium tumefaciens str. C58
MKVVPMHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 403 - protein, 613 aa, Coccidioides immitis RS
MHELYSIKGHNSTPVRRRPSRAIGRTPKTGDHPRDLEPFFKLKGANGNNLLHSKCTTDGDNSSPGCYLSSFPASPNPAIRTSCPAHAQDIPLQFQPYTEDDDTQCTQFLHIADFGPSTSKLKDKSLLIGKCFVNGEWVDAKSGETFEVTDPSTGKLIGTCPEFTAEETQKAVDAASASFPSFRKTLARERARMLRRWYQLMMDNAEDLATLITWENGKPYADAKGEVVYAANFFEWFSEEAPRVYGDTIPSSVPGNRVMTLKEPIGVCGFITPWNFPAAMITRKIGPALAAGCTVVAKSPGETPFTANAIMELGRRAGIPKGVVNLVTALKNTQELGMCLTTHPDIRKVSFTGSTNVGKLLMKQSSSTVKKLSFELGGNAPFIVFDDCPDVDAAVAGAIASKFRSSGQTCVCANRIYVQKGIYDEFAAKFAEKVRGFKLGYGFDEGVTHGPVIHSRAVDKVTQHVRDAEAKGGKVILGGKPASELGPNFFHPTVVTGMTKDMLMASEETFGPVAGLFPFETEKDVVEWANKAEVGLAGYFYSKDIRRIYRVAEALEVGMIGVNTGIISDTASPFGGVKQSGFGREGSKYGIDEFLSVKTITFGGMGGELQGHL

SEQ ID NO: 404 - protein, 713 aa, Aspergillus nidulans FGSC A4
MVDAYTCTAGAEDPLVPARPPVSFHDTLWRRARRTPAPRGRGSMSSSTLFSGDGTTVESVRHCLYTLRRLLASRYAVIPVTADMLIKEPWTLTCALLVIPGGADLGYCRALNGAGNRRIEQFVRRGGAYLGFCAGGYYGTKRCEFELGDKTMEVIGERELAFYPGICRGGAFKGFVYHSEVGARAAELTVSKDALSAGVIPSSFRSYYNGGGVFVDAPLYADRGVEVLASYAERLNVNPGSGAAAVVYCPVGDGAAILTGPHPEFAAVNLNPKAGGPEYAEVVEALAADDKARTDFLKACLSKLGLQVAQETTHVPSLSSLHFSSLSSGDAERVLKSLEELAGDEGLFKDEYDTFRIEKWGTYNMGALTESLPESKEASSELHESEGIVDYQSIVKRIIVHEDVPSSKTTPYFNHHAFYSHLRDYQAQSKEGASLFGSNLLYGEVVTSTNTILERNAKILRKLPTGTTATATTQVAGRGRGSNVWVSPAGSLMFSTVVRHPMEKMQSAPVVLIQYLAALAVVQGVRSYDEGYDAVPVKLKWPNDIYALDPGEPEHKKQYTKICGILVNSQYSSNEYTSVVGIGVNATNASPTTSLTALAARFVGHKAAPITLEKLLARILTVFEDLYTRFLRTGFDRSFEEMYYEAWLHTNQIVTLEAEGGTRARIKGVTRDYGLLLAEELSWDDRPTGRVWQLQSDSNSFDFMKGLLKRKVN

SEQ ID NO: 405 - protein, 335 aa, Novosphingobium aromaticivorans DSM 12444
MAIKVAINGFGRIGRNVARAILERPDCGLELVSINDLADAKANALLFKRDSVHGAFSGEVSVDGNDLIVNGKRIQVTAERDPANLPHGANGIDIALECTGFFTNRDGGQKHLDAGAKRVLISAPAKNVDLTVVYGVNHDKLTGDHKIVSNASCTTNCLAPMAKVLHESIGIERGLMTTIHSYTNDQKILDQIHSDPRRARAAAMNMIPTSTGAAVAVGEVLPDLKGKLDGSSIRVPTPNVSVVDLTFTPKRDTSVEEVNGLLKAAAEGALKGVLGYTDEPLVSIDFNHDPHSSTIDSLETAVLEGKLVRVLSWYDNEWGFSNRMLDTAGAMAKFL

SEQ ID NO: 406 - protein, 333 aa, Nitrosomonas europaea ATCC 19718
MTIRIGINGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNEWGYSCKLLEMVRVIASK

SEQ ID NO: 407 - protein, 224 aa, Streptococcus suis 89/1591
  misc_feature (188)..(188): Xaa can be any naturally occurring amino acid
  unsure (1)..(224): unsure at all Xaa locations
MTNLKEQVGIKAAEFVTDGMIVGLGTGSTAYYFVQEIGRRVAEEGLQITGVTTSHATAEHAASLGIPLKNIDEVEYVDLTVDGADEVDGDFNGIKGGGAALLMEKVVAVNSKDCIWIVDESKVVQTLGAFKLPVEVVQYGAENLFRLFEKKGYRPSFRMRNGEKHITDMQNFIIDLDLRRIEDTYALXEELDRTVGVVEHGLFIGLISKVIVGTPEGPNIIEKK

SEQ ID NO: 408 - protein, 517 aa, Aspergillus nidulans FGSC A4
MLFLSVLLAFAAYLLIYQYAMTNWNHARRARLWGCSPLPRYPTDILGLATLRESLKADKEKKIPLLLQNRLKRMSAREKRPVTTFVIRQMGLDNIFTCDHGNVQAILATKFKNFELGVGRRHTLYPMFGVGIFTSDGETWSRSRALLRPQFTRDQISDLDLEESHVQQAMRAMNVDPATGWTSSIDIQAIMFRLTIDSATEFLFGESAGSQAEALRNGGTLPLNHFSGDFDLGQWYVAQRSRFEKFYWLVDNRESRAVVKRVHEYVDRFVHAVLTTAEDRIEKSQSSSYVFLEALAASTKDPIELRSQLLNILLAGRDTTASLLSWSILMLARYPEVFTKLRSVILADFGSYTSSRDKITFASLKSCRYLQYFLNEVLRLYPAVPINRRVATTATTLPKGGGPAGDKPIYLRAGQVVTYSPFVTHRRTDLWGEDAEVFNPERWVNKKVGWEYLPFNGGPRVCIGQQFALTEAGYVIVRLLQRFDAIMDCFPEREIRYGLTLTLAPADGVFVRLHAAE

SEQ ID NO: 409 - protein, 149 aa, Arachis hypogaea
MAEQTFIMIKPDGVQRGLVGEIISRFEKKGFYLKGLKLITVDRPFAERHYSDLSAKPFFNGLVEYIISGPVVAMVWEGKGVVATGRKLIGATNPLASEPGTIRGDFAIDIGRNVIHGSDSVESATKEIALWFPEGPANWQSSLHSWIYE

SEQ ID NO: 410 - protein, 118 aa, Synechococcus sp. CC9605
MGQSQQPQPIQASELQQWLQSERPSPQLVDVREEAELAIAAFPGAVLHRPLSQSNAWLGSLQADLNRDQPVVVVCHAGVRSYHFGLWLLDQPWGLEVWNLEGGIDAWSLQVDPSVPRY

SEQ ID NO: 411 - protein, 403 aa, Nitrosomonas europaea ATCC 19718
MPDDAQRITRILTLNSIAQVGLKRFPPHLFQIGSDITGPDVILVRSHNLHDMEIPESVIAIGRAGAGTNNIPVNQMSARGIPVFNTPGANANAVRELVLAGMLMASRNLIPALRFVETLEGDDQSFNLQVEAGKKQFSGLELPGRTLGVIGLGKIGRQVADIAIKLGMKVLGYDPKITIDSAWSLPAEVQKANQIEDLIRRSQFISLHVPLNDSTRHLINDSLISCMQKNTILLNFSRDAIVDEDAVLTGIKSGVIRYYVCDFPGRKLQQQQAVVTLPHLGASTREAEENCAMMIADQIMDYVTNGNISYTVNFPDVVMERGTPYRVAVANANVPNLLGQISTCMADVGLNIHNMVNKSRGEMAYTLVDTDKAVPQETIDAIVRITGVLMVRYLPISESSERA

SEQ ID NO: 412 - protein, 400 aa, Candidatus Kuenenia stuttgartiensis
MFREGVFFFMVLSRVAREIQASATLAITAKAKQLAAEGKDVIGFGAGEPDFDTPENIKNAAIKAIKNGFTKYTPTSGVPKLKEAICEKLFNDNHLKYASSQILVSAGAKQSICNIALVLCDTGDEAIIPSPYWVSYPEMVTLAGAKPVFLETTDKDSFKITKESLAKVITPKSKLLFLNSPSNPTGMVYTEEELREIVMFAVEKGLYVISDEIYEKILYDGAAHFSPAAINDDCYNKVVTVNGFSKVYSMTGWRLGYAAGPEKIIKAATNIQDHTTSGANSITQLAGLEALRGSQESVTVMVKEFDRRRKYIVERLNTIKGISCLLPQGAFYAFPNVSRLCENLSLKGSFDLVSLLLEKAHIAFVPGAPFGADAHIRISYATSMENIEKGMDRFEKFLNT

SEQ ID NO: 413 - protein, 412 aa, Brucella suis 1330
MTERLSLSRDRINVLLLEGISQTAVEYFKSSGYTNVTHLPKALDKADLIKAISSAHIIGIRSRTQLTEEIFAAANRLIAVGCFSVGTNQVELKAARKRGIPVFNAPFSNTRSVAELVIGEIIMLMRRIFPRSVSAHAGGWEKTAIGSREVRGKTLGIVGYGNIGSQVGNLAESLGMTVRYYDTSDKLQYGNVKPAASLDELLKTSDVVSLHVPSSKSTSKLITEAKLRKMKKGAFLINNARGSVVDLEALAKVLQEGHLAGAAIDVFPVEPASNGERFSTPLQGLENVILTPHIGGSTEEAQERIGTEVTRKLVEYSDVGSTVGAVNFPQVQLPPRPTGTRFMHVHENRPGILNSLMNVFSHHHINIASQFLQTDGEVGYLVMEADGVGEASDAVLQEIREIPGTIRARLLY

SEQ ID NO: 414 - protein, 316 aa, Triticum aestivum
MDPALLDNIIARLLEVKSLKPGKNAQLSESEIKQLCAASKEIFLAQPNLLELEAPIKICGDVHGQYSDLLRLFEYGGYPPQSNYLFLGDYVDRGKQSLETICLLLAYKVKYPENFFLLRGNHECASVNRIYGFYDECKRRFSVKLWKTFTDCFNCLPVSALIDEKILCMHGGLSPELNKLDQILNLNRPTDVPDTGLLCDLLWSDPSNEAQGWAMNDRGVSYTFGPDKVAEFLEKHDLDLICRAHQVVEDGYEFFADRQLVTIFSAPNYCGEFDNAGAMMSVDETLMCSFQILKPARKMLPGSTNNKSGFKSMRGW

SEQ ID NO: 415 - protein, 458 aa, Xanthomonas campestris pv. vesicatoria str. 85-10
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLSLNLVTVKLFGEMEFWFALIKIIAIAALIITGAGLVAWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSGAAVPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQH

SEQ ID NO: 416 - protein, 476 aa, Thermosynechococcus elongatus BP-1
MDCIPVILSGGVGSRLWPLSRQAHPKQFIRLTPEGKSLLQQTWQRVQGLPQLQPPLVVANEAHRFLVAEQFQELGVTPTRILLEPVGRNTAPAITVAALYVTEVLASDALLLVLPADHFIQDVAHFQWGLQRGFSAAAKDWLVTFGIAPTSPHTGYGYIRRGESLSDPDTYRVAEFVEKPDLATAEAYLAAGNYLWNSGMFLFRAQSFLAELAQQQPQILDYCRLALRQGREDLDFIRLGKEAFDQCPNLSVDYGLMEKTQKAAVVPLDCGWSDVGSWSSLWEILPKDEWGNSCRGDVLVYNSKDCFAQSQHRLVALVGVDNLMVVETADAILIAHREAAQQVKQVVEQLQARNRSEAYNHRLVYRPWGYYDAIDAGHRFQVKRITVKPGASLSLQQHHHRAEHWIVVSGTAEVTCNGKTFLLTENESTYIPVGAVHRLANPGKIPLEMIEVQSGSYLGEDDIVRFEDCYGRKTEE

SEQ ID NO: 417 - protein, 253 aa, Arabidopsis thaliana
MEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWFSIIFSVIYLLAQQPAFSKLGTAKKLTPMQLEDLLSDGNTTKYWLIEFFACSSSKCVRSSRCFPELSITYSNNLLSFGTVDLGLFPNTAAKFGISLAGGMSQLPTYILFEKGVEVSRFPDFYVDAAPSLPITKKLLCQHFELDRLLLDYINGT

SEQ ID NO: 418 - protein, 344 aa, Triticum aestivum
MSKSGALDLASGLGGKIDKEQVKSAVDEYEKYHGYYGGKEESRKSNYTDMVNKYYDLATSFYEYGWGESFHFAHRWNGESLRESIKRHEHFLALQLELKPGMKVLDVGCGIGGPLREIARFSSTSVTGLNNNDYQITRGKALNRSVGLGATCDFVKADFMKMPFSDNTFDAVYAIEATCHAPDPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPMYFFVVRKPLSE

SEQ ID NO: 419 - protein, 275 aa, Brucella suis 1330
MSAPVTRKRLTPKVIQAMKGECPIVSLTAYTTPVARLLDPHCDLLLVGDSLGMVLYGMESTLAVTLDMMIMHGQAVMRGTSHACVIVDMPFGSYQESKEQAFRNAARVMQETGCDGVKLEGGEEMAETVAFLVRRGIPVFGHVGLMPQQVNTVGGFRSLGRGDDEAGKIRRDAQAIAQAGAFAVVIEGTVEPLAREITALIDIPTVGIGASSACDGQVLVSDDMLGLFQDFTPRFVKRFAHLAPQVSQAAEAYAEEVRARRFPGPEHVFGAKPGA

SEQ ID NO: 420 - protein, 577 aa, Rhodopseudomonas palustris CGA009
MEHNTPLISTIVAGLVLAFAFGVAAQRLKISPLVGYLLAGVVIGPFTPGYVADQSLANELAEIGVILLMFGVGLHFSLKDLLEVRAIAIPGAVVQIGAATVLGAGLGHALGWPFGAGLVFGLALSVASTVVLLRALQERRLVDSERGRIAVGWLIVEDIAMVLTLVLLPAVAGLLKGEATTANWETVLWPVAMTLGKVFAFMVFMLVVGRRIIPWMLHYVAHTGSRELFRLAVLAISLGVAFGAAVLFDVSLALGAFFAGMILSESELSHRAANETLPLRDAFAVLFFVSVGMLVDPGIVVREPLPLLVTVLIIVFGKSIAAFFIVRLFGHPNMTALTISASLAQIGEFSFILAGLGVSLGLMPERGRDLVLAGAIISIMLNPMMFVLLDRVSAKIAAAAEVAKQAAKEAAAAAMPAQPRGHIVLVGHGRVGSNVSTALRRAGADMVVIENDDERVARLQREGFTAINGNAAAQEILDEAEVAQAHGLLVAIPNAFEGGQIVAKARAVNPGLLIIARAHSAEEVTHLRSNGANLVIMGEDEIARAMIARLGVDAVSGDAAASPIISATAPASAGAVA

SEQ ID NO: 421 - protein, 592 aa, Rhodopseudomonas palustris CGA009
MSVENDVGVYREALVFLGTAGVLIPVMTRFRVSPVLGFLVAGLVLGPHSLGRIGADLPWLSYVTITSQDAVDRLAELGVAFLLFTIGLELSFDRLWTMRRLVFGLGMSQVVLTTAAISGIALIFGNTVESSLVIGACLALSSTAIVLQLLAEQKRLATVAGRSIFAVLLAQDLAVVPILFLIVVFGKAAGDAAGGGAASTGAVWLGLAMALVQAAAAILLIIGFGRLVLRRLFRLVASTHNRELFMATILFVVVGTSLVTHVAGLSMALGAFLAGLVLAETEFRRQVEVDIEPFKGMLLGLFFISVGMRIDLAEVARYPAMVATSVIGMTALKALVIAGLTWLFRLSRPVIAEASLLLAGGGEFAFLVLGLASSSGLVTREVEQFMLLVSSGTMMLTPYLARLSRKASARARKAVAVAAGHTDPTPSDSPRIILVGYGRVGRIVGDILNKQGKPFIGIDVDPEAVARARKAGVNVVYGDATQRAFLRKCGLGDAPAVVVTMHDAAAAEHVVAAARAERADLPVIVRARDADHAARLFTLGATEVIREVLEASFEIASTVLQALGMPVGKVIAVIHDERDTRKKRVRAGVPAD

SEQ ID NO: 422 - protein, 389 aa, Xanthomonas campestris pv. campestris str. ATCC 33913
MRALCWNGVNDLRVETVPDPVLVNPRDVILKVGLSTTCGSDLHFIDGYLPTMREGDVIGHEFMGTVVEVGPAVKNVRVGQRVVVPSFISCGGCWHCERKEYSLCDNTNPHWEMQESLLGHPTAGIYGYTHAFGGYAGSHATYIRVPHADVGCFEVPDEVSDEDALFLSDAGPTGFMGADFCNIQPGDTVAVWGCGGVGLMAQQSARILGAERVIAIDRLPERLAMARDVLGVEVIDYSTVDSVVDVLREMTGGRGPDACIDAVGMEAHGTGMGHAYDRVKQALHLHTDRGQALREAILACRKGGILSVLGVYGLMDKFPLGAVMNKGLTMRTAQQHGQLYVPRLLDLARAGRLKSSFLMTHKMPLEEAARGYEMFKHKHEGCVRAAFVP

SEQ ID NO: 423 - protein, 540 aa, Mannheimia succiniciproducens MBEL55E
MNDNWWKNGVIYQIYPKSFQDTTGSGTGDIQGIIKRLDYLQTLGIDGIWITPMYVSPQIDNGYDIADYRNIDPSYGTMADFEQLIAEAHKRDIRIVMDMVFNHSSTFHQWFKQGEDPNSEYHDYYIWREQPTNWQSKFGGNAWKWSDKAQKYYLHLFAPEQADLNWENPKLRAELYDICRFWAEKGVDGLRLDVVNLISKPEKYEDDFEGDGRRFYTDGPKIHQYLQELNQNALKPFGLMTVGEMSSTKLEHCQRYANLDGSELSMTFNFHHLKVDYPNGEKWTYAKPDYVELKSIFNYWQKGMHGKAWNALFWCNHDQPRIVSRFGDEGELRTLSAKMLAMLLHGMQGTPYIYQGEEIGMTNPNFSSIEEYRDVESLNAYQILQNQGKSAVEILQILAQKSRDNSRTPVQWDASPNAGFTSATPWIGVAKNYPQINVEQALADRDSVFYTYQKLIALRKQLAVLTDGDYSDLLPNHESVWLYQRSTAGERLTVAANLSNQPQFIEIKPQGQVLINNYADITQEDSGICLKPYQALYFLA

SEQ ID NO: 424 - protein, 256 aa, Vibrio angustum S14
MRHPVVMGNWKLNGSKEMVSGLIKGLDAALNGVEGVDVAIAPPVMYLDLAEQLLSKANSKIILGSQNVDLHNNGAFTGDISPAMLKEFGASHIIIGHSERREYHNESDEFVAQKFAFLKENGLTPVLCIGESEAQNEAGETVAVCARQLDAVINTQGVEALNGAIIAYEPIWAIGTGKAATADDAQRIHAAIRAHIAEKSEEVAKNVVIQYGGSVKPENAAAYFAQPDIDGALVGGAALVAESFAAIAKAAAEAKN

SEQ ID NO: 425 - protein, 184 aa, Triticum aestivum
  misc_feature (172)..(172): Xaa can be any naturally occurring amino acid
  unsure (1)..(184): unsure at all Xaa locations
MASSSPSPSPSPSPSSPAQARGGRNPLEEWSGRVRALEAGFRAWMAKQPIHVEAVVTTAAGAVQGGALRGLMGSITADGGAPWVPPLPPNANPQAMASFKQAQALAAGPLVQARNFAVMSGTNAGISCVMRRIRGVDDIQGSMAAAFGSGVLPSLGSERATPNPVANAITPXVPSPEFQGGFSM

SEQ ID NO: 426 - protein, 990 aa, Rhodopseudomonas palustris CGA009
MTPLRFPSNLPLRAVAFDEDQSMPHRRPIDAANDFVRRHIGPSPQDIAAMLATAGAGSLEQLVAETLPYAIRHREPLKLGAPLTESEALAHMSELGAQNQVFTSLIGQGYYGTILPTVIQRNILENPAWYTAYTPYQPEISQGRLEALFNFQTMICDLTGLDVANASLLDEGTAAAEAMALAERAAAKNAKAFFVDADTHPQTIAVLRTRAEPLGWRIIVGNPETGLEGADVFGALLQYPGSSGRLSDPRAVIAALRKKGALAVVAADLLALTLITPPGELGADIAIGSAQRFGVPMGYGGPHAAYMAVRDSLKRSLPGRIVGLSIDSHGQPAYRLALQTREQHIRREKATSNICTAQVLLAVINAMYAVYHGPDGLAAIARRVHRRTAVLAAGLQQLGFAPTHGNYFDTLTIEVGDRRDAIVARAEAENINLRINASSLGISLDETTTPATVEALWRAFGGSLDYAAVERDAGDALGTALPAALKRTSDYLTQPAFQDYRSETELLRYMRKLSDRDLALDRAMIPLGSCTMKLNATTEMMPLTWPEFGSLHPFVPKAQAAGYHALFERLETWLAEITGYDAVSLQPNSGAQGEYAGLLTIRGYHLSRGEPHRKVCLIPSSAHGTNPASAAMAGMDVVVVACDAHGDVDVDDLRAKAEAHSADLAAVMITYPSTHGVFEEHIREICDIVHAHGGQVYLDGANLNAQVGLARPGSYGADVSHLNLHKTFCIPHGGGGPGMGPIGVKAHLAPFLPGHPAEGEPLNGGLHGGGTVSAAPWGSASILTISYIYILMMGAAGLKRATEIAILNANYIAAKLHPHFPVLYRNPRGRVAHECIIDPRALKTSTGVTVDDIAKRLIDYGFHAPTMSFPVPGTLMIEPTESESKAEIDRFCDAMIAIRREIAQVEAGRYPIEQSPLRHAPHTAHDVTSAEWTRPYPRTEGCFPAPNSRTDKYWSPVGRVDNVYGDRNLICSCPPVEDYALAADYARAAE

SEQ ID NO: 427 - protein, 602 aa, Ralstonia eutropha JMP134
MNQHDFLIALVVFLVAAVVAVPLARRTGLGAVLGYLLAGAAIGPFALRMVTNVESILHFSEFGVVLMMFVIGLELEPRKLWALRRSIFGYGGIQLAACALVIGILAALVGAPWPVALVAGLGLALSSTAIALATLGERNLFGTPAGGASFGILLFQDIAAIPMIALLPLLAAESAADASGGGWQSAAKAVAVIAAVVFGGRYLVRPALRFIARTDMREMFTAFALLLVVGIALMMDAVGLSMALGTFVAGVLLADSEYRHALEADLEPFKGLLLGMFFMAVGMSIDFAVLARAPGTVLGLVAVFVVAKTAVLMFLGRYFEIARGQRLLFALLISQGGEFAFVVFGVAGTAGLLPRETEALLVLIVALSMVATPLLLLAYDRLVAPRLGVTKRRADEAITPQDNPVMIAGFGRFGQIIGRLLYAQGVGVTVLDHDPDQIEFLRQYGFKIFYGDATRLDLLEAAGIDKARILIVAIDGMDDSLQLIDRVRERYPDLQIYARARHVSHIYQLKDRGVNLFEREMFEGSLMLGRRVLEGLGFDPAEARNVALRFRRHNIQAIDRFYPHYTDQKKLVSLARQARDELQEMFRQDREQRRQREEAEWS

SEQ ID NO: 428 - protein, 163 aa, Arabidopsis thaliana
  misc_feature (108)..(108): Xaa can be any naturally occurring amino acid
  misc_feature (113)..(113): Xaa can be any naturally occurring amino acid
  misc_feature (137)..(137): Xaa can be any naturally occurring amino acid
  misc_feature (146)..(146): Xaa can be any naturally occurring amino acid
  misc_feature (155)..(155): Xaa can be any naturally occurring amino acid
  misc_feature (159)..(161): Xaa can be any naturally occurring amino acid
  unsure (1)..(163): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYXREHGXTLPGYYDGRYLDNFGSFPLFGCTXSVQGFKGGXRVQKGVPGXFIWXXXWK

SEQ ID NO: 429 - protein, 143 aa, Pseudoalteromonas tunicata D2
MALERTFSIIKPDAVAKNHIGAIYNRFESAGLKIVASKMVHLSKEKAEGFYAEHSARPFFGALVSFMTSGPVMVQVLEGENAVLKNREIMGATNPADALAGTLRADYADSIDENAVHGSDALESAAREIAYFFSDEEICPRTR

SEQ ID NO: 430 - protein, 375 aa, Methanococcus maripaludis S2
MIAERCLGTEQSEIRKIFNMATENSINLGIGEPDFDTPKNIVEAAKLALDAGKTHYVPNAGILELTSAISEKLKKDNNLDISQKNIVTTCGASEALMLSLFTLVNRGEEVLVPDPGFVSYKGLTELCEGKMVPIDLDDKFRIDLESVKNSITDKTKCIVLNSPSNPTGSVMTKEELKGICEIADEKNICVISDEIYEKIIYGKKHYSAMEFTDNCILINGFSKAYSMTGWRVGYLAVNENFDNKYQILENMMKIHQYGFACATSFAQFGAVEALKGDQNCVSEMVSEFERRRDLIYSGMKDIFSVQKPEGAFYIFPDVSEYGNGMDVATKLIQNRILCVPGSAFGKNGENSVRFSYATKYEDIKRALEIMKNVLL

SEQ ID NO: 431 - protein, 401 aa, Deinococcus radiodurans
MTAELQPEAGALLHTELMSLNVGPQHPSTHGVLRLVVDMDGEYVTRVEPHMGYLHTGFEKTMEHRTYQQNVTYAPRTDYLHSFSHELAYVLSVEKLLGAEVPERANVVRVILHELGRIHSHLVFVGTGLLDLGALTPFFYAFREKEACQDLFEAVCGYRMNQGYFRVGGLARDLPEGWTARVEAFLNQMERGVEEYTTLFAANPIFLDRAKGVGVIPADAALDLGLTGPNLRASGVPLDNRKDHPYCGFEDYDFNVISSPDGDSLARFNMRLLEFSESIKIIRQGLQKLRPGPIKDPNRKISLPPRHELETSMEAVIHHFKLVTEGFHPPLGEAYVPIESARGEVGYYVISDGGSMPYRVKIRAPSFVNLQALEYACVGVQFADLITILATIDPVLGDVDR

SEQ ID NO: 432 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 433 - protein, 394 aa, Synechococcus sp. CC9605
MTQLETRTEPMVVNFGPHHPSMHGVLRLVVTLDGEDVVDCEPVIGYLHRGMEKIAENRTNVMFVPYVSRMDYAAGMFYEAIVVNAPEKLANIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGRIEKEDAINWSLSGPMLRASGVPWDLRKVDHYECYDDFDWQVAWEKEGDCYARYRVRIEEMRQSLKILRQACDMIPGGPTENLEAKRLNEGKGSDAAGFDFQYVAKKVAPTFKIPNGELYTRLESGKGEIGVFIQGNNDVTPWRFKIRAADSNNLQILPHILKGHKVADIMAILGSIDVIMGSVDR

SEQ ID NO: 434 - protein, 153 aa, Saccharomyces cerevisiae
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 435 - protein, 363 aa, Pseudomonas syringae pv. syringae B728a
MALNSIEELVEDIRQGKMVILMDDEDRENEGDLIMAAECVKPEHINFMARFARGLICMPMTRERCETLKLPLMAARNGSGFGTKFTVSIEAAEGVTTGISAADRARTVQAAAAKDAKAEDIVSPGHIFPLMAQAGGTLARAGHTEAACDLARMAGFEPTGLICEVMNDDGTMSRRAELEAFALQHDIKIGTIADLIHYRMIHERTVQRIAEQPMDSELGSFNLVTYRDSVEGDVHLALTLGTICAEEPTLVRVHNMDPLRDLLMVNQPGRWSLRAAMRAVNEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 436 - protein, 483 aa, Aspergillus oryzae
MLPFKTLFSAIFLAVGGFLFGYDSGIITSTISLPTFQEYFTNPSDTVTGGIVSAFQGGAILGTIVNMVWADWLGRKRTILTGSVISCLGCALQAGSVNMAMLIIGRFIAGMAVGMLTATIPMYAAELSEPKWRATLSGLLQWMLSWGFLVAQWLGYGCSFSSSEFAWRFPLAFQNIPGLILIAGIWFLDESPRWLMEKDRHDEAKVVLTRLRGNSSPDLIELEFREIRDVIEADRAAGNTSWKTILTKPSWRRRLILGCGVQAFGPLSGINVINYYGPRIYQILGIDNNQTSLMIIGISGALSIVYCTICLYLVDKVGRVKPLIVSAAFLGASLLVNAVQAQYMNPNNPHQLRSMVAMNFVFSLFYTPLGIISWVYPAEIFPVEVRALGNALTTFTNWTVNLIFAQFTPGALSSVGFKYFYLFFALNLIAMLCYYFFYPETKGRTLEQIDELFGDQLVPHALEDPEGAQAAMEKEAQVAHVEN

SEQ ID NO: 437 - protein, 393 aa, Ehrlichia canis str. Jake
MSDQVKITPMTLNFGPQHPAAHGVMRLVLEMGGEVIERIDPHIGLLHRGTEKLIEYKTYLQALPYFDRLDYVSPMAQEHAYSLCVEKLLKCEIPIRAKYLRVIFCELTRILNHLLNISSQALDIGAMTPLLWMFEEREKILGFYERASGARFHSAYIRPGGVAADVPSDLIDDIFKFVSTFSKFMDDIDDLLTENRIWKQRNVDIGVVSKKQALDWGFSGPMLRACGIPWDLRKSQPYEIYEDLEFEIPVGENGDCYDRYLVRMAEIRQSIKLLEQCLDRLPDGPVKTDDRKIAPPKRSEMKESMEALIHHFKLYSEGYSVPVGETYMAVEAPKGEFGVYIVSDGTNKPYRCRIRAPGFAHLQAIDIIAKGHMLADLTAIIGSLDIVFGEIDR

SEQ ID NO: 438 - protein, 215 aa, Triticum aestivum
  misc_feature (99)..(99): Xaa can be any naturally occurring amino acid
  unsure (1)..(215): unsure at all Xaa locations
PRVRKKGGIVDVEAAAKIVIHDWNEGKVPYFTLPPKRDVVEDANAVIITEDGSEFNVDEIYKAESSYISGLKSMEEFSHIEIPSNAPPEIDEAMLEGSXTQSAPVKDESMSDANDREGSKAAASGGTQHDKLYTAEGILDPRKKKAEKKRRKGNKFSVLNDMDADYDFKVDYQMKDASPADDEEGDGSKGEGEEPKGEDDKKDAPAAECEPMTTS

SEQ ID NO: 439 - protein, 424 aa, Oryza sativa (japonica cultivar-group)
MADQKVILAEPLLPGKEADFADDDDVEAQLTSYHTGASFSRTCLNLTNAVSGIGVLSMPYAVSQGGWLSLLLFVLVGAVCYYTGTLIERCMRADGSIASYPDIGQYAFGATGRRAVAFFMYVELYLVAISFLVLEGDNLDKLFPGATMEILGYQLHGKQLFIVLAAAVILPTTWLKNLGMLAYVSAAGLIASVALTASLIWAGVAETGFHRNSNTLNLAGIPTSLGLYFVCFTGHAVFPTIYSSMKNSKHFSKVLLISSVLCSLNYGLTAVLGYMIYGDDVQSQVTLNLPSGKLYTKIAIVMTLVNPLAKYALLVAPITAAVEERLSLTRGSAPARVAISTAILASTVVVASTVPFFGYLMSFIGSFLSVMATVLFPCLCYLKIYKADGIHRTEMVAIAGILLLGVFVAVTGTYTSLLQIIATF

SEQ ID NO: 440 - protein, 556 aa, Mycobacterium tuberculosis CDC1551
MPDDIAAADPTDTQPHLRRDLANRHIQLIAIGGAIGTGLFMGSGRTISLAGPAVMVVYGIIGFFVFFVLRAMGELLLSNLNYKSFVDFAADLLGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 441 - protein, 182 aa, Brassica napus
KYNNDIFVMRLKPGESSSHPKIFKSPAAAAAAASVTAAYAIAKSDSSDFPPPPANPTLNGTGNSFPERDIRNTIDSIKEEKRTLESSVAETQVENSKLREKIDEVNSTHAELSQELQSVQGQLISERSRCFKLEAQIAELQKALESGQSIEAEVEMLRKQKLASDEREDGTVKKQGWGWGTR

SEQ ID NO: 442 - protein, 78 aa, Oryza sativa
  misc_feature (51)..(51): Xaa can be any naturally occurring amino acid
  unsure (1)..(78): unsure at all Xaa locations
MAPTVMASSATSVAPFQGLKSTAGLPVRRRSTNSGFGNVSNGGRIKCMQVXPMGGIKKFETLSYLPQLTGRDFWKQIE

SEQ ID NO: 443 - protein, 261 aa, Triticum aestivum
  misc_feature (208)..(208): Xaa can be any naturally occurring amino acid
  unsure (1)..(261): unsure at all Xaa locations
AYLGDSIRTSLYKKAGWHRSGIPGISSTHASGFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLMEGGXGAKSFTGKGRALDLDPHRTSTRESPIFPRRQRRRGRRSRRLYPEEATEGKDLP

SEQ ID NO: 444 - protein, 990 aa, Oryza sativa (indica cultivar-group)
MPPTLLFLLLLLPPSLASPDRDIYALAKLKAALVPSPSATAPPPLARLGPGRDLPRALHLLRRHLRRPSRVVAINLTALPLHFGYLPPEIALLDSLANLTIAACSVPGHVPLELPTLPSLRHLNLSNNNLSGHFPVPDSRWRLPLLPLARAHRRLQQQPLRVASSLLRFTRCLRYLHHGGNYFTGAIPTAMHLAALEYLGLNGNTLSGHVPVSLSRLTPLREMYIGYYNQYDAVPPEFGDLGALVRLDMSSCNLTGPVPPELGRLQRLDTLFLQWKPLRRDTPQLGDLSSRASLDLSVNDLAGEIPPSLANLSNLKLLNLFRNHLRGSIPDFVAGFAQLEVLQLWDNNLTGNIPAGLGKNGRLKTLDLATNHLTGPIPAGPLAGRRLEMLVLMEKAWFGPIPDSLGDWQDVTPVRLAKNFLTGPVPAGLFNLPQANMVELTDNLLTGELPDVIGGDKIGMLLLGNNGIGGRIPPAIGNLPALQTLSLESNNFSGALPPEIGNLKNLSRLNVSGNRLTGAIPDELIPCASLAAVDLSRNGFSGEIPESITSLKILCTLNVSRNRLTGELPPEMSNMTSLTTLDVSYNSLSGPVPMQGQFLVFNESSFVGNPGLCGGPVADACPPSMRGGGGGAGSQLRLRWDSKKMLVALVAAFAAVAVAFLGARKGCSAWRSAARRRSGAWKMTAFQKLEFSAEDVVECVKEDNIIGKGGAGIVYHGVTRGADVAIKRLVGRGGGERDRGFSAEVTTLGRIRHRNIVRLLGFVTNRETNLLLYEYMPNGSLGEMLHGGKGGHLGWEARARVAAEAACGLCYLHHDCAPRIIHRDVKSNNILLDSAFEGHVADFGLAKFLGGATSECMSAIAGSYGYIAPEYAYTLRVDEKSDVYSFGVVLLELITGRRPVGGFGDGVDIVHWVRKVTAELPDNSDTAAVLAVADRRLTPEPVALMVNLYKVAMACVEEASTARPTMREVVHMLSNPNSAQPNSGDLLVTF

SEQ ID NO: 445 - protein, 461 aa, Arabidopsis thaliana
MDPCPFIRLTIGNLALKVPLAAKTTSSVVHPSSSPCFCKIKLKNFPPQTAAIPYIPLETTQFPEIQTLAATFHLSSSDIQRLASRSIFTSKPCLKILIYTGRAGAACGVHSGRLLAKVSVPLDLSGTQSKPCVFHNGWISVGKGAGKSSSSAQFHLNVKAEPDPRFVFQFDGEPECSPQVVQIQGNIRQPVFTCKFSCRHTGDRTQRSRSLPTETSVSRSWLNSFGSERERPGKERKGWSITVHDLSGSPVAMASIVTPFVAFPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRRGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 446 - protein, 591 aa, Oryza sativa
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLPDIAYFEFIPLKPVAGDGGYAEAEPVGLTEVAAGELYEVVMTTFAGLYRYRLGDVVKVAGFYNATPKLKFVCRRNLMLSINIDKNSEQDLQLAVDAAARAVLAGEKLEVVDYTSHADVSSDPGHYVVFLELNAADPAAVDGDVMQACCDELDRAFADAGYVGSRKSGAIAPLELRVLQRGTFQKVLRHYLSLGAPVSQFKSPRCVSRSNSGVLQILAGCTVNVFFSSAYD

SEQ ID NO: 447 - protein, 488 aa, Pseudoalteromonas tunicata D2
MFSPLSQPLVFTDSVIANQPFVTKTFITVDNPATEKLLTSVSCVDDAGIEHAVQSAELGFGTLKSMHSQARSDLLMRWYQLVIDYIDALAEIMTLEQGKPLAEAKGEVIYGAEFIRWFAEECKRSYGQQIPSNNNHQQLSTIRQPIGVVLAITPWNFPIAMITRKVAPAIAAGCSVILKPSELTPLSALALAHLAIRAGFPKGAFNVLLTDDAPSLVSKLLADHRVKKVTFTGSTQVGRILLAQAANTVKRTSMELGGNAPFIVFDSANLDQAVDGLIKSKFRNAGQACVATNRVLLDASIAGDFTAKLLTKVATLKTGNGLSNDTDLGPLINQAAKLRLVATIEQAICEGASWVFGETAFAEAKCSKDNFLPVVVLGNINQDMAIFQQELFGPVVLLSQFESEQQAIELANSTEYGLAAYFYSQNINQVHRVAESLTFGMVGINEGLISNAIAPFGGIKQSGLGREGGQAGLDEYLQQKYLCLNIKD

SEQ ID NO: 448 - protein, 485 aa, Pseudomonas syringae pv. tomato str. DC3000
MSILIPCIIAGGSGTRLWPVSREAMPKPFMRLPDGESLLQKTFLRAAGLPGVDRLLTVTNREVYFRTVDDYRLLNKSHARLDFILEPFGRNTAAAIAAAALHVSTLYGDDAQLLVLPADHLITDVAAFSRAVAAAQTLAAEGWLVTFGIVPTAPETGFGYIEKGQALNAEACQVARFVEKPDAAVAQGYLQSGLHLWNAGMFCMRADAVLRELQTHAPDVLSVVSTCMAVSQRKEGGRELQIELDSESFALTPDISIDYALMERSDKVAVVPCQLGWSDIGSWQAVRELSPVDAQGNHCNGETVLHDVSNCYIDSPKRLVGAVGLDNLIIIDTPDALLIADGRRSQDVKIIAQELKRQGHDAYRLHRTVTRPWGTYTVLEEGKRFKIKRIVVRPQASLSLQMHHHRSEHWIVVSGMATVTNGEREFMLDTNESTFIKPGFTHRLVNPGVIDLVMIEVQSGEYLGEDDIVRFTDIYGRVPEKAVKS

SEQ ID NO: 449 - protein, 153 aa, Triticum aestivum
MDASPTGAVSKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTTEKEPKSPKKAAKSPKKA

SEQ ID NO: 450 - protein, 195 aa, Zea mays
YNQLLGFFPRLFSIGESDTGGSLLIPAARRFYVCSRGQVLVSFGFPRHVSRLVPAFNSQFLAQIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 451 - protein, 226 aa, Prunus dulcis
MKSNSSTLIKLLVLGCLSVVCVAEDFDFFYFVQQWPGSYCDTKKSCCYPTTGKPAADFGIHGLWPNYKDGSYPSNCDPSNPFDQSEISDIRSSMQKEWPTLACPSGSGIEFWTHEWEKHGTCSESVIDQHGYFAAALNLKKKLSLLQALESAGIQPNGDSYSLGNIKDAVKSATGFTPFIECNVDESGNSQLYQVYFCVDTSGSDLIECPVFPHGKCGSQIEFPSF

SEQ ID NO: 452 - protein, 269 aa, Corynebacterium glutamicum ATCC 13032
MNVDISRSREPLNVELLKEKLLQNGDFGQVIYEKVTGSTNADLLALAGSGAPNWTVKTVEFQDHARGRLGRPWSAPEGSQTIVSVLVQLSIDQVDRIGTIPLAAGLAVMDALNDLGVEGAGLKWPNDVQIHGKKLCGILVEATGFDSTPTVVIGWGTNISLTKEELPVPHATSLALEGVEVDRTTFLINMLTHLHTRLDQWQGPSVDWLDDYRAVCSSIGQDVRVLLPGDKELLGEAIGVATGGEIRVRDASGTVHTLNAGEITHLRLQ

SEQ ID NO: 453 - protein, 388 aa, Neorickettsia sennetsu str. Miyayama
MTVIKELNFGPQHPAAHGVLRLIMQLDGETVERLDPHIGFLHRGTEKLIEHKTYLQALPYFDRLDYVSPMAQEHAYSLCVEKLLGITVPPRAQYLRVIFVEITRILNHLLNVTTHALDVGAMNPLFWMFEEREKMLSFYEKASGARFHAAYIRPGGLAADIPDGLDEEIMSFLESFTHKLDDVADVLTDNPIFKQRLVDIGKVSKREAVALGFSGPVLRASGVPWDLRKSQPYEVYESLDFAIPVGSCGDSYDRYLVRMAEMYESVKIIKQCIDKLPEGPVVVDDRKVAPPSRAEMKTSMEALIHHFKLYSEGYHVPEGETYFAVESPKGEFGVYIVSDGTNKPYRCRIRAPGFVHLQALDTLSRKHLLADVPAILGSLDIVFGEVDR

SEQ ID NO: 454 - protein, 401 aa, Brucella suis 1330
MDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVAGSDRFREAARQAYMTGSFWYGGASMAAAVATIKELRRIDGPALMKHAGERLRSGLDAQAARYGFDLLQTGPAVMPLVQFAGDSDAALGARFCQEALKRGVYLHHKHNMFISCAHTDDVINDALSRTEDAFKAISTK

SEQ ID NO: 455 - protein, 969 aa, Prochlorococcus marinus subsp. pastoris str. CCMP1986
MNPKSNTDLFIDRHLGLNDNDEKKMLQKLGFNNIDEFIHQVIPEDIQLKEKCSDVLPKGCSEIEALNELEEISNKNHKFRSLIGLGYYGTHTPKVIQRHVLENPRWYTAYTPYQAEIAQGRLEALFNFQTLICELTGFSIANASLLDEGTAASEAMTMSFSSRKNKSSNTFLVDENVFDHTFNVLLTRAKPLGIKLKRFNQKYFNNHDDVFGLLIQLPGKNGDLFDPTFLISQAHKAEIVVTSIIDPLAQVLIKPIAQFGVDIAVGSLQRFGVPMGFGGPHAAFFACTEKYKRLIPGRIVGQTLSKNGEQSLRLALQTREQHIRREKATSNICTAQSLLAIISSFYATYHGSLGLTKMAKRLVVLRRYLESLLSELGLKIPLGSRFDSFDIYCEESEKIHKEALKNGFNFRILPLGSSIEESKGFGISLDELTDKNEIHKIVNCVANGLGRKEDLTHITLNNCFQFEGIPLRNKEWMQQNVFENYQSETDLMRYIFKLAEKDFSLVDGMIPLGSCTMKLNSAAELSPISWANLSSIHPFAPANQTNGYSKIISDLEKWISDLIGLNSVSFQPNAGSQGEFAGLLAINSYFSSKGDLLRKKCLIPQSAHGTNPASAVMAGFDVVTIKCDSEGNISYEDLLNKVQEFDNTIGALMLTYPSTHGVFELKIREICDLIHSVGAFVYLDGANLNAQVGLCRPGDYGVDVCHLNLHKTFCIPHGGGGPGVGPVATSETLSPFLPSHSLKDNTFSQFGYSVSSSQHGSASILPISWMYIKMAGQRGLRKASSHAILSANYIANTLKNKFKILYKGQNNCVAHECILDFRELKSKTGLSVNDIAKRLIDYSFHAPTISWPVPETIMIEPTESESLTELNRFCEAMILISEEIEEIENNINLRNNNLISNAPHTINELIADNWNYPYSKEKAAYPYKGKFEHKFWSSVSRIDNAYGDRNLICSCNVNDKDFLDDKKCA

SEQ ID NO: 456 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPAGNGQRACIGQQFALHEATLVLGMMLKHFDFEDHTNYELDIKETLTLKPEGFVVKAKSKKIPL

SEQ ID NO: 457 - protein, 229 aa, Nicotiana glutinosa
MASDSATSLFLTLFLITQCLSVLTAAQDFDFFYFVQQWPGSYCDTKQSCCYPKTGKPASDFGIHGLWPNNNDGSYPSNCDSNSPYDQSQVSDLISRMQQNWPTLACPSGTGSAFWSHEWEKHGTCAENVFDQHGYFKKALDLKNQINLLEILQGAGINPDGGFYSLNSIKNAIRSAIGYAPGIECNVDESGNSQLYQIYICVDGSGSNLIECPIFPRGKCGSSIEFPTF

SEQ ID NO: 458 - protein, 576 aa, Zea mays
MPICSCEETIHEFEMLTRDAGRVQKDTLKKILELNADAEYLNKFGLNGRTDVESYKSCIPLCVHSDLEPYIHKIADGDSSPLLTGKPVTSLSLSSGTTQGRPKFLPFTDELLETTLQIFQTSYAFRNREYPIGRGKALQFIYGSKQVVTKGGILATTATTNLYRRARYKEGMKDIQSQCCSPDEVVFGSDFHQSLYCHLLCGLIYSDEVHQVFSTFAHSLVHAFQTFEEVWEDLCADIRDGVLSEKVTVPSVREAVTKILKPNPELADSIYKKCTGLSNWYGVIPALWPNAKYVYGIMTGSMEPYLKKLRHYAGHLPLISADYGASEGWVGANINPTLPPEQVTYAVLPQTGYFEFIPLEVENSASSIHYLESEPVGLTEVEVGKTYEVVITTFGGLYRYRLGDIVKVTGFHNATPELRFICRRSLVLSINIDKNTEQDLQLAVEEAAKLLDAEKLEIVDFTSFVEKSSDPGRYVIFWELSSDASEDVLRGCANCLDLAFVDAGYVGSRKIRAIGPLELRILKRGTFKEILDHFLSLGGAVSQFKTPRFVNPLNVKVLQILSRNTTRSYFSTAYGL

SEQ ID NO: 459 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPWGNGQRACIGQQFALHEATLVLGMMLKHFDFEDHTNYELDIKETLTLKPEGFVVKAKSKKIPL

SEQ ID NO: 460 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPYGNGQRACIGQQFALHEATLVLGMMLKHFDFEDHTNYELDIKETLTLKPEGFVVKAKSKKIPL

SEQ ID NO: 461 - protein, 515 aa, Triticum aestivum
  misc_feature (114)..(114): Xaa can be any naturally occurring amino acid
  misc_feature (121)..(121): Xaa can be any naturally occurring amino acid
  misc_feature (146)..(146): Xaa can be any naturally occurring amino acid
  misc_feature (148)..(148): Xaa can be any naturally occurring amino acid
  misc_feature (152)..(152): Xaa can be any naturally occurring amino acid
  misc_feature (189)..(189): Xaa can be any naturally occurring amino acid
  misc_feature (196)..(196): Xaa can be any naturally occurring amino acid
  misc_feature (201)..(201): Xaa can be any naturally occurring amino acid
  misc_feature (204)..(204): Xaa can be any naturally occurring amino acid
  misc_feature (215)..(215): Xaa can be any naturally occurring amino acid
  misc_feature (444)..(444): Xaa can be any naturally occurring amino acid
  unsure (1)..(515): unsure at all Xaa locations
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEIXVSTDYDXKGDTNTISMSYKKIPQDVKPGHVIXCXDGNXSLAVLSCDPAAGTVRCRCENTAMLGERKNCNLPGIVXDLPTLTXKDKEXILXWGVPNDIDMIXLSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSXEGPARHSLIYRGLIPLLAEGSAKATDSESTEEILQAALKSAVKKQLCKAGDAVVVLHRIGMASVIKICTVK

SEQ ID NO: 462 - protein, 492 aa, Pseudomonas putida
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALVEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAGDVTILPHNLSEALEVLETSKFFREAFGEEFIRYWMHLRRSEWKRFVDAEGQVDFSGDPVTNWEHREYFELF

SEQ ID NO: 463 - protein, 325 aa, Triticum aestivum
  misc_feature (15)..(15): Xaa can be any naturally occurring amino acid
  misc_feature (35)..(35): Xaa can be any naturally occurring amino acid
  misc_feature (63)..(63): Xaa can be any naturally occurring amino acid
  misc_feature (182)..(182): Xaa can be any naturally occurring amino acid
  misc_feature (193)..(193): Xaa can be any naturally occurring amino acid
  unsure (1)..(325): unsure at all Xaa locations
ESPHLTNIASVVHPXGEVDVEDVPKPARLARIVPXPGLDEFKTRAIAERGKDASSQTGHVIHXRRGPSGQLYNYASAAKGAKVLDFNKEAKGASNILDKDKDKYLRNPCSVEGKYVIIELSEETLVDTIAIANFEHYSSNLKEFEMLSSLIYPTENWETLGRFTVANAKHAQSFTFPEPKWXARYLKFNLPKXRGRGRGCTLSMLEVYGMDAVEKMLENLIPVESKNAESDDKSKEPIEQPPLKEPSGGKDSSQEPLDEDEFEVEDDKPNGDSSRNGVHDQIVETRTLQAGRIPGDTVLKILMQKVQSLDVSFSVLERYLPGRPL

SEQ ID NO: 464 - protein, 340 aa, Thermosynechococcus elongatus BP-1
MTLRVGINGFGRIGRLVLRAGLACDNLQFVGINDLVPADNLAYLFKYDSTHGMYPGTVKATAEGIEIDGQFIPCTAVRNPAELPWGAVGADYVVESTGLFTSYEGAAQHLQAGAKRVVISAPTKDADKVKTIVVGVNHDTFDPSSDRIVSNASCTTNCLAPVAKVLHASFGLAEGLMTTVHAVTATQPTVDGPSKKDWRGGRGAGQNIIPASTGAAKAVTLVLPELKGKLTGMAFRVPTPDVSVVDLTFKTEKATTYGDICAAMKAAAEGELKGILGYTEEAVVSSDFIGDGRSSIFDATAGIQLNANFFKVVAWYDNEWGYSCRVVDLLKLMAAKEGLL

SEQ ID NO: 465 - protein, 440 aa, Glycine max
  misc_feature (62)..(62): Xaa can be any naturally occurring amino acid
  unsure (1)..(440): unsure at all Xaa locations
MISSSMALSSPVSLFQLCMLLFSFFFSTSFSAKLNPTIDSLSLSFPLTSLPLSTAKPLNRNXISEPFSSSSSYNIKSSFKYSMALVVTLPIGTPPQHQQMVLDTGSQLSWIQCHNKTPPTASFDPSLSSSFYILPCTHPLCKPRVPDFTLPTTCDQNRLCHYSYFYADGTYAEGNLVREKLTFSPSQTTPPLILGCATESSDARGILGMNLGRLSFPSQAKVTKFSYCVPTRQAANDNNLPTGSFYLGNNPNSARFRYVSMLTFPQSQRMPNLDPLAYTVPMQGIRIGGKKLNIPPSVFRPNAGGSGQTMVDSGSEFTFLVDAAYDAVREEVIRVVGPRVKKGYVYGGVADMCFNGSAMEIGRLIGDVAFEFEKGVEIVVPKERVLADVGGGVHCLGIGRSERLGAASNIIGNFHQQNLWVEFDLANRRIGFGVADCSRS

SEQ ID NO: 466 - protein, 111 aa, Thermosynechococcus elongatus BP-1
MLGQITVVELAQRLATEADTLQLIDVREPEEWAIAHLPHFTPLPLSAFPQWSPQICQLFDPDRETLVLCHHGVRSAQMGHWLIQQGFRNVKNIVGGIDAYAAVVDPTLPRY

SEQ ID NO: 467 - protein, 331 aa, Vibrio fischeri ES114
MKIAMFSTKSYDETSFNSINQNYQFECQFFNFQLTESTAPIANGADVVCAFVNDDLSAPVLEILAKQGTKLIAMRCAGFDRVDLEAAKKLGMQVVRVPAYSPEAIAEHAVGMMMCLNRRFHKAYQRTRDANFSLEGLTGFNFFGKTVGVIGSGKIGLATMRILKGLGMNILCFDPYPSQVAIDMGVKYTTLDEIFSQSDVITLHCPLTPENTHLLDTDSFSKMKDGVMIINTSRGGLLNSASAIEALKAGKIGSLGLDVYDHEKELFFQDKSNDIIKDDVFRRLSACHNVLFTGHQAFLTEEALDNIASTTLGNIDAFLKGEASGNELITN

SEQ ID NO: 468 - protein, 541 aa, Streptococcus suis 89/1591
MTIDKRKVVYQIYPKSYKDTTGNGVGDLRGIIEKLPYLKELGIDMIWLNPFYPSPQRDNGYDISDYTAVNPDFGTMADFEDMVAVGKELGIEFMLDMVLNHCSTDHEWFQKALAGDKYYQDFFILRDQPTDWVSKFGGNAWAPFGDTGKYYLHLFDVTQADLNWRNPHVREELFKVVNFWKDKGVKGFRFDVINLIGKDEVLEDCPINDGKPAYTDRPITHDYLKMMNNATFGSEKGFMTVGEMSATTIENCILYTAPEREELSMAFNFHHLKVDYKDGQKWTIMDFDFEELKRLFHTWGEEMSAGNGWNALFYNNHDQPRALNRFVDVENFRNEGATMLAASIHLSRGTPYIYMGEEIGMIDPDYDSMDDYVDVESINAYQMLLDQGHTPEQAFKIIQAKSRDNSRTPMQWDSSDNAGFSTGAPWLKAGKSYPTINVEQEKTGPIFTFYQELIRLRKELPLISEGDYKAAYNDSQKVYAFERLLNGEKLLVLNNFFAEEVELDLADDYAHGQVLISNYPDNKLGKKIILKPYQALAIQVK

SEQ ID NO: 469 - protein, 236 aa, Bacillus thuringiensis serovar konkukian str. 97-27
MKKYAFITGANKGIGYELVRQLAEKDYHVFLGARNEQLGQQAVESLNVSNVSYIQVDISSSQSIQEATKKIYETTDHLHLLINNAGIALDFNTLPSELNIETLRQGFEVNFFGTFQMVQAFLPLLKKSSNSKIINVTTDMASLTMFANGETHPINTLGYNSSKTAINALTLAFSKEFATNGPEVFGVTPGFTTTDLNGNSPGGHTTTESAKIISKYALSKTNYNGKILNKDGIIPW

SEQ ID NO: 470 - protein, 313 aa, Brassica napus
  misc_feature (258)..(258): Xaa can be any naturally occurring amino acid
  unsure (1)..(313): unsure at all Xaa locations
MGANSIPTDATIGLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEXKVVTIFSAPNYCYRCGNMASILEVDDCRNHTFIQFEPAPRRGEPDVTRRTPDYFL

SEQ ID NO: 471 - protein, 968 aa, Aspergillus nidulans FGSC A4
MAAAAQPSGLMDIASSLTQDEIPFKLRCAICNKLALNAFRLPCCDQAICENCQASLPDTCPVCAHTPISSDLCKPNKALRTTLKAFLRTEEKKREKERQERQEAQPAPSGTAAPADEALVRQESQQDSNVVEETPANGPLPNAGEDSSAAQPVDTASAAAEADAAGEEQIGTNGVSQVDEHSETVAPDAADQALDVAQKNADGDNIESSESTEQPDQDSQNAMPGSGFPNPMGFNMNPGMFPNMAWGTNPMAQFMGGGMMGFPNPMGMAAMGMDPMAASQGMFGGYGMNMNGMSNGMNMGMNFNAGQGMYGGWDGSQNNMWNGSQDKFNPNAFANGMGAQIGDPSGFGGYNMSQPNGVHPQMQQQQFSNQELQNGYYGPGNYRGRGRGYFPGGRGRGGYVGHMQPNFPHNVNSAALQDNTSSADQPMPSQTEEGATDSTATGDNVPSDGKKAEDGPNTADASSGNQALNQVETNGGNVESVPGADGHPDQAMNAENQLQGIPTVDSLNEPYNVGATAAPTYMYQGFGRGGGYMRGGFHGRGGSFGGQQQFMPAPNMQPRGPGVEGAPAAPRAMRQGLPNTSVFRQRNFHLVGRVPNQPSKGPEVSQTPHAEPTSEDQRPQSSSRSISRARSRSRSKPRSRSRSRSRVPSRSSSRRRYRPRSRSVEDDATDYDRPRERRRRPHHDERDRTAEDERRSRSPSIDSHRSSLRDKERDRRRARRSRRSHRRRSRSRSASGDRNGDSRDTDRFAEERSSSKPRSRNADTLDTHRSGKDRSSRREEDRERDRDSRRRDRERDRDRDRDRDRDRDRDRIREKERERDRDRERPRERDRDRERDRKRSRRDRSESAADSDYHSRKAKRGREDDARTSTSNRDRPKDTREKTLLTNPPEPEKDPHTLEREARNRERLLKEQQRREAMQADRDAGKSSRRRDSRQERAGRRLNYKYDDETDAARAARVEREREAGRWE

SEQ ID NO: 472 - protein, 240 aa, Burkholderia xenovorans LB400
MTLQTGTLVVLRHGQSIWNRANRFTGWSDVGLSVQGVADAQRVGERLREAGFRFDLAVTSALLRATDTLAHVLRTLEQPPPRTVRSWRLNDRHYGMLTGMEKDEAALAYGAERVRQWRRGFDLAPPALDADLHAALVRALHDDAMPHADALPRTESLRDTLRRVLPLWDECVAPALTRGQSVLMVGHGNSLRALFKQLDNIGDDAIASVEVAHAEPLVMKFDATLSVISRTPLAALAASR

SEQ ID NO: 473 - protein, 148 aa, Capsicum annuum
MASKRILKELKDLQKDPPTSCSAGPVAEDMFHWQATLMGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 474 - protein, 394 aa, Xanthomonas campestris pv. vesicatoria str. 85-10
MDSTLPYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGKHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIAIFEARRGEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 475 - protein, 604 aa, Ralstonia metallidurans CH34
MNQHDFMIALVVFLVAAVVAVPLARRFGLGAVLGYLLAGAAIGPYALRLVTNVESILHFSEFGVVLMMFVIGLELEPRKLKNLRKTIFGYGTAQLAACALVVGGAAALLGASWQVAIVIGLGLALSSTAIAFATLAERNLMGTPAGAASFGILLFQDIAAIPMIALLPLLAIDAADIAPHGPPHWQTVARAVAVLGIVVVGGRYLVRPALRFIARTDMREMFTAFALLLVVGIALMMEAVGVSMALGTFVAGVLLADSEYKHALEADIEPFKGLLLGLFFMAVGMSIDFGVLAQAPWKVLGLVAGFVLVKTLVLAVLAPRFGIARGQWLLFGLLISQGGEFAFVVFSVADNVGLLTEHMHALLVLIVALSMVATPLLLLVFDQLIAPRLHILMRKPDDVIPPQHNPVIIAGFGRYGQIIGRLLYAQGIGVTVLDHDPDQIEFLRQYGFKIFYGDATRVDLLEAAGVAEAKILVVAIDGMEDSLALIDRVRERWPELTICARARHVSHVYQLKDRGVGIYEREMFEGSLMMGRRVLEGLGFDPAEARNVALRFRRHNIQGIDRFYPYYTDQKKLTSLTKQARDELEEMFRQDREQRRKREEAEWS

SEQ ID NO: 476 - protein, 520 aa, Bradyrhizobium japonicum USDA 110
MTTSLPSRAILVLAVSAFALAGLARADDPPQPRSETAAPAGQKGGRGGGTQSAQQASPSAAEPHRLPSDSTTKQTLDLPGRTLNFAATAGSIRVFDGKGEPLADIAYTSYELDGSDRATRPVTFLFNGGPGASSAWLQFGAAGPWRLPLDGEALSPSASPDVKPNAETWLDFTDLVFIDPVGTGYSRFVATGEDARKSFYSVDGDVNAIALVIRRWLERHDRLVSPKYVAGESYGGIRGPKVVRQLQVQHGVGVRGLILVSPLLDFREFTGTSLLQYVATLPSYVAVAREAKGPVKRADLADVEAYARGEFLADLVKGEADKEATNRLADKVAELTGIDRAVSRRLAGRFDIGEFRREFDRKNGKVTGRYDASVRGLDPYPDSGNSRFGDPSGDALQAPLTSAAVDVLTRKLNWRPDGSYEVLNGAVEGQWDFGRGINPPQSVSDLRQVLAADAKLNVLVAHGLFDLATPYFGSKRVLDQLPAFATQRIKFVVYPGGHMFYSRDGSRQALRGEVEGLIRE

SEQ ID NO: 477 - protein, 459 aa, Pseudomonas syringae pv. phaseolicola 1448A
MQRMDAPAGIARPLLVQHWFICGHKRCLSTQNKLVLWPAVCRLVTYSPSRPSTRNANVTASRIAARVLRIKPSPSSAAADRANELRRAGKSIINLVVGEPDFDTPAHIRQAASAAIENGETRYTLNAGTAALRDAIAAKLQRENGLSYAPGQIVVTSGAKAAIFNAFAATLGIDDEVLIPAPYWVSYPDMVLACDGRPVTLPCPEDNQFKLTAEQLRHAITPRTRWLLLNSPSNPSGATYSATEWRALADVLLDYPDVLVMTDDIYEHIRYDDTPLSHLLTVEPALRERVLIINGVSKTYAMTGWRIGYAAGPSDIINAMATLQSQSTSNACSVSQAAAVAALNGDQSFVGESVKVYKQRRDRCLELINAIDGLSCIQPQGAFYLYVNCAALIGKTTPSGSVLEADTDVVLYLLESQGVAVVAGTAYGLAPFFRMSTATALETLETGCTRIATAVAALR

SEQ ID NO: 478 - protein, 110 aa, Tragopogon miscellus
AMDESNATCGKRLASIGLENTEADRQAYRTLLVTPPGLGNYVSGAILFEETLYQSTVDGKKIVDILVEQGVVPGIKVDKGLVPLAGSNDESWCQGLDGLASRSAAYYQQG

SEQ ID NO: 479 - protein, 363 aa, Hypocrea jecorina
MATQTINKDAISNLSFVLNKPGDVTFEERPKPTITDPNDVLVAVNYTGICGSDVHYWVHGAIGHFVVKDPMVLGHESAGTVVEVGPAVKSLKPGDRVALEPGYPCRRCSFCRAGKYNLCPDMVFAATPPYHGTLTGLWAAPADFCYKLPDGVSLQEGALIEPLAVAVHIVKQARVQPGQSVVVMGAGPVGLLCAAVAKAYGASTIVSVDIVQSKLDFARGFCSTHTYVSQRISAEDNAKAIKELAGLPGGADVVIDASGAEPSIQTSIHVVRMGGTYVQGGMGKSDITFPIMAMCLKEVTVRGSFRYGAGDYELAVELVRTGRVDVKKLITGTVSFKQAEEAFQKVKSGEAIKILIAGPNEKV

SEQ ID NO: 480 - protein, 1027 aa, Saccharum hybrid cultivar
  misc_feature (168)..(168): Xaa can be any naturally occurring amino acid
  misc_feature (432)..(432): Xaa can be any naturally occurring amino acid
  unsure (1)..(1027): unsure at all Xaa locations
TRPASRCSTGGSHGRLLCWLLLACSWVAATTGQQTARTDPAEVAALNTILGRWGLKASAAWNISGEPCSGVAVDTTNVDDNPNINPAIKCDCTYNNATVCHITKLKVYALNVVGQIPAELQNLTYLNNLNLMQNYLTGPVPSFIGKFPMQYLSLAINPLSGTLPKELXNLTNLISWGISLNNFTGELLLELGNLTKLEQIYFAGSGFSGHFPTFSRLKNLKILWASDNDFTGKMPDFIGSLTQLEDLRFQGNSFEGPIPKSLSNLTKLTSLRIGDIVNGSSSLSFISNLTSLNVLILRNCRISDTLATVNFSNLAGLTLLDLSFNNLTGQIPQSILNLEKLGFLFLGNNSLSGSLPDVKSPSLNDLDFSYNQLSGSFPSWATQNNLELNLVANNFILGSSNNSILPSGLNCLQQDIPCFRGSPEYSSFAVDXGSTRSMEGLRYTFYEIDPTNIGAASYYVTGQTRWGVSNVGKFNEAPNGSYIIYSSQQFQNALDSELFQTARMSPSSLRYYGIGLENGNYTVELQFAEFAYPESPTWQSTGRRVFDIYIQGGLKEKNFNIRKTAGGKSYVAVYKKYNATVSKNFLEIHLFWAGKGTCCIPTQGYYGPMISALSVTPSFTPTVRNGVPKKKSKAGAIAGIVIGAAVLGLAALAGTFMLVQKRRRVAQQQEELYNMVGRPNIFSNAELKLATDNFSSKNILGEGGYGPVYKGKLPDGRIIAVKQLSQTSHQGKSQFVTEVATISAVQHRNLVKLYGCCIDSNTPLLVYEYHENGSLDRALFGNSGLSLDWPTRFEIILGIARGLTYLHEESSVRIVHRDIKASNVLLDTDLTPKISDFGLAKLFDEKKTHVSTKIAGTFGYLAPEYAMRGHLTEKADVFAFGVVALETVAGRSNTDSSLEENRVYLFEWAWELYERDKALDILDARIEEFDSEEALRVISVALLCTQGSPHQRPPMSRVVKMLTGDVEVTEVVTKPSYITEWQRRGGNTSYVTSDYSGDTTGEFSMQRETIAPLTPSPAMTGVIDDGR

SEQ ID NO: 481 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 482 - protein, 332 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKFFDCRKAQKFKGRVPGYAVKAVDTTGAGDSFVGAFLVSLGKDGSILDDEGKLKEALAFANACGAVCTTQKGAIPALPTPADAQKLMKSKSK

SEQ ID NO: 483 - protein, 338 aa, Glycine max
  misc_feature (238)..(238): Xaa can be any naturally occurring amino acid
  unsure (1)..(338): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEKEYNSDIDIVSNASCTTNCLAPLAKVINDRFGIVEGLMTTVHAMTATQKTVDGPSSKDWRGGRAASFNIIPSSTGAAKAVGKVLPELNGKLTGMSFRVXPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 484 - protein, 686 aa, Oryza sativa
MASPAAAAPAALLVLLAAALAATGVVADGSDHRYKANELVPLYANKVGPFHNPSETYRYFDLPFCSPEKVKEKSEALGEVLNGDRLVDAPYKLDFRVDYDSKPVCSKKLTKEEVAKFRNAVAKDYYFQMYYDDLPLWGFIGKVEKGGKTDPKEWKYYLYRHIIFDILYNNDRVIEINVHTDQSALVDLTEDKEADVQFLYSVKWKETPTPFEKRMEKYSSSSNLPHHLEVHWFSIINSCVTVLLLTGFLATILMRVLKNDFVKYAHDEEAADDQEESGWKYIHGDVFRFPKNKSFFSAALGTGTQLFALTTFIFLLALVGVFYPYNRGALFTALVVIYALTSGIAGLLLKTMNGGGVRPREGNTLPPAMSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQVCLRWVYEQGDCLIVKSFDEARMRENLDIVGWELTEEERQRIAGIPQRKINRALRFVSDHGPYKSLDDLWDGEI

SEQ ID NO: 485 - protein, 642 aa, Arabidopsis thaliana
MMYVSARSGSAKRSISSLPHLSQRFKQTENEIVQMFSVPNHEESEKPQEKWKLSRKDPSVRMLDERFIRIVKIFKWGPDAEKALEVLKLKVDHRLVRSILEIDVEINVKIQFFKWAGKRRNFQHDCSTYMTLIRCLEEARLYGEMYRTIQEVVRNTYVSVSPAVLSELVKALGRAKMVSKALSVFYQAKGRKCKPTSSTYNSVILMLMQEGQHEKVHEVYTEMCNEGDCFPDTITYSALISSYEKLGRNDSAIRLFDEMKDNCMQPTEKIYTTLLGIYFKVGKVEKALDLFEEMKRAGCSPTVYTYTELIKGLGKAGRVDEAYGFYKDMLRDGLTPDVVFLNNLMNILGKVGRVEELTNVFSEMGMWRCTPTVVSYNTVIKALFESKAHVSEVSSWFDKMKADSVSPSEFTYSILIDGYCKTNRVEKALLLLEEMDEKGFPPCPAAYCSLINALGKAKRYEAANELFKELKENFGNVSSRVYAVMIKHFGKCGKLSEAVDLFNEMKNQGSGPDVYAYNALMSGMVKAGMINEANSLLRKMEENGCRADINSHNIILNGFARTGVPRRAIEMFETIKHSGIKPDGVTYNTLLGCFAHAGMFEEAARMMREMKDKGFEYDAITYSSILDAVGNVDHEKDDVSSF

SEQ ID NO: 486 - protein, 292 aa, Aspergillus oryzae
MGIHTQLTIAVIGCGTLGTAIAAGILSPKERTDLEVHHLTATVGTESSKRRVENALSQHSSRLTVLTQERNVRAVWEADVVLLAMNPVKRADVFAALGFRDILQGKLVLSIMAGITTKALNILALGEDSAPDNESALQCVRAMPNMAAKIREAVTLYTAGSGTTKENLEIASWVFSQVGEAHRIPESSFDICAVSVGCAGSLLLLAIDGLLDAAVAEGVKRPDVQNLVVNSAIGMMKLVPAGDHVSVLREKIASPGGCSIRALLELEKLGVRAAFTTAIMAAAEKSKHMSLS

SEQ ID NO: 487 - protein, 253 aa, Francisella tularensis subsp. holarctica
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 488 - protein, 424 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKFLGREGYCKVEDTPKGWFMTYIDRDSEQAVKERLKRKRIKSDMADDERQERMIARQIERAHKSLAKPNGGGAAEGEPESGSEGEYSGSDDDEQEPEDDSKEADKATGKIAIALQKAVPGPKVNPFDDKPKMKFGFDEEDGSGTRDQEKNELTKKMGKDVKAAEAKRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKVLRAVEYEDICKISS

SEQ ID NO: 489 - protein, 119 aa, Capsicum annuum
MFHWQATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 490 - protein, 460 aa, Oryza sativa
MAADKSPIDEALLHRQEDLRDEVDYDMEHLLLPTGSNMEQHLLLPTGSNMEQHLLLPTGGGSFCMTGASFGRSCLNLSNIISGIGMLSVPYALSQGGWLSLTLFTMVGAICFYTGNLIDRCMRVDRCVRSYPDIGYLAFGSYGRMAIGLVIYVELYLVAISFLILEGDNLDKLLPGIVVEILGYQVHGKQLFVLAAAAVILPTTWLKNLSMLAYVSAVGLVSSVALTASLVWAGVAGKGFHMEGSSLLNLSELPTALSLYFVCFAGHGVFPTVYSSMNSKKDFPKVLLISLVLCSLNYAVTAVLGYLIYGEDVQAQVTLSLPTGKLYTRIAILTTLITPLAKYALVIQPVTIAIEEKLSATTDAEINRLTRVLTSTAVVISTVVLACTVPFFGYLISFIGSSLNVTVAVLFPCLSYLKIYMSRGGVGCFEMAAIIGILVIGVCVAIVGTYTSLQQIIGTF

SEQ ID NO: 491 - protein, 274 aa, Bradyrhizobium sp. BTAi1
MSVQAPTRRQTAPGLRARKGGEPIVMLTSYHAHTAAMIDRHCDAILVGDSLGNVMHGFETTVPVTLDMMILHGRAVMRGSRQALVVVDMPFGCYEASKEEAFHAAARLLKETGCGAVKLEGGVRMAETVRFLCERGIPVMGHIGLTPQSINTLGSFRAQGRQADSWAPIENDARAIAEAGAFAVVIEAVAEPLARKITQEVAIPTIGIGASAACDGQVLVLEDMLGLSPKVPKFVRRYGNLGQAIEDAVTAFAADVRSRGFPAAEHVYGMEREG

SEQ ID NO: 492 - protein, 226 aa, Malus x domestica
MGTGMIYMVMMVFSLILLILSSSTVGFDYYQFTQQYQPAACNSNPTPCKDPPDKLFTVHGLWPSDSNGNDPKYCKAPPYQTMKILEPQLVIIWPNVLNRNDHEVFWRKQWDKHGSCASSPIQNQTHYFDTVIKMYTTQKQNVSEILSKANIKPGRKSRRLVDIENAIRNVTNNMTPKFKCQKNTRTSLTELVEVGLCSDSNLTQFINCPRPFPQGSRYFCPTNIQY

SEQ ID NO: 493 - protein, 580 aa, Photorhabdus luminescens subsp. laumondii TTO1
MSNIEIIQREIITIFAETFGLSKEEIKLEIPLVELGAESLLLFEALEPIHKQFGVKLSVRQFFAELQTVRQLSEYILMVGKNRVVEDNHSVTQPVLSDQEKRSEQSDTSDIPPINKERFFQWMLRSAPSIESEERKKYLASFISEYNERTIKSKIHSVAVRKNIADSRSGIGFKLSIKELLYPIVCTKFAGPVVKDIDGNDYIDMTMGFGAHLFGHSPPFVVKALTQQIDNSFGLGTRHEIGLEVAELIKEITGMDRVAFVNSGTEAVMNAVRAARALTRRNHIVLFSSSYHGHWDAVLARAGDYDEANATKPVSVGIPENMVADVSVFGFGSNEAIEFLKTNRTDIAAVLVEPVPTRDPGLSNPDYLRHLRRVTRELDILLIFDEIVTGFRSHPAGIQGLFGIEADIVIYGKTIGGGMPLGVITGRKKMLDSIDGGNWNFNDDSFPAAEPTFFGGTYFQHPLCMTAAKATLQEIKRRGETFTKVLTQRTESFVSRLNQLFLSRRVPIEARSFSSFFRLMHRDNMDLLYYNLLMRGVYIWEWRCWFISDAHDDTHLEKVYLAFVDSLDELEENNLLPRYS

SEQ ID NO: 494 - protein, 138 aa, Sulfolobus solfataricus P2
MVAQRTFVMIKPDGVKRGLIGEIISRFEKRGLKIVSLKMVKMSRDTAEKLYEEHKGKSFFEELVNYVTSGPVVCMVIEGDDVVQVIRRMIGNTDPKEAPPGTIRGDYALSKSENVIHASDSIEKAQREMSLFFDKSDL

SEQ ID NO: 495 - protein, 265 aa, Zea mays
MLPAPPPPPVLSVIHSEIPTILNVLVDQGHAERQVLVRDDETGKSVAFDQRIRNLKEVYTSDGCKMFCRGSVQTILPANRNWRAGRLCTSLEEKITEMEQEATEIKQINSERLDRKRKLFADRDSIDLELRQLKRKREDEELHVERKKAQLVDTKKISIDNSHAAAVDTSELVVEMMQVKEDIENQELVVQKINLKLTDALQEENNRRASYKDFIESVHAEMGSISDAERELQLVEEKIHDAEQEKAHYERVMETKFLSPITATE

SEQ ID NO: 496 - protein, 412 aa, Lactobacillus reuteri
MPGGVNSPVRAFKNVGGDPLFIDHGKDEYIYDIDGNKYIDYVLSWGPLILGHADDHVVAELDKAVAKGTSYGAPTLQETELAKIVNKIMPSIEMIRMVSSGTEATMSAIRLARGYTHRKKIVKFVGNYHGHSDSLLVDAGSGLATFGINTSPGVPDDLAYDTLTVAYNDVAGVKKLFAEHGDEIACAIVEPVAGNMGVIPGTQEFLQTLRNVTNEHGALLIFDEVMSGFRAAYHGVQSLVNITPDLTTLGKVIGGGLPVGAFGGRREIMENITPAGDIYHAGTLSGNPLAMTGGISTLEQLTPDDYVEMDKKVTALTEGIKHAADQYGVPMTVHHVGTMWSYFYNSDPINNFDDVKACDQKLFEKCFWELLAHGVYVAPSQFETNFISTKHTDEDIEKTIAAFDAAFNAATK

SEQ ID NO: 497 - protein, 228 aa, Malus x domestica
MGSTGMIYTATMVFSLIVLIYSSPTVGYDYFQFTLQYQPAVCNSNGTPCKDPPDKLFTVHGLWPSNFLGPDPEYCKNKTLDSRKIANLTAQLNIIWPNVYDRTDNIGFWSRQWEKHGICGSPAIKNDIHYFETVIKMYITEKQNVSEILLKAKIKPEGKKWTRKRIVDAIRNGTDSKRPKLKCQKNTRMTELVEVTLCRDYDLTHFIDCPNLIEPESPYFCPKRSIQY

SEQ ID NO: 498 - protein, 181 aa, Arabidopsis thaliana
MASSMLSSAVVVTSPAHATMVAPFTGLKSSASFPVTRKANNDITSITSSDGGRGCMKEGPPPVKKKMETIFYLPDVTDDELATEEDYLLRNKWIPCVEFELEHGFVYREHGNTPGYYEGRYWTMWKLPLFGCTDSAQVLKEVEECKKEYPGAFIRIIGFDNTRQVQCISFIAYKPPRFTEA

SEQ ID NO: 499 - protein, 312 aa, Arabidopsis lyrata
YLSGMDILLTVDPVNIHYILSSNFANYPKGMEFKKIFEVVGDSIFNVDSGLWEDMRNSSHAIFSHQDFQRFWVSTSVNKLRQGLVPIIENAADKNILVDLQDLFQRFLFDTSLILMTGYDPKCLSIEMPKVEFGDAVDGVSDGVFYRHVKPVFLWRLQYWIGVGVEKRLKRGLAVFDQLLEKIITAKREEIKSLGTQHHSRGEAIDVLTYYMTMDTTEYKYLKPSDDKFIKDTILGFLIAARDTTSSALTWFFWLLSKNPEAMNKIRQEVNKKMPRFDPADLDKLVYLHGAVCETLRLYPPVPFNHKSPAKP

SEQ ID NO: 500 - protein, 502 aa, Solibacter usitatus Ellin6076
MVYPAQSPSMTQPTLQKDTGFVRGLNLFDSTMVVIGVMIGSGIFIVSADMSRLINSPGWMLMAWVITGVLTLTAALSYGELASMLPHAGGMYVYLREAFSPLWGFLYGWTFFTVIQTGTIAAVAVAFARFSSIIFPAIGESRYLIPPVHITESYALSLSTAQLVAIAIIALLTWTNTRGLEYGKIVQNLFTSAKTVALAALILAGIFLGWNSTAVHANFTDMFRLGSFDASLGVQAASFYGLIVALCVAQSGSMFSADSWHDITIIAGEVRNPSRNLPLAMAFGCSAVIGLYILANAAYLVVLPLPAIQNAPSDRVATAMLQAIFPGYGPTIMAIAIMISTFGCVNSLVLAGARAYYAMAKDGLFFKQAGVLNENRVPGWSLVVQGLWAVMLVLPRTYNVATRQYGNLYSNLLDYVISAALLFYILTIAGVFQLRRKRPDMARPYKVTGYPVVPAVFIIGAAIVLYMLFAYRPATTWPGLVIVVIGAVVYAGVGRGAAARAA

SEQ ID NO: 501 - protein, 390 aa, Chlorokybus atmophyticus
MLETKTDPMVISMGPHHPSMHGVLRLIVTLDGENVIDCEPVLGYLHRGMEKIAENRTIVQYLPYVTRWDYLATMFTEAITVNAPERLANIEVPKRASYIRVIMLELSRIASHLLWLGPFMADIGAQTPFFYIFREREMIYDLFEAATGMRMMHNYFRIGGVAADLPYGWVDKCLDFCDYFLPKVDEYERLITNNPIFLKRVKDIGKISKEDAINWGLSGPMLRASGVKWDLRKVDNYECYDELDWSIQWQSDGDCLARYQVRIGEMRESIKIIQQALKAIPGGPYENLEARRLSKGRKSEWNNFEYQFIGKKPSPTFKMPKQEHYVRVEAPKGELGVFLIGDDNVFPWRWKIRSPGFINVQILPQLVQGMKLADIMTILGSIDIIMGEVD

SEQ ID NO: 502 - protein, 333 aa, Debaryomyces hansenii CBS767
MAETITKTQPQSLKLRSGFELPQVGFGLWKIPKDKTAQVVHDAIKCGYRNFDGAYDYQNEEEAGEGIRKAISDGLVTRDEIFVTTKLWNNYHSKENVFKSAKWQNEAWGLGYIDLYLMHFPIALKYVDPKENQYPAWWADKEMTIVQPDRVPIRETWEAMESLVDLGIARSIGVSNFQAQAIYDILTYNSLPISALQVEHHPYLVQPELFQLCQEQNIAFIAYSSYGPQSFLELPGSFSELANDITPLFQNKTILSIASTHKKSPAQVLLRWATQRGVVVIPKASSQTHLEQNLQLDFDLSEDQINSISKLDIGLRFNDPGFYLKSHPLHIFA

SEQ ID NO: 503 - protein, 492 aa, Mycobacterium bovis AF2122/97
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFGQLEIKTILHRLLRRYRLELSRPDYQPRWDYSAMPIPMDGMPIVLRPR

SEQ ID NO: 504 - protein, 474 aa, Yersinia pestis biovar Medievalis str. 91001
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGNAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 505 - protein, 366 aa, Bacillus cereus ATCC 10987
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSEEDAISYSLSGANLRCTGVNWDLRKDEPYSIYDRFDFDIPVGSVGDAWDRYVCRMKEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 506 - protein, 194 aa, Oryza sativa
GKWQRNKYVGVSLVGKTLAIMGFGKVGSEVARRAKGLGMDIISHDPYAPVDRARAIGVDLVSFDEAISTADFISLHMPLTPSTAKLFDDETFANMKKGVRIINVARGGVVDEDALLRALDNGTVSQAALDVFTEEPPPKDSKLVHHEHVTVTPHLGASTSEAQEGVALEIAEAVLGALKGELAATAVNAPMVPA

SEQ ID NO: 507 - protein, 625 aa, Oryza sativa (japonica cultivar-group)
MALAPPLCHLLAAPPPSTSAAADAAHDHAGALAPHRRASPLRRRGRLFLACRVPAAAPSARGVAAEAAAGRPTVLVTEKLGDAGLELLRRFANVDCAYELTAEELRAKVSLVDALVVRSATRVTREVFEAARGRLRVVGRAGVGIDNVDLQAATEAGCLVVNAPTANTVAAAEHAIALLAAMARNVAQADASLKAESCFSLVLCTYSGKWQRNKYVGVSLVGKTLAIMGFGKVGSEVARRAKGLGMDIISHDPYAPVDRARAIGVDLVSFDEAISTADFISLHMPLTPSTAKLFDDETFANMKKGVRIINVARGGVVDEDALLRALDNGTVSQAALDVFTEEPPPKDSKLVHHEHVTVTPHLGASTSEAQEGVALEIAEAVLGALKGELAATAVNAPMVPAEVLSELSPYVILAEKLGRLVVQLVAGGSGIKGVKIGYSSSRDPDDLDTRVLRAMVTKGIIEPISSAFVNIVNADYVAKQRGLRISEERILLDGSPEIPIDSIQVHLANVESKFAGALSDEGDIRVEGEVKDGKPHLTLVGPFSVDVSLEGNLILCRQVDQPGIIGKVGSILGKMNVNVNFMSVGRTAPGKQAIMAIGVDEEPEKEALKLIGDIPSVEEFVFIKL

SEQ ID NO: 508 - protein, 154 aa, Prunus mume
RMPSNCTGSQFNFTKVYPQLRSKLKKSWPDVESGNDTRFWESEWNKHGTCSEEKLNQMQYFERSHEMWNFHNITKILENASIVPSATQKWSYSDIVSAIKARTQTTPSLRCKRDKKTQLLHLHEVVLCYEYNALKQIDCNRTATCGNQQAIWFQ

SEQ ID NO: 509 - protein, 279 aa, Bacillus cereus G9241
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEKRVRAIGVSNFQIHHLQDVLADAEMKPMINQVEYHPRLTQKELQAFCKEQGIQMEAWSPLMQGQLLDNETLQEIAHKYGKTTAQIILRWDLQNEVVTIPKSTKEHRIIANADVFNFELTKEDMEKIDALNQNHRVGPDPDNFDF

SEQ ID NO: 510 - protein, 330 aa, Shewanella sp. MR-7
MQTLAQHLTSKAVNESLSQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 511 - protein, 455 aa, Bradyrhizobium japonicum USDA 110
MTASDAGTAPWTGRLTGRGAGVSVLVATAIVVADMIGVGVFTSLGFQVKDIPSGFSILLLWSVGGIVALCGVFSYSELGAMFPRSSGEYNFLGRAYHPAFGFLAGWVSATVGFAAPVALAAMAFGEYAKSVVPDLPPIPLAIGVVWLVSLVQLTGVRHSSTFQLISTILKVVLIVAFLVAGFIIGVPQPIAFTPQPGDLAHIVSAPFAIGLVFVMYSFSGWNAATYIIGEMNMPQQNLPRALLAGTLIVLVLYVALNAVFLYSTPVGALAGQLDVASVAGSAIFGSLGGRIVGAMICVGLISSISAMMWIGPRVMMTMGEDIPALRVFSRKSTSGAPAYAILFQLAVATLLLFTRSFEAVLDFIQFALLFCSFFTVAGVIKLRITDPDLPRPYRAWGYPFTPLVFLLVTAFMMYYLLTERPVQSLSGMFVMLSGLLIYAVFRRRPVAAGTSHNRE

SEQ ID NO: 512 - protein, 237 aa, Oryza sativa
MVVQEFTVDLNKPLVFQVGHLEERYQEWVHQPIVSKEGPRFFGNDVLEFLTRTKWFAVPTIWLPVVCWLLVKSIRMGHTIQEVGLMALFGIFIWTLIEYTLHRFLFHIETKTYWANTAHYLLHGCHHKHPMDSLRLVFPPTATAILCVPFWKLVAFFATPTITPALFGGGLLGYVMYDCTHYYLHHGQPSKEPAKNLKRYHLNHHFRIQNKGFGITSSLWDYVFGTLPPSKTTGKNN

SEQ ID NO: 513 - protein, 477 aa, Corynebacterium efficiens YS-314
MAFNTPEEVTKFIKDENVEFVDVRFTDLPGIEQHFSIPASALDEDAIEEGLAFDGSSIRGFTTIDESDMNLLPDLATAKIDPFRKAKTLNIKFFVHDPFTREAFSRDPRNVARKAEQFLASTGIADTCNFGAEAEFYLFDSVRYSTDINSGFYHVDTNEGWWNRGRETNLDGTPNTGSKNRLKGGYFPVAPYDQTVDVRDEMVRNLRDAGFHLERFHHEVGGGQQEINYRFNTLLHAADDIQTFKYIVKNTAALHGKAATFMPKPLAGDNGSGMHAHQSLWKDGKPLFHDESGYAGLSDIARYYIGGILHHAGAVLAFTNPTLNSYHRLVPGFEAPINLVYSQRNRSAAVRIPITGSNPKAKRIEFRAPDPSGNPYLGFAAMMMAGLDGVKNRIEPHAPVDKDLYELPPEEAASIPQAPTSLEASLKALQEDSDFLTESDVFTEDLIEAYIQYKYDNEITPVRLRPTPQEFELYFDC

SEQ ID NO: 514 - protein, 512 aa, Mycoplasma hyopneumoniae 232
MQKNRKNVKKKLVLIIIDGLGLRFESQGNGFALAKTPVFDRLFQEYPNSLIAASGQEVGLPEGQMGNSEVGHLNIGAGFVVYTGISIINNALKTGKFFENEKFILAFRHSIKTGFPLQIMGLFSPGGVHSHQDHLFALIDFAANFGVKKLNLHLFGDGRDVGPKSIKPWIKMLNLKLKNYENYKIASISGRFYSMDRDKMFDRVELGYNALLGKAENTFTDPIDYVNFQYEKGVSDEFFEPAINLKVNKKDFLADDHPVIFFNFRPDRARQLSHLILQTDLYEQKPKNPIKTDVFVSMMKYEGINCLVAFEEMRVENPLGKLICMAGFRQLRLAETQKYAHVTFFVDGGVELELENSDRILIDSLKVQSYADFPQMSAVEITDKLLEVGQKYDFIIMNFANPDMVGHTGDLKATIKAVEILDFQIGRICKWAEEKNFDFFITADHGNAELTEDENGNPSTKHTTFPVMLISSDKTIKLKSGKLANIAPTILDYLGLDKHPDMDHDSLIIKDK

SEQ ID NO: 515 - protein, 279 aa, Kluyveromyces lactis NRRL Y-1140
MTSVEVKKVLTTLLRDPENNRCGDCKVATHPRWASWSLGVFVCIKCAGFHRSMGTHISKVKSVDLDTWTEEHLEAVLEFGNNKKFNEYYENKLGGGTYVPDQSKIGQFIRTKYELKKWVGDDPIVDVKSSKHTAEAKDRVAQKAAAVRNSPSSDSPRSLDLDLGLNLNSVVTDKNVPQISSEKPSATNTNVYRPPDRPDLKKSILSLYANRKSTSPHSQSQSPSQSSLHLPTKNMSTSNSLSSGGKLTSNPWAVPRAVDDSRSGSSLSLDDDLFKNVWS

SEQ ID NO: 516 - protein, 243 aa, Xanthomonas campestris pv. campestris str. ATCC 33913
MSTNKIALVTGGTRGIGLETVRQLAQAGVHTLLAGRKRDDAVAAALKLQAEGLPVEAIQLDVNDDISIAAAVGTVEQRHGHLDILINNAGIMIEDMQRKPSEQSLDTWKRTFDTNLFAVVGVTKAFLPLLRRSLAGRIVNVSSILGSLTLHTQQGSPIYDFKIPAYDASKSALNSWTVHLAHELRESAIKVNMVHPGYVKTDMNGGVGEIDVEQGAHSSVQMALIDAHGPNGSFTYLGEVLPW

SEQ ID NO: 517 - protein, 288 aa, Mannheimia succiniciproducens MBEL55E
MNSKRHLGHTARKRFGQNFLHDDNVIQGIVAAIYPQKGQFLVEIGPGLGALTEPVADQTDRLTVVELDRDLAQRLRHHPFLHQKLNVIETDAMQFDFGKLYEDEHLAEQGQKLRVFGNLPYNISTPLIFHLLKFYDKIQDMHFMLQKEVVKRLCAAPNSKAYGRLTIMTQYFCQVMPVLEVPPTAFKPAPKVDSAVVRLIPHKELPHPVKDLYWLNRVTSQAFNQRRKTLRNALSTLFTPEQLTALNIDLTARAENLSIADYARLANWLADNPPADVRRDEIIEENEE

SEQ ID NO: 518 - protein, 430 aa, Bacillus subtilis subsp. subtilis str. 168
MRSYEKSKTAFKEAQKLMPGGVNSPVRAFKSVDMDPIFMERGKGSKIFDIDGNEYIDYVLSWGPLILGHTNDRVVESLKKVAEYGTSFGAPTEVENELAKLVIDRVPSVEIVRMVSSGTEATMSALRLARGYTGRNKILKFEGCYHGHGDSLLIKAGSGVATLGLPDSPGVPEGIAKNTITVPYNDLESVKLAFQQFGEDIAGVIVEPVAGNMGVVPPQEGFLQGLRDITEQYGSLLIFDEVMTGFRVDYNCAQGYFGVTPDLTCLGKVIGGGLPVGAYGGKAEIMEQIAPSGPIYQAGTLSGNPLAMTAGLETLKQLTPESYKNFIKKGDRLEEGISKTAGAHGIPHTFNRAGSMIGFFFTNEPVINYETAKSSDLKLFASYYKGMANEGVFLPPSQFEGLFLSTAHTDEDIENTIQAAEKVFAEISRR

SEQ ID NO: 519 - protein, 336 aa, Aspergillus niger
MAPKVGINGFGRIGRIVFRNAINHGEVDVVAVNDPFIETHYAAYMLKYDSTHGQFKGTIETYEEGLIVNGKKIRFFAERDPAAIPWGTTGADYIVESTGVFTTQEKAAAHLKGGAKKVVISAPSADAPMFVMGVNNTSYTKDINVLSNASCTTNCLAPLAKVINDKFGIVEGLMTTVHSYTATQKVVDAPSSKDWRGGRTAAQNIIPSSTGAAKAVGKVIPTLNGKLTGMAMRVPTSNVSVVDLTCRLEKATSYDEIKKALKDASENELKGILGYTEDDIVSSDLNGDDHSSIFDAKAGIALNSNFVKLVSWYDNEWGYSRRVVDLIAYISKVDAQ

SEQ ID NO: 520 - protein, 772 aa, Arabidopsis thaliana
MGKKRIVFFACLLLFTVLLRFSYAGITTESPLSVEQTLSSSNGIYELGFFSPNNSQNLYVGIWFKGIIPRVVVWVANRETPTTDTSANLAISSNGSLLLFNGKHGVVWSIGENFASNGSRAELTDNGNLVVIDNASGRTLWESFEHFGDTMLPFSSLMYNLATGEKRVLTSWKTDTDPSPGVFVGQITPQVPSQVLIMRGSTRYYRTGPWAKTRFTGIPLMDDTYASPFSLQQDANGSGFFTYFDRSFKLSRIIISSEGSMKRFRHNGTDWELSYMAPANSCDIYGVCGPFGLCIVSVPLKCKCLKGFVPHSTEEWKRGNWTGGCARLTELHCQGNSTGKDVNIFHPVTNVKLPDFYEYESSVDAEECHQSCLHNCSCLAFAYIHGIGCLIWNQNLMDAVQFSAGGEILSIRLAHSELGGNKRNKIIVASTVSLSLFVILTSAAFGFWRYRVKHKAYTLKDAWRNDLKSKEVPGLEFFEMNTIQTATNNFSLSNKLGQGGFGSVYKGKLQDGKEIAVKQLSSSSGQGKEEFMNEIVLISKLQHRNLVRVLGCCIEGEEKLLIYEFMLNKSLDTFVFDARKKLEVDWPKRFDIVQGIARGLLYLHRDSRLKVIHRDLKVSNILLDEKMNPKISDFGLARMYEGTQCQDKTRRVVGTLGYMSPEYAWTGVFSEKSDIYSFGVLLLEIIIGEKISRFSYGEEGKTLLAYIGLLCVQHQPADRPNTLELLAMLTTTSDLPSPKQPTFVVHSRDDESSLSKDLFTVNEMTQSMILGR

SEQ ID NO: 521 - protein, 259 aa, Gluconobacter oxydans 621H
MGGALLDGWLASPTPPRLVILDRHRTGSDDAITVVRTAAEIPAGFKPDIIVLAVKPAAAEIMIDAIGKALGPRMSNAAILSVMAGRTCAALSDAARLAGADIPVLRAMPNTPSAVGAGISGLYAAPSATPEQKSICHDLLFAVGDVVPVEKEADLSVVTAISGSGPAYVFLLAELLEKAGQQHGLSPTIARRLARGTIYGAGRMLDDLPDSAEDLRKAVTSPNGTTAAALAVLMKSDAWPETVPKAIDAATKRADELAG

SEQ ID NO: 522 - protein, 270 aa, Nitrosomonas europaea ATCC 19718
MKITFIGGGNMAGAMIGGLIHHGSTPSHICAVETDAMRRQQLAEACGVTVTASIPDGIHGSEIVILAVKPQQLRAVANQAAQFLQNKLVISIAAGVRASDLSQWLNRHEFVIRAMPNTPALIGEGITGLYALPLVDSRQKEQATTILEAIGTVIWVNEEAQLDAVTALSGSGPAYVFYFLEAMQEAGTQLGLTADTAKQLAMQTFLGATHLAAQSNDTLATLRMKVTSQGGTTEQALLSMEQADIRGAFIRAMHAACDRSRQMGEIFGRT

SEQ ID NO: 523 - protein, 447 aa, Bacillus thuringiensis serovar konkukian str. 97-27
MLHRYLPMTEEDKKEMLQTIGVQTIDELFSDIPESVRFKGDLKIKEAKSEPELLKELSQIASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 524 - protein, 441 aa, Mycobacterium avium subsp. paratuberculosis K-10
MSTTTESTHDGAGETLVVAGGQDWDKVVEAARSADPGERIVVNMGPQHPSTHGVLRLILEIEGETVTEARCGIGYLHTGIEKNLEYRYWTQGVTFVTRMDYLSPFFNETAYCLGVEKLLGITDQIPERVNVIRVMMMELNRISSHLVALATGGMELGAMTPMFVGFRGREIVLTLFESITGLRMNSAYIRPGGVAQDLPPNAKTEIAQALDQLRQPLREMGDLLNENAIWKARTQDIGYLDLTGCMALGITGPILRATGLPHDLRKSEPYCGYENYEFDVITADTCDAYGRYMIRVKEMWESIKIVEQCLDKLQPGPIMVENGKIAWPADLKVGPDGLGNSPEHIAKIMGGSMEALIHHFKLVTEGIRVPPGQVYTAVESPRGELGVHMVSDGGTRPYRVHYRDPSFTNLQSVAAMCEGGMVADLITAVASIDPVMGGVDR

SEQ ID NO: 525 - protein, 532 aa, Trichodesmium erythraeum IMS101
MKNGSISPVVLIILDGWGYREEKYGNAIAVGKTPNIDSLWQAYPRTLIQASGKAVGLPEGQMGNSEVGHLNIGAGRVVPQELVRISDAIEDGLIVQNQAIKKICQDVIERNSKLHLVGLCSSGGVHSHVNHLLGLLDVAKAKGISDVCVHAITDGRDTNPKSGLHVLKQIEYHTNQIGIGRIATVSGRYYAMDRDKRWDRIQKAYEVMTQDGYGTGCSASDLLQKSYAEGITDEFVLPVRVAPGAVEPGDGVIFFNFRPDRARQLTQAFVAPDFNGFERQTIQPLTFLTFTQYDSSFPVLVAFEPQNFNNILGQVISQHGLRQFRTAETEKYAHVTYFFNGGLEQPFEGEDRELVQSPMVSHYDEAPEMSAEDLTEVAIAAVKKQIYSLIVINYANPDMVGHTGAMDAAVNAVQTVDHCLGKLLQGISKVGGTAIIIADHGNAEYMWDEDGNPWTAHTTNLVPFILIEGEVSKIPGHGTKVPLRENGCLADIAPTILEILNLPQPAEMTGKSIIKKAEYELKPNRTPVRVGL

SEQ ID NO: 526 - protein, 385 aa, Triticum aestivum
PTVSGCTKKQVATGPEFPGYRRPTRPLPTLLFRGPDPALPSLPLAPPCRRRRALAQVAFSPGRRRRRRAAEDMEPMSVDSSGCGGLDAQIEQLLQCRPLAEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNAHTFIQFEPAPRRGEPDVTRRTPDYFL

SEQ ID NO: 527 - protein, 504 aa, Xylella fastidiosa 9a5c
MLTRKKSMDCKVGRLGMPIALAVSDCYPNPKRFPLMSLENVEKLVKDKKIEFVDLRFVDMRGVQQHVTFPVNILEPSLFKDGKMFDGSSIAGWKGINESDMVLLPDANTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNGGYRPAVKGGYFPVPPTDSLHDLRAEMVKTLEQVGIETEVHHHEVATAGQCEIGTKFNSLVKKADQLMTMKYILKNVAYRNGKTVTFMPKPMVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFIDGYIALKMQEVTQFRAATHPLEYQMYYAN

SEQ ID NO: 528 - protein, 511 aa, Oryza sativa
  misc_feature (271)..(271): Xaa can be any naturally occurring amino acid
  unsure (1)..(511): unsure at all Xaa locations
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQCAAYTAPANSQTTWTMRATFPEYVVALATIVGSVLFTIFGGVGIACLPLGLIFSFVRRPKAVITRSQYIKEATELGKKARELKKAXAEALHQEEKSGKKGRKWRKNVKALGKELVLLEDDMKALEEMYPQGEQAEATWALTVLGYIGKLLFGAVGLIISIAWVAHIVIYLLIDPPLSSFLNEIFVKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 529 - protein, 486 aa, Leptospira interrogans serovar Copenhageni str. Fiocruz L1-130
MKSESSVFRKTKIICTIGPATSDKKMIQALAEAGMNVARLNMSHGNHDFHRSIIRNIKSLNKDVLKNPIAILLDTQGPEIRTGDLQVDHLDLKVGETFTFHIIPGEESEEQSVFVNYKDIVKDLKVGDPVTVDNGLINLVVEEINDSALKCKVLDGGRLGSRKHINLPGIRVNLPSITPKDHKDILFGLEEDVDFIALSFVRSVEDINQLKQIIEENDGHAQIIAKIEDQEAVRNMKEIVEAADGVMVARGDLGVEVPIEELPILQRAIIKECALKGKRVIVATHLLESMIHNPSPTRAEVTDVANAIYEEADAIMLSGETAAGKFPIRCVEMMDKIAQRVEKTGGVDYVKDKIPQDKKEQMARAAAKLADSLKCPAIIVITRRGTTALNVAGFHPHYPLIYAFTNMTTVRRKLWLTRGVIPHRIDFSKDPEKTIRLAIETLKKTGRIEDGDQVVILSDIIAGEDRVETIQIREVKTYFNVEVEKL

SEQ ID NO: 530 - protein, 272 aa, Photobacterium sp. SKA34
MEQRSIAFIGAGNMARSIIAGLVASGYDAKKLTATAPSDARREPLARDFGIHTTSDNLNAAQNADVVVLAVKPQLMEEVCKPLQDINFAGKLVISIAAGINCDRLCEMLGQQVELVRVMPNTPSLIGKGMSGLYAKPQLTETDRLFATQLLQAVGEICWVQEESGINGIIAAAGSAPAYFFLFMEAMQQEAMNQGFDADTARLLVQQAALGAAELVKANPDTSLSTLRDQVTSKGGTTAEAINTFNQHQFSDIVAKAMQAAVSRAKEMEQLF

SEQ ID NO: 531 - protein, 314 aa, Mesorhizobium huakuii
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 532 - protein, 314 aa, Mesorhizobium loti
VMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 533 - protein, 314 aa, Mesorhizobium mediterraneum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 534 - protein, 292 aa, Photorhabdus luminescens subsp. laumondii TTO1
MDNQPIIRLADGNHMPQLGLGSWASDDQQIAETIHAALDIGYRAIDTAAIYNNEKGVGNALQETDIPREDIFVTTKLWNDRHLDARAALTESLEKLQLDYVDLYLIHWPAPPQDQYVGAWQQLIELQKEGLIRSIGVSNFQPEHIQRLINETGVHPVINQIELHPLLQQRQLHAWNATHNIVTESWSPLAQGGENVFDNQLVQHLTQKYGKTPAQVVIRWHIDNGMIVIPKSTTLSRIKENFDVFDFKLEKEDLTAMTTLDIGKRLGPTPEIFVDFSEFIQLLEQNSANNQC

SEQ ID NO: 535 - protein, 314 aa, Mesorhizobium ciceri
  misc_feature (100)..(100): Xaa can be any naturally occurring amino acid
  unsure (1)..(314): unsure at all Xaa locations
VMFDGSSIAGWKAITKSDMVLMPDPETVHMDPFFAQSTMVILCDILDPVSGESYNRDPRGTAKKAEAYMKAEGIGDTIFVGPEAEFFVFDDVKYKADPYXTGFKLDSTELPSNDDTDYETGNLGHRPRIKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFFIGGVIKHAKAINAFTNPLTNSYKRLVPGYEAPVLLAYSARNRSASCRIPFGSSPKAKRVEVRFP

SEQ ID NO: 536 - protein, 481 aa, Corynebacterium efficiens YS-314
MASSPTTNPDEILKFIRDNDINWVDVQFTDVPGTEQHLSVPAAAFDESAMENGLAFDGSSISGYTTVDDSDMMLLPDLSTAFIDPFRRSKTLNIKFFVHDPYTREPFSRDPRNIARKAEEYLASTGFADSCNFGAEAEFYIFDSVRFSSQSNAAFHEVDSVEGWWNSGSRENPDGSRNLGHKVRQKGGYFPVAPYDHFQDLRDTIGETLAEIGFTVERSHHEMGSGGQQEINYRFNTLLRAADDLQTFKYVVKNTAKAVGKSATFMPKPLADDGGSGMHIHQSLWKDGKPLFHDEAGYANLSEMARHYVGGLLKHAPAVLAFTNPTLNSYNRLVPGFEAPVSLAYSQQNRSAAIRIPASGPNPKATRIEFRTPDPSGNPYLAFTASMMAGLDGIRNRIEPDAPLDKDLYELPPEEAAKVAEAPTSLEQALKALEEDHEFLTEGDVFTDDLIEAYVAYKHEHEITPERLRPTALDFELYYDC

SEQ ID NO: 537 - protein, 314 aa, Rhizobium leguminosarum bv. viciae
VMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 538 - protein, 435 aa, Roseovarius nubinhibens ISM
MGILASLRSARRNILSIIPEIATKQPMVSGRTGKRWHMVMDPGAIRRILLEELDNYPKSLVTKNLLRPAVGESLFIAEGDHWRWQRRAAAPAFSHRNVLNLAPVMSGAAGRSADRVAAAGGQAIDMAEDMVRTTFDVISDVTFSGGDAFDADGVHRAIDDYISAAGKISLFDILGFPDWVPRPARVAAGPGMRQMKALADRAVNDRRARGHDGTPDLLDLLLAGEDPETKRKMNTAELRDNLLTFIVAGHETTALTLAWSLYLCAFDQEVQDRARAEAKAVLTDGQPATGEDVAKLPFIRQIADEALRLYPPAGMISRTALKKDRLCDRDIRPGDTVIIPIYALHRNHLLWDDPDHFRPERFADRKAVDRYAYLPFGDGPRICIGSSFALQEAVIILATLLARFRFRPIAGRDPKPVMILTLRPEGGVWLTAEEL

SEQ ID NO: 539 - protein, 574 aa, Debaryomyces hansenii CBS767
MKEIKDMKNIFTVKSPSKPGIYRSDSSYVNLSISNSKIVNIDESGKVLSAENSNETFDEKTLERGLKLRHVQLIALGGCIGTGLFIGTGSALSQCGAASLFISYVIMSAVIFFVMNMLGEMTTFLPLPGNGAQAFVNDYFDDSLGFAIGYNYWYAFSMLIASEVTAAAIVIQYWNTSVNIAVWITIFLAVIVGLNMSSVKYFGEAEFYFASLKLIAITGLIILGVVLFFGGGPNHDRLGFRYWEHGGAFKQHLTGGDTGRFLGVWTAIIKSGFAFICSPELVSIAGGECQKPRRNIPKACNRFIYRLCFFYIFGTLVIGVIVNSNSNRLLSGGSDASASPFVIGIQNAGIPVLNHIINAVILTSAASAGNSFCYSASRSLYSMAVKGLAPSCFAKVNKLGVPYYCVLVSSAVGCLAYLNCSSSSSNVFTWFSNIATISGFISWIAVGMAYLRWRKAIEYHNLQDRVTYRTILQPYGAYFVIIFIGLVTLTNGYAVFFDFNGADFVAAYITFPIVIVLYFGHKIYNRTVNGVTRWIRPLEEVDLFTGLDLIEEEDNNTPDRVPKNVAEKIWYWVA

SEQ ID NO: 540 - protein, 128 aa, Arabidopsis thaliana
MSWAGPEEIYLSTSLASYLDRKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 541 - protein, 1032 aa, Candida glabrata CBS 138
MLKGTAIKRSWTGLRRLYATDVSSTKFKQIYHADPLDSKNDRLDTFQRRHLGPNPKDVDEMLKTVNSNYNDLSDFVNDMVPSKILGMKDGLKFKSSPKGVFNETAMLNHLAQIAEKNNYKVKNYIGKGYYDTILPPVIQRNVLECPEWYTSYTPYQPEISQGRLESLLNFQTVVSDLTGLPVANSSLLDEGTAAGEAMLLSYHSLKSKKIKKSSPNQKLNFIIDKNLHPQTKSVLKTRAKPFNIELLEIDFNELSNKEIEDKLSKELLDNSFGGLVQYPDTNGNIPTTDKLNTISGLLHSSNCLFSVATDLLALTLLEPPSTFGADICLGSSQRFGVPLAYGGPHAAFFSVTEKLNRKIPGRIVGVSKDRLGNTALRLALQTREQHIKRDKATSNICTAQALLANVSANYCVYHGPEGLKNIAKRVYGMTTVLANAISEHSEHKLLNNSWFDTLTIELKEGTTADQFLELALSEFNTNVFAVNNRTVSISFDEKKTIDDLEDMIRLFCNLKKNSSISSSIKDSGILPEFPKELQRKSQFLQNPVFNRYHTETAMLRYLHHLQSRDLSLANSMIPLGSCTMKLNSTFEMMPITWPQFANIHPFQPVDQVQGYKELITAIEEDFSSITGFHSVSLQPNSGAQGEYTGLRVIRSYLEDIGEGHRNLCLIPISAHGTNPASAAMCGLKVIPINCLQNGALDLADLKEKAEKYKDDIAAVMITYPSTYGLYEPDIKEAFDIVHSCGGQVYLDGANMNAQVGLTSPGDLGADVCHLNLHKTFAIPHGGGGPAGAPICVKEHLAPFLPRHDVTDMITEIGSNKSIDSVSSAPYGNALVLPISYAYVNMMGEEGLPFSTVIATLNSNYMMARLKEHYKIMFVNGEDVKHCAHEFIIDLREFKAKGIEAIDVAKRLQDYGFHAPTLAFPVPGTLMVEPTESENREELDRFVDSMISIRKEIDDYIAGKPEGMVIKNAPHPLSDLISSTDWETRGYTREQAAFPLAFLKTSKFWPTVARVDDKFGDTHLICTCPSVEEMAEE

SEQ ID NO: 542 - protein, 474 aa, Yersinia pseudotuberculosis IP 32953
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGDAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 543 - protein, 444 aa, Burkholderia xenovorans LB400
MHDIDDFLKKNRVTEIEAIIPDMAGIARGKIIPRSKFESGESMRLPQAVMIQTVTGDYPEDGTLTGVTDPDMVCVPDPSTIRMIPWAVDPTAQVIHDCVHFDGTPVAISPRRVLRRVLELYKAKGWKPVIAPELEFYLVDMNKDPDLPLQPPIGRTGRPETGRQAYSIEAVNEFDPLFEDIYEYCEVQELEVDTLIHEVGAAQMEINFMHGDPLKLADSVFLFKRTVREAALRHKMYATFMAKPMEGEPGSAMHMHQSLVDEETGHNLFTGADGKPTTLFTSYIAGLQKYTPALMPIFAPYINSYRRLSRFMAAPINVAWGYDNRTVGFRIPHSGPAARRIENRIPGVDCNPYLAIAATLAAGYLGMTQNLEATEPLLSDGYELPYQLPRNLEEGLTLMGACEPIAEVLGEKFVKAYLALKETEYEAFFRVISSWERRHLLLHV

SEQ ID NO: 544 - protein, 978 aa, Burkholderia xenovorans LB400
MKLEHPDRLMNRTPLSLAALEVHDAFAERHIGPDSADQQAMLEALGFASRAALIDAVIPKTIRRTEPLPLGPFAQPKSEAEALATLRELADRNQVFRSYIGQGYYNAHTPTVILRNVLENPAWYTAYTPYQPEISQGRLEALLNFQQMIVDLTGLAISNASLLDEATAAAEAMTLLQRIGKPKSNVFYVADDVLPQTIEVVKTRATPVGIEVKVGPAADAANANAFGVLLQYPGVNGDVRDYRALAEAIHAAGGHVVVAADLLALTVLTPPGEWGADVAVGNTQRFGVPVGFGGPHAAYLAVRDEFKRQMPGRLVGVTVDAQGNPALRLALQTREQHIRREKATSNVCTAQALLAIMASMYAVYHGPHGLKTIALRVNRIAALLAEGAKQLGYTLVNETFFDTLTFETGARTQALHDAALAKRINLRRVSDTQVGLSVDETTTRRDLADLLEVFAQAAGAKIVPQVDALDSTIAASDTASVPPALERTSAYLTHHVFNRHHSETEMLRYLRSLSDKDLALDRSMIPLGSCTMKLNATSEMLPVTWPEFGQIHPFAPAEQTVGYREMIDQLEAMLVAATGYAAVSLQPNAGSQGEYAGLLIIHAYHASRGEAHRNVCLIPASAHGTNPASAHMAGMQVIVVACDAQGNVDIEDLKKKAEQHADKLAAIMITYPSTHGVFEQNVREICEIVHAHGGQVYVDGANMNAMVGLTAPGQFGGDVSHLNLHKTFCIPHGGGGPGVGPVAVGAHLAQFLPNQISSGYERAPNGIGAVSGAPYGSASILPISWMYIAMMGAKNLTAATETAILNANYVAKKLAPHYPVLYSGPGGLVAHECILDLRPIKETSGITVDDVAKRLADYGFHAPTMSFPVPGTLMVEPTESESKEELDRFIEAMIAIREEIRAVEEGRSDREDNPLKHAPHTAAVVIANDWKHAYARETAAYPLPTLIAKKYWPPVGRADNVYGDRNLFCSCVPIADYE

SEQ ID NO: 545 - protein, 726 aa, Thermococcus aggregans
MRRRFGALLLLMFMLNIIASGCLQSPTTQELKLPSGNYPPIYINEKSQNMCPPGKVPVTFRYQPEENVTSVSLRGSFNDWGELPMKNENGTWVRTVCLNPGRYEYKFFVDGEWIKDMSAVDPTADAYVDDGFGGKNAVKIVKGEQGLIIEHDPKNPAYLSIADNRTVIRFKVQPNQIQSAFLVASNGEYKMERQLWWGSGEVWRVEIQEVSPIEYYFKLTTNNGEVLVLNTSKNPFFTFDGINRFPQVEWVSKGIGYQIFPDRFNNGDPSNDALALQTDEFWFNELINERPILSNWSDPISPLHCCHQYFGGDIKGILEKLDYLQELGVTVIYLNPIFLAGSAHGYDVYDHYRLDPQFGSEEDLKILIEEAHKRGIRIIFDFVPNHSGIGHWAFLDVASRGKKSPYWNWYFVQRWPFKLGDGKAYLGWWGLGSLPKLNTANPEVKEYLIGAALHWLDFGFDGIRIDAPQELINAEEFFSELRKAIKEKHPDAYIVGEIWELSPRWVQGNMFDSLMNYALGRDILLAYARGDWNGERTLELLGRYYASYGENVIAMGFNLVSSHDTSRVLTDLGGGNLGDTPKPEAIQRLKLLSTLLYTLPGMPVTFQGDERGLLGDKEHFDSHRYPIQWDTVNEDVLNHYKSLADLRKSVPALTSSKIKFYTSKEGVLAFFRGHDDEVLVIANNVPKDTSIPLPPGKWKQIWPEGEKIFEKEITVPGLEVLVLVKT

SEQ ID NO: 546 - protein, 372 aa, Silicibacter pomeroyi DSS-3
MTCPEQAIEHDDMNVVVDVEKCKFCMDCIPVCPTGSIDNWRVVDTPYSLEDQYGWMDLPPQEDVAGDEAGLEALDDAMAALLAEAHKGAGGKSRAPATASKPTINLYTLGKPAEARVTGNYRLTAESSDSDVRHIILDFGGQPFPVLEGQSIGIIPPGTDEAGNPHLPRLYSVSSPRDGERPNFNNLSLTVKREPHGICSNHVCDLKPGDTVRVTGPFGATFLMPSDPAAHLLMICTGTGSAPFRAFTMRRQRESPKLRNSLTLVFGARRPQELPYFGPLAKVPEQFMAKHFAFSRQDGAPKHYVQDRLRAEADRVGELLADPLTHVYVCGLKAMEQGVEEAFKDIARAQGIDWTGLRDRMRDEGRYHVETY

SEQ ID NO: 547 - protein, 518 aa, Aspergillus oryzae
MLAQIAPLFGALCITFLVLQYLQRLYQQRKRAQSLGCQPAAQGPSGIFGIRSFVRLLNEVRHKRWVEYIAGQYGRYGNTYTQKALGKWMVSTIEPENIKALLATQFNDFGLGTRHREFYPLLGDGIFTLDGPGWSHARGLLRPQFTRDQVADLELMDGHISRMIDLIPQDGSSFDIQRLFFLLTIDSATHFLFGESVGALESSNSASLLGRSSVGSAQGFAEAFGTAQDYLTTRSRAMHFYWMVNPKEFREANQRVHEVVDHYVQLAIQSKNNPDKKSDRYIFAEALAADNDDPKVLRDNMLNILVAGRDTTASLLSSAFFYLSRNQDVWKKLRQTIIDEFGDSQNPKGEITQAKLKDIPYLRYVLNEVLRLLPPVPLNFRVAAKDTSLPVGGGPDGRSPVFIPKGQVVAYSVYAMHRRTDLYGPDSHSFRPERWEENGRRGWDYLPFNGGPRICLGQQYALTEASYTLVKLVQRFDTLECADPELKQPAILSTLTMSHDRGVKVRLSSSVPKCWFNQ

SEQ ID NO: 548 - protein, 372 aa, Idiomarina baltica OS145
MSLHSTEEIIEDIKQGKMVILMDDEDRENEGDLILAADCVTPEAINFMARYGRGLICLTLSEERCKQLNLPLMVDRNNAPYSTAFTVSIEAAEGVTTGISAADRAQTVKAAVARNAQPEDLVMPGHIFPLKAKQGGVLNRAGHTEAGCDLARLAGYEPAAVIVEVLNEDGTMARRADLEKFAEAHDIKVGTIADLIEYRSVREKTIRRVAQCQLPTSFGKFNMITYQDSIDQQVHHALVHGEINAEKVTNVRVHLQDSLHDTLSTERAAKRSWPIAKAMQYIAENDGVLVLIGRQQTPEDIIAQVKEFEAQDQGQHKPTASASNASRNVGVGSQILADLGIHQMHLLSSPKRYSALSGFGLEVVDFIEDKAD

SEQ ID NO: 549 - protein, 231 aa, Arabidopsis thaliana
MAKDGGVSCLRRSEMIGIGIGELESPPLDSDQVHVLAVDDSLVDRIVIERLLRITSCKVTAVDSGWRALEFLGLDDDKAAVEFDRLKVDLIITDYCMPGMTGYELLKKIKESTSFKEVPVVIMSSENVMTRIDRCLEEGAEDFLLKPVKLADVKRLRSYLTRDVKVAAEGNKRKLTTPPPPPPLSATSSMESSDSTVESPLSMVDDEDSLTMSPESATSLVDSPMRSPGLA

SEQ ID NO: 550 - protein, 471 aa, Burkholderia sp. 383
MSKTVADVMQLVKDEDVKFVDFRFTDTRGKEQHVSVPVSAFDEDKFESGHAFDGSSIAGWKGIEASDMLLMPDPNAAFVDPFYEESTLVLTCDVVEPADGKGYERDPRSLAKRAEAYLKSTGIGDTAYFGPEPEFFIFDSVQWSTDMSGCFVKINSEEAPWSSAKEFEGGNTGHRPGTKGGYFPVAPVDTFQDMRSEMCLLLEQLGIPVEVHHHEVAGQGQNEIGTKFSTLVERADWTQWSKYIIHNVAHSYGKTATFMPKPIVGDNGSGMHVHQSIWKDGQNLFAGNGYAGLSEMALFYIGGIIKHARALNAITNPTTNSYKRLVPHFEAPVKLAYSARNRSASIRIPHVSNPKGRRIETRFPDPMANPYLLFSALMMAGLDGIQNKIHPGEAADKNLYDLPPEEDAKIPTVCAGLDQALEALDKDREFLTRGGVFTDGMLDAYLALKEQELAKFRMTTHPIEFEMYYSL

SEQ ID NO: 551 - protein, 526 aa, Yarrowia lipolytica CLIB122
MFQLFSILVLAFTTALVAQLAYNQYDYQRKVKKFGCGQLRVAENGLFGWKGLREVLRINKYKLGPAALKDRFEKYGKTHVFHVGPSPLITTMDPENIKAMLATQFKDFCLIARYKALGPMLGDGIFTLDGHGWTHSRALLRPQFAREQVSRLDSIEHHFQILKKCISKEMSDKRDTQRGFDIQNLFFLMTLDTATEFLFGSSVDSLVDFLDDPSIQTGDHGGIDEAARKGFSNAFNRAQELSSLRTRLHKLYWVIGTLAVREPYHRYNREVKTFVDHYAAKAIKARNEKNTDLLDNDKYIFMYELVKETSNPITLRDQMLNILLAGRDTTASMLSWIYFRLARDPKRYAKLRAAVLADFGPGPENITFESLKKCDYLRYVLNESLRVYPVVPINARTASRDTTLPRGGGPDGSQPIFVPKGQTVSYSVWWTHRDPEFWGQDAEEFIPERWDTKNGSIGRGWEYLPFNGGPRICLGQQFALTEVGYVLSRMVQTYETLESGDTKPLPPLYNHALTLCHQEGVWIKTE

SEQ ID NO: 552 - protein, 518 aa, Xanthobacter autotrophicus Py2
MPTKRQQPLKRQRATKIVATVGPASNSEEKLKALFLAGVDVFRLNFSHGTQENHGEVLARIRRLEKEMNRPIGVIADMQGPKLRIGRFKDGAIAIKAGDILHFDADVDRPGDETRVPIPHPDILAALNVGSTVLCDDGKVRLKVVKKGEGFLEAQVVAGTRLSNNKGFNIPDVVLPLSPLTDKDRLDLEFACEAGVEWIALSFVQRPEDIHEARALIKDRAAVMLKMEKPSAVDYLTELVELSDSIMVARGDLGVEISLAEVPALQKRMIAEARKFGRPVIVATQMLESMITAPVPTRAEVSDVATAVYEGADCVMLSAETAAGQFPVEAVTFMDDIIRHVECDPGYRQALDATQAEWGKTIGDAVTKATYQAAIAVDASALVAFTLSGTTGLRAARERPAIPILGLTPKMETARRLALSYGVHAVHMKEDIHSFGDMVDTAVRTAVEHGLGKPGDRLAITAGVPFAKPGTTNIMRITTIGADSPPSRHDADTPAVRSTKAHESKGQEKKAHGSKVHA

SEQ ID NO: 553 - protein, 314 aa, Rhizobium etli
VMFDGSSIGGWKAINESDMVLMPDTETVHMDPFFAQSTMVILCDILDPVSGEAYNRDPRGTAKKAEAYLKASGIGDTIFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 554 - protein, 403 aa, Pseudomonas syringae pv. phaseolicola 1448A
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAMHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 555 - protein, 314 aa, Rhizobium tropici
VMFDGSSIAGWKAINESDMVLMPDPDTVHMDPFFAQSTMVILCDILDPISGESYNRDPRGTAKKAEAYLKASGIGDTAFFGPEAEFFVFDDVKYKADPYNTGFKLDSSELPSNDDTDYETGNLGHRPRVKGGYFPVPPIDSCQDMRSEMLTVLTEMGVTVEKHHHEVAAAQHELGIKFDTLVRSADGMQIYKYVVHQVANAYGKTATFMPKPIFGDNGSGMHVHQSVWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 556 - protein, 314 aa, Rhizobium tropici
VMFDGSSIAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKSGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 557 - protein, 314 aa, Sinorhizobium terangae
VMFDGSSISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 558 - protein, 314 aa, Sinorhizobium fredii
VMFDGSSIAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 559 - protein, 314 aa, Sinorhizobium medicae
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFP

SEQ ID NO: 560 - protein, 314 aa, Sinorhizobium meliloti
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFP

SEQ ID NO: 561 - protein, 314 aa, Sinorhizobium saheli
VMFDGSSIAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFP

SEQ ID NO: 562 - protein, 314 aa, Rhizobium galegae
VMFDGSSIGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFP

SEQ ID NO: 563 - protein, 314 aa, Bradyrhizobium japonicum
TMFDGSSIAGWKAINESDMCLMPDPVTETIDPFFAETTMVIACDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCVHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFP

SEQ ID NO: 564 - protein, 516 aa, Corynebacterium efficiens YS-314
MRGHDRLLQLASVFYFSRCHRVNQAGRTPTTPTCTIDALTCCFVDHFHPRRGVGACNSPEQVRGLRKLVCMNSQQEFVLSTIEERDIKFVRLWFTDIVGQLKSVVVAPAELESAFEEGIGFDGSAIEGYARISEADTIARPDPSTFQILPKEVETSRLQAARMFCDVTMPDGQPSFSDPRQVLRRQVQLAADEGFICMISPEIEFFLVQSLRTDGRPPVPTDNGGYFDQATFNEAPNFRRHAMLALEEMGIPVEFSHHETAPGQQEIDLRHADALTMADNVMTFRYLIKQVARDQGVAATFMPKPFAEHAGSAIHTHMSLFEGGTNAFHDPDDEFMLSRTARQFIAGILRHAPEFCAVTNQWVNSYKRIVYGNEAPTAATWGMSNRSALVRVPTYRLNKADSRRVEIRIPDSACNPYLAFSVLLGAGLKGIKEGYELEDPAEDDISSLSLRERRAMGYKDLPSSFDHALRLMERSDLVADILGEHVFEYFLRNKWREWREYQAQITPWELRTNLDY

SEQ ID NO: 565 - protein, 484 aa, Rhodobacter sphaeroides 2.4.1
MAPLSDLIHPVLLCGGSGTRLWPLSRKSYPKQFARLTGDESLYQASARRLSGAGFAAPTVVAASDFRFVVIEQLAALKIQPGCVLIEPEARNTAGAIAAAALALEARRPGALMLVAPSDHVIPDADRFRAAVQAAAPAARAGQIVTFGIRPDRPETGYGWLELSTPTADFAPEPQPLRSFVEKPDLATAERLLSGGMHLWNAGIFLFTTTAILEALERHAPEVLAPVRQAVEAAEKDLSFTRLAPGPWADLPDISIDYAVMERAENLTVVPYAGAWSDLGDWQAVWRDAPPQEGGVVLSGPATAIDCHDSLLQATNAAQQLVGIGLTDIIAVAMPDAVLVAHKDRAQEVKRAVAALKAKGVEQAETLPRDYRPWGWYESLVKGPRFQVKRIVVTPGATLSLQSHHHRAEHWIVVEGTAKVTIDNQVTLVTENQSVYIPLGARHRMENPGKVPLTLIEVQTGAYLGEDDIIRYEDVYARGQGARG

SEQ ID NO: 566 - protein, 473 aa, Brassica napus
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 567 - protein, 142 aa, Arabidopsis thaliana
  misc_feature (102)..(103): Xaa can be any naturally occurring amino acid
  misc_feature (105)..(105): Xaa can be any naturally occurring amino acid
  misc_feature (110)..(110): Xaa can be any naturally occurring amino acid
  misc_feature (119)..(119): Xaa can be any naturally occurring amino acid
  misc_feature (123)..(124): Xaa can be any naturally occurring amino acid
  misc_feature (128)..(128): Xaa can be any naturally occurring amino acid
  misc_feature (131)..(131): Xaa can be any naturally occurring amino acid
  unsure (1)..(142): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFEFXXHXFLYRXHGNTSGYYXGRYXXMWEXPLXRMPLKVFEGLI

SEQ ID NO: 568 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 569 - protein, 422 aa, Oryza sativa
MAIGGWQDERYAIQGEKYQGQQYSHIYFTRLHHMRNLLHALVPSWKPHLPVTTVLGLEEGKDCIIVGTLYKHMKLKPSILDEYSKERSAIPLVKPHNFMHPDDHLILEDESGRVTLAGAIPPAAYVTDEDKYVVFVSGLSIGSEKFNPLQFQLLIDHITGHLGDENEQSIASNIVRVVVAGNSVHISPRFFNGQAVASKDQSRIAEPIKELDIMLTQLVASLPVDMMPGSNDPANFSLPQQPLHRCLFAGAATYNTFSSCSNPHQFELDSVRFIGTSGQNIDDLYKYSDAKDKLEFVERTLRWRHLAPTAPNSLGCYPYTDKDPFLVESCPHVYFVGNQDKYETQLLQGLEKQKVRLICIPRFCDSGVAVMVNTSSCMLTIAQFEELGVQHVEFLNKLRCLTMLYLSGVQICRCKIAQQTAE

SEQ ID NO: 570 - protein, 309 aa, Candida albicans SC5314
MYRRAFVGSSRLFSTSSYFRSSYTSAARKTIADIHELYKTGESISMVTSHDFITSQILEQAKVDINLIGDSLANTTLGYDDTNELTLDEFLYHVKSVQRGNSHSLLVADMPFGSFESSIEQATTTAVKLIQKGKIQAVKIEGGNEEIIPTIKKIVSVGIPVMGHVGLTPQKHNSLGGYKLQGRSVDDSVRIFQECLNLQNAGVFAIVLECIPNKLSQYITDKLSIPTIGIGAGPYTSGQVLVISDLLGMKDGHVAKFVQQYNNFFQQGVEGVKQYTKDVKSKKFPNPDTHGYKMKKDVLDEFKEIAKDL

SEQ ID NO: 571 - protein, 145 aa, Zea mays
EVFIKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 572 - protein, 1064 aa, Aspergillus oryzae
MAASWCALRGTRQLALRTRLRSAPSPIALRKATPSSPFRATHRALHTATQQPSRRPVYTSSVADHGDPHPRDLFQPLDTFPRRHIGPSPDAAKEMLATLDPPVASLDEFVKQVLPADILSKKDLKVTDPHAKTNLYRDNVGGGLGETDMLKLLDVYRKQIDVSGKTYIGTGYYGTIVPPVILRNVLENPAWYTSYTPYQPEISQGRLESLLNFQTLTADLTGLPFANASVLDEATAAAEAMTMSFATMPASKQKKPGKAYVVSHLCHPQTIAVMRSRAEGFGINLVIGDILADDFKLVKEQGDNLIGVLAQYPDTEGGIYDFQALSDNIHGAGGTFSVATDLMALTVLKAPGEFGADIAFGNAQRFGVPMGYGGPHAAFFACVDKYKRKVPGRVVGVSKDRLGNRALRLALQTREQHIRREKATSNICTAQALLANMSAMYAVYHGPTGLKSIAQRIMSMTSTLQAKLAALGYNVPIKTNVADGGAIFDTVTVELPTSQEADAIVAAAREQSIFLRRVNSTKVGISLDETSGRDEVKSILQVFATHASKGEVSIDGELGISPLPASLERTSEYLTHPVFNTHHSETEMLRYIRHLESKDLSLAHSMIPLGSCTMKLNATTEMIPISWPEFSQMHPFLPADVAKGYTQMIDDLEQQLADITGMAEVTVQPNSGAQGEFAGLRVIKKYLEAQGESKRNICLIPVSAHGTNPASAAMAGMKVVTIKCDTKTSNLDLEDLKAKCEKHKDELAAVMITYPSTFGVYEPGVKEACEIVHQHGGQVYMDGANMNAQIGLCSPGEIGADVCHLNLHKTFCIPHGGGGPGVGPIGVAEHLRPFLPSHPASEYLQSKRTESSSPPISAAPWGSASILPITFNYINMMGAKGLTHATKITLLNANYILSRLKEHYPILYTNENGRCAHEFILDVRKFKETCGVEAIDIAKRLQDYGFHAPTMSWPVSNTLMIEPTESESKAELDRFCDALISIRQEIAEVESGAQPREGNVLKMAPHTQRDLLSNEWNRPYTRETAAYPLPYLVEKKFWPSVTRVDDAYGDQNLFCTCGPVEETD

SEQ ID NO: 573 - protein, 561 aa, Mesorhizobium sp. BNC1
MDTLQQFLRHTSIAYFSMEIALRPEMRTYSGGLGILAGDCARSSADLDLPLVFVTLVSHEGYLRQEIGSAGEQVDHPDPWRVEDWATQLDFMAAVDIEGRSVWVRPWLYVVSCPLGGRIPVLLLDTRVEQNRPEDRSITDRLYGGDAAYRLKQEIVLGVGGARILEGLGFEIRKFHLNEGHASLLTLHLLAKQTGTDVPLQGRLDKVREACVFTTHTPVEAGHDRFSYGEVARILGHGGLVDPDLLKQLGGKDELNMTLLALNLSRHVNGVAEVHAETTRLIFPGYQVGAVTNGVHVPTWAHPSFAELFQGILSSWAHQPERLTRCEQLPDEAIWNAHQRAKRGLVAAVAKATGQMLDEERPIIAFARRMTGYKRPHLIFTDLERLRELNRHYPFQIVMGGKAHPRDQEGKALIAEIHRHIRELAPELPAAFVPNYDMELARLFVSGADVWLNTPMPPLEASGTSGMKAALNGVLNLSVLDGWWSEGWVEGVTGWAIGEGDRPAKEHASACLDKLERTVLPLFYENRPRWIWMMKQSISKIGSYFNSQRMMRRYGSEVYLS

SEQ ID NO: 574 - protein, 119 aa, Triticum aestivum
  misc_feature (11)..(11): Xaa can be any naturally occurring amino acid
  misc_feature (85)..(85): Xaa can be any naturally occurring amino acid
  unsure (1)..(119): unsure at all Xaa locations
MASATLLKANXLPREAKWGATRQAAAPKPMTVSMVVRARAYAYELEKTAKTIAWSGRGILDMDESNATCGKRLDSIGLENTDANXRQADRTLLVTPPGSGNYISGAILIEETLYQTTVD

SEQ ID NO: 575 - protein, 417 aa, Francisella tularensis subsp. holarctica
MAEYKNYTLNFGPVHPAAHGVLRLILELDGENVVRADPHVGLLHRGTEKLAEFKPYNQSIGYMDRLDYVSMMCNEHAYVMAIEKLLQLEVPERAKYIRVMFAEMTRILNHLLWVAACGIDLGAMTVFLYAFRVREDLFDCYEAVSGARMHAAYFRPGGVARDLPTQMPQYQKTRFTSKRKAKKLNEPRQGSMLDFLDHFVVDFEKSLDEIDTLLTDNRLWKQRTVDIGTVTAERAKELGFTGPMLRGSGVAWDLRKTQPYEVYHKLEFDIPIGANGDCYDRYLVRMAEMRESNKLIKQCVDWLRANPGSVLSDNHKVAPPKRNAMKNNMEELIHHFKLFSEGYCTTEGEVYVGTEHPKGEFGVYIKSDGANKPYRLKMRAPGFAHISAMDELLSGHMLADTPAIISTIDVVFGDVDR

SEQ ID NO: 576 - protein, 278 aa, Polaromonas sp. JS666
MSTPNPGSNEHIAFIGGGNMASAVIGGLLKQGLPAGQIQVVEPFAEQRARLVQQFGVAVSDAPGASLSSAGLVVWAVKPQTFKEAAAQARAHTQAALHLSVAAGIRSDSIAQWLGTERVVRSMPNTPALVGKGMTALFARPAATAADRAAVERVIQTTGEYLWLNDEVQLDAVTALSGSGPAYVFYFLEAMIQAGTDMGLEPEQARKLAVGTFVGASALAHASDEPLEVLRARVTSKGGTTYAALTSMEQAGIKQQFMQAIEAARQRAGELGDEFGAA

SEQ ID NO: 577 - protein, 337 aa, Cryptococcus curvatus
MATKVGINGFGRIGRIVLRNALEHGDIDVVAINDPFIDLDYMVYMFKYDSTHGRFKGKVETKDGKLVIEGKPISVFGERDPAAIPWGKAGADYVVESTGVFTTIEKASLHLKGGAKKVIISAPSADAPMFVCGVNLEAYKPEYEVISNASCTTNCLAPLAKVIHDNFGIVEGLMTTVHATTATQKTVDGPSHKDWRGGRGAAANIIPSSTGAAKAVGKVIPSLNGKLTGMSFRIPTSDVSVVDLVVRLEKGASYDQIKEVIKKASEGELKGILGYTEDEVVSTDFLGSTESSVFDAKAGIPLNDKFVKLISWYDNEYGYSRRVCDLIAYVAKKDKSA

SEQ ID NO: 578 - protein, 248 aa, Ustilago maydis 521
MARTFFVGGNWKMNGSLESTKQLTQTLTQAKLDSNVEVVVSPPALHLLAVQEQLKGSKVAVAAQNAYHKPSGAFTGEVSVTMLKDAGIPWVILGHSERRTLFHESDANVAEKTAAALAENLSVILCIGETLEQREANETVNVVVRQLDAVADHVKDWSKIVVAYEPVWAIGTGKVATSEQAQEVHAAIRKWATEKLGKDTADQLRIIYGGSVAAKNCKELAQRPDIDGFLVGGASLKPEFVDIVNANA

SEQ ID NO: 579 - protein, 385 aa, Geobacillus kaustophilus HTA426
MKHLIQPRVQAIQLSGIRQFFNLVADRPGLVSLTIGQPDFPTPDHVKAAAQEAIAADFTTYTANAGLLELRQAACQFVADKYGLRYTPDEVIATVGASQALDITFRTILEEGTEVLLPAPVYPGYEPLIRLCGAKPVYIDTRPNGFRLSAELIAPYLTEKTRCLVLPYPSNPTGTALSAEELENIASLLKGRPIWIVSDEIYSELVYHGRHHSIAEWLPEQTIVINGLSKSHSMTGWRIGFVFAPAFAVEQMVKVHQYSVSCTSSISQKAAVEALTAGKHDAEAMRAAYAERLEYAYHRLTAMGLPVEKPDGAFYLFPSIAAFGMSSFDFALDVVENAGVALVPGSAFSEYGEGHVRLSYAYSLDVLKEGLDRLERYIQTKRRRP

SEQ ID NO: 580 - protein, 295 aa, Medicago truncatula
MGTEAIRYAVVTGANKGIGYGICKKLASSGVVVVLTARNEERGLEAVERLKNEFDFSDFVVFHQLDVDDPASVASLASFIKTMFGKLDILVNNAGVPGGKLIDGDALLRKRNGAEIDTKEIGYETYELAEKCLKTNFYGVERVTEALVPLLQLSTSPTIVNVSSRAGLLKNISNEWARIVFNDIENLTKEKIDEVLKEFEKDYKEGSLEIKDWPTFASAYTMSKAALNAYTRIMAKKYPHFHINSVCPGFVKTDMNNNIGNLSIDEGVETPLMLALWSNNGPSGCFFNKGEVISF

SEQ ID NO: 581 - protein, 773 aa, Arabidopsis thaliana
MSGFSSGNVNSRVVDILSGVVPLLKLICLTVIGLLLAHPKTQLVPRATFRLLSKLVFALFLPCLIFTELGESITLDNIVQWWFIPVNVLLSAVVGSLIGYLVVLICRPPPEFNRFTIVMTAFGNTGNLLLAIVSSVCHTKTNPFGPNCNSRGVSYVSFAQWVAVILVYTVVYHMMEPPLEYYEVVEEEGVEIEEINVENHDASRPLLVEAEWPGIEDKETEHCKTPFIARVFNSISSFSQTSFPEVDLGGEYGGESSSPRSIQCLAEPRVMRRIRVVAEQTPVKHILQPPTIASLLAIIIGSVPQLKSVVFGYDAPLSFITDSLNIMGSAMVPSVMLVLGGMLSEGPNESTLGLRTTIGISVARLLVLPLVGIGIVMSADKLGLISSADPMFKFVLLLQYSTPSAILLGAIASLRGYAVREASALLFWQHIFALLSLTFYIVIFFKLTVETTVQEKRVNFLECESFNYSFREKINHFGFVEESRSDFMEMSEWKFCAFKSQSKSRTMGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 582 - protein, 287 aa, Medicago truncatula
MQRFNFHKYAVVTGSNKGIGFETVKMLASNGVKVVLTARDEKKGNEAIQKLKQFGLSDQVMFHQLDVTDSASITSLVQFFKTQFGRLDILVNNAGVSGVNPYETVGSTVDWEKLTQTSDMAENCLRTNYYGVKETTDAFLPLLKLSNSSKIVNVSSQAALLKNIPNQWAKRVFDDIENLTEEKIDEVLKEFIKDFKEGSLENKGWPTIMSAYIISKAAMNSYTRILAKKYPNMCINCVCPGFVKTDINKNTGMLPVDQGAASVVRLALLPDDSPSGLFFIREEISNF

SEQ ID NO: 583 - protein, 286 aa, Medicago truncatula
MAEAKLRNAVVTGSNKGIGFETVKMLASNGVKVMLTARDEKKGNEAIQKLKQFGLSDQVMFHQLDVTDPASITSLVEFVKTQFGRLDILVNNAGVSGVNPYETVGSTVDWEKLTQTSDMAENCLRTNYYGVKETTEAFLSLLKLSNSPKIINVSSQAALLQNIPNQWAKRVFDDIENLTEERIDKVLIEFIKDFKEGSLENKGWPTFLSTYIVSKAATNSYTRILAKKYPNMCINCVCPGYVKTDLTKNIGMLSVDQGAASVVRLALLPDGSPSGLFFIREEMSNF

SEQ ID NO: 584 - protein, 139 aa, Triticum aestivum
MKTESPRHLRNPLLALLFLAAAAASAAQIAMAAEPEQQAPAAQEAAVHIVYVDRPEDADPEEFHIRTLAPVLGSEEKARGAVLYHYKHAASGFSAKLTTEQVEDLKKQPGVLQVVPSQTYQLHGHEGGHASTTRTMGLM

SEQ ID NO: 585 - protein, 314 aa, Mesorhizobium tianshanense
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 586 - protein, 264 aa, Photobacterium sp. SKA34
MKKITINDLMKWKQEGRKFASVTAYDASFAQLFEQQEMPVLLVGDSLGMVLQGREDTLPVTVEEIAYHTRSVRAGSPNALLMADMPFMSYATPEQTCENAAKLMRSGANMVKLEGGAWLADTISMLAERAVPVCAHLGLTPQSVNIFGGYKVQGRDIDKADEMVKDAILLKNAGAQIIVLECVPASLAERITKAVEIPVIGIGAGNSTDGQILVMHDMFGISANYMPKFSKNFLAETGDMRAAVTKYIKDVEKGEFPGSQHTFE

SEQ ID NO: 587 - protein, 477 aa, Borrelia burgdorferi B31
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 588 - protein, 445 aa, Burkholderia sp. 383
MQPELSEFLRQHRITEVEAIIPDMAGIARGKIIPRNKFESGESMRLPQAVMVQTVTGDYPEDGTLTGVTDPDMVCVPDPSTICLIPWAVDPTAQVIHDCVHFDGSPVEISPRYVLRRVLDLYKEKGWQPVVAPELEFYLVDMNADPDLPLRPPVGRTGRAETGRQSYSIEAVNEFDSLFEDIYEYCEMQGLDIETLIHEVGAAQMEINFVHGDALSLADQVFLFKRTVREAALRHNMYATFMAKPMQDEPGSAMHIHQSLADARTGRNLFSSEDGAVSPMFHSYLAGLQKYTPALMPIFAPYINSYRRLSRFMAAPINVQWGYDNRTVGFRIPQSGASARRIENRIPGVDCNPYLAFAATLAAGYLGLTQQLAPTEPIASDGYKLPYQLPRNLEEGISLMAACTPLAGILGDKFVKAYLALKDTEYEAFFRVISSWERRHLLLHV

SEQ ID NO: 589 - protein, 101 aa, Zea mays
THRRRGGEEAMGVTKEDVEAAITSALSPSNLHLQLCGASYEIEVVSEKFEGKRLLERHRMVNTALASHMAEIHAVSIKKALTPAQAQPQAQPEPAADKPQA

SEQ ID NO: 590 - protein, 217 aa, Photorhabdus luminescens subsp. laumondii TTO1
MNQTLLSEYGTSSERVEHAINALRDGKGVMVLDNEDRENEGDIIFAAETMTVEQMALTIRYGSGIVCLCLTEERRQQLQLPMMVENNSSPFQTAFTVTIEAAQGVTTGVSAADRITTIRAAIADNAKPSDLNRPGHVFPLRAQPGGVLVRQGHTEAAIDLVSLAGFKPAGVLCELTNDDGSMARTLEVVQFAKLHNMPVVTIEDLVIYRQAIEQKAS

SEQ ID NO: 591 - protein, 457 aa, Leuconostoc mesenteroides subsp. mesenteroides ATCC 8293
MSDSKGDSNLPKRGLQNRHVQLIAIGGTIGTGLFMGAGNSIHFAGPSILLVYLVIGMFMFVVMRAIGELLYADPSQHTFISFITKFLGNRAGFFARWSYWLTVVFMGMAELTAVAKYIQFWLPDLPSWLIQIVMLILLTSINLIAVALYGETEFWFAMIKIVAILSLIVTGIIMALTGFETPVGKVAFSNVWHHFELFPNGVGNFINAFQMVMFAFVGMEFIGMTTAETENPRSVLPKAINQIPWRILFFYLGALFIIMTIYPWQKIPEDQSPFVMVFQLAGVKWAAALINFVVLTSAASALNSVLFSASRNFFALSFQSKAKFLQPFRKTSKTQLPVNAVLVTSLMVAFSALISVIPSITNAFSFVTSASTDLFLMIYVLILFAYMKYRKSDSYMPDGFLVIAPKTLVPLAILFFSFVFITLFFNPESRLPAIGATIWMVVFGCISMKQPKQALNK

SEQ ID NO: 592 - protein, 949 aa, Zea mays
MASACGFGGVDALVDATVPPAIRAPPMRFPGRFDAGFTESQMLDHMRRLASMNRDFKSFIGMGYYGTHVPAVVLRNLMENPAWYTQYTPYQAEIAQGRLESLLNYQTMVADLTGLPMSNASLLDEATAAAEAMAMCSAILRGKKRTFLIASNCHPQTIDVCRTRSDGFGIRVVVADAKDLDYGGGDVCGVLVQYPGTEGEVLDYAEFVRDAHAHGVKVVMATDLLALTALRPPGEIGADIAVGSAQRFGVPMGYGGPHAAFLATSQEYKRLMPGRIIGVSVDSTGRPALRMAMQTREQHIRRDKATSNICTAQALLANMAAMYAVYHGPAGLKAIADRVHGLAGTFAHGLKKLGTVTVQDLPFFDTVRVTCSDARAIAKEAVKNEMNLRVVDANTITVAFDETSTLEDVDKLFKVFNNGKSASFTAESIAPEVSSSIPSSLARESPYLTHPVFNMYHTEHELLRYLHKLQSKDLSLCHSMIPLGSCTMKLNATVEMIPVTFPNFANLHPFAPTDQAAGYHEMFDDLGNLLCTITGFDSFSLQPNAGAAGEYAGLMVIRAYHNSRGDHHRDVCIIPVSAHGTNPASAAMVGMKIVAVGTDAKGNINIEELRKAAEAYKDNLAALMVTYPSTHGVYEEGIDEICKIIHENGGQVYMDGANMNAQVGLTSPGFIGADVCHLNLHKTFCIPHGGGGPGMGPIGVKKHLAPFLPSHPVIPTGGFPLPEKTDPLGTISAAPWGSALILPISYTYIAMMGSQGLTDASKIAILNANYMAKRLEKHYPVLFRGVNGTVAHEFIIDLRAFKTTAGIEPEDVAKRLMDYGFHAPTMSWPVPGTLMIEPTESESKAELDRFCDALISIREEIAEIESGKADVLNNVLKGAPHPPQLLMGDTWSKPYSREYAAFPAAWLRGAKFWPTTGRVDNVYGDRNLICTLQQATQVAEEAAAATATA

SEQ ID NO: 593 - protein, 490 aa, Pseudomonas putida KT2440
MKDLAPSALNKLRRNDLLETRAYIDGRWVTGEGSLDVTDPANDQVIAQVAHCDESWVDLAVEAASRAFDGWRNTLPTQRGAVLRKWAALMRENQEDLAVIMTCEQGKPLSESRGEINYGANFVEWFAAEGERCYGETIPSHLPNSQLVTKLQPIGVTVAITPWNFPSAMITRKAAAALAAGCPMIVKPAPETPLSALALARLAEEAGIPGGVFQVLTGDAPKMSARLLAASAVRAFSFTGSTEVGRILLRQSADTVKKVSLELGGHAPFIVFDDASIAEAVEGCIGAKFATSGQDCLGANRIYVHRNIYGQFVEEFTKATEKLRVGHGLEEGVDIGPMTRVTVANKCREQISNALSLGAKLTCGGIDNHLGSSFVLPTVLADVTDKMDIAFEETFGPVAAILPFDSEDEVVTRANNTEFGLAAYVYTNDLRRACRVSDRLEYGMVALNTPKFTGAPIPFGGWKQSGLGREGSKHGLAEYMELKYVCIGGL

SEQ ID NO: 594 - protein, 417 aa, Streptomyces carzinostaticus
MNSHQLQILFLDLAIILVMARGLGHLASRIRQPPVVGEILAGVLLGPTLFDGVLSETLFPDDVRPVLSGVANLGVALFMFVVGLEIEGNLMKGHGRTTVAAAVGSTAVPFLLGIGLAFALMPGHDPADRGTFVVFIGLAVSVTAFPVLARILAERGLTRTAIGGIALAAAAFVDVVAWAALAAVNASVGAAGDHRLVLLTVPYLAAMLFVVRPLLRRVLAPGDKAAEPGPLKFAVVLVGALLSAAATEAMGMHHIFGAFLFGLMVPRERAQALRADLHDRTTHLTSVLLPVYFVVAGFQVDLGGIGLGGLRELSLILLVAIAGKFGGTYLGARATKLAPRPSATLAALMNTRGLTELVILGVGLQLGLLDDSLYSLMVVMAVVTTVMTGPLLSLAGSGRSGTPADGTAPRERISAAP

SEQ ID NO: 595 - protein, 266 aa, Mycoplasma mycoides subsp. mycoides SC
MKAKKYYGQNFISDLNLINRIVDVLDQNKNQLIIEIGPGKGALTKELVKRFDKVVVIEIDQDMVEILKAKFDHSNLEIIQADVLEIDLKQLISKYDYEKISIISNTPYYITSEILFKTLQISDLLTKAVFMLQKEVALRICSNKNENNYNNLSIACQFYSQRNFEFVVNKKMFYPIPKVDSAIISLTFNDIYKKQINDDKKFIEFVRILFNNKRKTILNNLNNIIQNKNKALEYLNTLNISSNLRPEQLDIDEYIKLFNLVYTSNF

SEQ ID NO: 596 - protein, 130 aa, Kluyveromyces lactis NRRL Y-1140
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTIAQGGVLPNIHQNLLPKKSSKAKASQEL

SEQ ID NO: 597 - protein, 313 aa, Cyanophora paradoxa
NGFGRIGRLVLRAAVEKGTVEVVAVNDPFIFPDAAYAAYMLQYDSTHGAFPGEVGSDGEHLVVNGKKLACFAIRDPAEIPWGSVGVDYVVEASGAFTAADKASLHLTGGAKKVVLSAPGKDVPMFVMGVNHDAHTKDLKVVSNASCTTNCLAPLAKIIDEAFGIEMGLMSTIHALTATQRRWTGRAPKRLARGRGTFQSIVPTSTGAAKAVGNVYPKLNGKLTGMAFRVPVAAGSVVDLTLNLKRATTYEDIKMVVKEASESQQYNGIVGYTEDSVVSIDIVHNSCSSVFDAGAGIMLSPTFVKLVSWYDNEW

SEQ ID NO: 598 - protein, 954 aa, Agrobacterium tumefaciens str. C58
MTTPTEFHFTDYQPYDFANRRHIGPSPSEMAEMLKVVGYKSLDALIDATVPSSIRQKVPLTWGAALTEREALDRLRETANKNQVLTSLIGQGYYGTITPPVIQRNILENPAWYTAYTPYQPEISQGRLEALLNYQTMVCDLTGLDVANASLLDEATAAAEAMAMCQRVAKSKATAFFVDANCHPQTIALIETRAAPLGWKVIIGNPFTDLDPVDVFGAIFQYPGTHGHVSDFTGLISRLHQTGAIAAVAADLLALTLLKSPGEMGADIAIGTSQRFGVPVGYGGPHAAYMSVKDAHKRSMPGRLVGVSVDARGNRAYRLSLQTREQHIRREKATSNICTAQVLLAVMASMYGVFHGPQGIKAIAQQTHQKAVLMAKGLEKLGYTIEPETFFDTITVEVGHMQGVILRSAVAEGVNLRKVGATKIGMSLDERTRPATLEAVWRAFGGNFSISDFEPDYRLPKDLLRTSQYMTHPIFHMNRAESEMTRYIRRLSDRDLALDRSMIPLGSCTMKLNATAEMLPITWPEFSDIHPFVPANQALGYKEMIDDLSEKLCSVTGYDAFSMQPNSGAQGEYAGLLTIRNYHLANGGTHRDVCLIPTSAHGTNPASAQMVGMKVVPVKVRDNGDIDIDDFRLKAEQYAENLSCCMITYPSTHGVFEETVREICEITHKHGGQVYLDGANMNAMVGLARPGDIGSDVSHLNLHKTFCIPHGGGGPGMGPIGVKAHLAPFLPGHPTTDGREGAVSAAPFGSPSILPISWSYCLMMGGEGLTQATKVAILNANYIAERLKGAYDVLYKSETGRVAHECIIDTRPLADSCGVTVDDVAKRLIDCGFHAPTMSWPVAGTLMIEPTESETKAEIDRFCDAMLAIREEARDIEEGRADKNNNPLKNAPHTVEDLVGEWDRPYSREKGCFPPGAFRIDKYWSPVNRIDNVYGDRNLICTCPPMEAYAEAAE

SEQ ID NO: 599 - protein, 527 aa, Rhodococcus sp. RHA1
MITHERKFAISPGPGPHFRPRPVTVSRRPITPATTGAQLALSISCPTRPLERLMSTLEQPPETLQKSLKQRHLTMIAIGGVIGAGLFVGSSALLHTSGPAAFVSYAITGVVIVLVMRMLGEMATTNPSTGSFAGYARKAFGGWAGFTTGWLYWFFWVVAVGAEAVIGGKLLQRWIDLPSWVMAVVLLLAMVATNLRSVRNFGEFEYWFAGIKVAAILLFLGLGAAYVFGLWPSHSADFSNLTDHGGFTPNGWTVILSGVVVAVFSMVGPEIATIAAAESAEPEKAVAKATNSVIARIGFFYIGSVLLLAIIVPWTDVKVGQSPFVDALTHMGIPGGPDIMNAVVLVAVLSCLNSGLYTSSRMLFTLAHKGDAPQSIARLDKHGVPRNSLLLATLVGFACIGLDYLSPDTVFAFLLNASGATILMVYLMIAMSQIKLRGLMTREEVAQLRLKMWLFPYLSILAAGGILAVLVSMFYVESSRSQLSLSVGALIATLIAYRLRRRINPQNPLANNISAPAPGPITKPASK

SEQ ID NO: 600 - protein, 439 aa, Rhodopirellula baltica SH 1
MNSPANSSAARPAAGPKSVAAFQRASALMPGGVNSPARAFGAVGGTPLFIERAEGPYLYDIDGNRYIDYIGSWGPMILGHAHPEVINAITQAAAKGTSYGAPTEAESRLAEQIIEAVPSIEKVRLVNSGTEATMSALRVARGATGRKKVIKFAGNYHGHVDSLLVAAGSAAATLGAPDSPGVTPGAAEDTLVLSYNDVSGLQNAFAQHGDDIAALILEPVVGNMGCVLPTMEFLNAARDLTTKHGSILIFDEVMTGFRVAYGGAQERFGVTPDMTTLGKIVGGGMPLGAYGGRADIMNQVLPAGKVFQAGTLSGNPVAVAAGSATLRLLKENPPYEQLERLADRLADGLDRAATSAGMAHTVAKAGAMLTLFFNPEPVDCWAVADRCDREAFGRYFWGLIDEGIYMPCSQFEALFFSQQHTEAMIDETIAAAEKVLKSL

SEQ ID NO: 601 - protein, 470 aa, Moritella marina
MKKTKIVCTIGPKTESVEKLTELVNAGMNVMRLNFSHGNFAEHSVRIQNIRQVSENLNKKIAVLLDTKGPEIRTIKLENGDDVMLTAGQSFTFTTDINVVGNKDCVAVTYAGFAKDLNPGAIILVDDGLIEMEVVATTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMISNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKAAQQLCLTKGVSSCIVEQIDSTDEFYRKGKELALATGLAKEGDIVVMVSGALVPSGTTNTASVHQL

SEQ ID NO: 602 - protein, 432 aa, Synechococcus sp.
VTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVNDAVPSIEMVRFVNSGTEACMAVLRLMRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 603 - protein, 709 aa, Aspergillus oryzae
MTSLSSDHHTPHHAFLMPPSIAGGRRGSTDYRPSIKKAQGHIPACLVNASVTYCNNDQIYAFGGFDQYTDEVYNHVLRLNLKDLRWELVDNYGDIPGVRMGHTATLHQGTKLIVFGGENEHREYLSDVVILDITTSTWTQPEIRGPIPRGRARHAAVIYDDKLFVLGGVTGDNKILDDLSYLDLKTWTWSRTWRFTARFDHTAWVWGGRLWTFGGLDPGMERTTDIWWLDLKDIQSLGMTTSQGTVDTPATIGRSTHSPDTMFNSPTQQLSGRSGSYAANSGSVQVRNANRRKPIAPGAISCLQFKSGPHVPALFSGTHFQAYASGVLLDLITPSETVRIFDCNLSSLELDSLRWQRLADGQEIFKPGYRWHYCTVDTSGTKAWLLGSSSDAGATPGTADENHMSEVLCIDLERYGLLGNEMTAASPDQGRALLSERSGISPLSGLGADLSAVFDQAPETGSGADFIITANPDDQVDGDEPGEDASSQAQPAFLPPNAATSPPIHVHRIILQLRWPHFKRLYSAQMVEYHSKKMHIPEPYSVVRAFVYYLYTDSISGHPEYCSDIVDVAGMLVMANLYDMPKLRVLCVNRLSRELDVENAAIIWERAGRTNEEWLMRRAAQFCLSNWGRVVRTDGFKSLSRQSLIELCEVVDMEGRVVAGPELEMVGALSAEGFGSGRDPKRSQLALGGTLADDVDDLDGDEMEGMEMS

SEQ ID NO: 604 - protein, 265 aa, Candida glabrata CBS 138
MTSVPVKKALTTLLRDPGNASCADCKSQSHPRWASWSLGVFICIKCAGVHRSLGTHISKVKSVDLDTWKEEHLKELVQMRNNVNANRVYEAKLPDSSKFNGKSLGNDINLLQEFIRQKYERKRWMDSSVDLSRDQPVVSQANSSSSSLVSTMSSSNESTNNTVAVEEKLKPQSTHSSSLLNLQGRKEIVENKRPARPTQQDTPQRNDLKKSILSLYSSANASKSNNNSTMNVSSGMGMTTPFNTTPQNNSSLSIDDDELFKNVWS

SEQ ID NO: 605 - protein, 487 aa, Ralstonia eutropha JMP134
MRRQRKAKIVATLGPASTDIAVIRQLFEAGADVFRLNFSHGTHEDHRARYDAVRQIEAETGRPIAVLADLQGPKLRIGVFAAGKVAVRAGDSFVLDSDPTPGDGTRVHLPHPELFHAAQPGQSLLIDDGKVRLAIESVASGSITTRVVNNGTLSDRKGVNVPDAVIPIPALTEKDRKDLDFALSLGADWIGLSFVQRPSDIVEAREIVGTRAGILSKIEKPAALQQLEEIVRVSDSVMVARGDLGVELPPERVPGVQKRILRVCRQLGKPVVIATQMLESMIDSPVPTRAEASDVASAIYEGADAVMLSAESANGRYPVPAVSMMNRIVTEVERDPLYRNLLDAQHETPLNTRQDAICAALREVTQIIGAVATVTYTSSGATALRAARERPCAPIVSITPNLEIARRLAIAWGIHSTVSPDVKSVDEMVEAATRAALVEGYAAPGDQITIAAGMPFGQGGTTNLLRVAEVGGNAVAGVESVRESATV

SEQ ID NO: 606 - protein, 411 aa, Aspergillus oryzae
MSNQQVGTVFDRVIQEVCDGSQVDFEESGVDQQTLLDLRKSWQKKLSSLGVAHFPWDPPPPQPAPPQPQNQNQILPPSATVPSNAPRPAPAPQTPQQHVPPPQSMPHSMPGTAPPLQVPTPVGAAPNAMGQAPHIKTEPGMNGQTTLPPMSNMIPTNIPNAQSARERAANMLHQRYGAAAANSVSQLQAQSQAAMAMPGQARPQNLPHVPNGQAPHIKQEPGYPPVSQPPMNNTQTDGASDDALSAWKAEVARRREAADRQNGEGDRVLREHLKQRMLQLEGGGLLLPLEERQDSSIAPTHELATDAAVPSDPSASASSSSKVVRAQYDGPGGDDERDEDDEDAINSDLDDPDDLVADDHEAEDAVGQVMLCTYDKVQRVKNKWKCTLKDGILTTGGKEYVFHKGQGEFEW

SEQ ID NO: 607 - protein, 375 aa, Methanococcus maripaludis S2
MYEGEIAIGPVHSTMLEPHRLRLFIEDEIVKDAELTIGVNHRGVERLMEGLPVEKACILCEKICGICSHIHLWSAARLVEIGCNIEIPERANHIRIIVEELERLHSHTLLFGHAFEILGHETMSMRCFMLREPIMQVFFEISGSRVHYSCPIIGGIRPRCNISETQIPHILDKISKYEEGLNKFLERMLNDPMIISRVKDVGVMDRKTAAKFHAVGPTARGSNVKSDMRKWGWVPEYDPYDFDEILFDSGDVFARLAVRFYECLESVKIIRQALDALKDTSDKRIYNPNYELHEFKPINCYTEAQRGEQYYSYGLDDEGLVRQAKIRTPTATNLGAMEDIVKGYHVSDAELIIASCDPCFTCTDRLMVLKEPFKK

SEQ ID NO: 608 - protein, 399 aa, Burkholderia xenovorans LB400
MSSNRGVVYLGQGKVEVQSIDYPKMVDPRGRSIGHGVILKVVSTNICGSDQHMVRGRTTAEVGLVLGHEITGEVIEIGRDVETLKIGDLVSVPFNVACGRCPTCKAQHTGVCLNVNPSRAGGAYGYVDMGGWIGGQAEYVMVPYADFNLLKFPDRAQALSKIRDLTCLSDILPTGYHGAVMAGVKPGATVYIAGAGPVGMAAAASARLLGAACTIVGDMNEERLAHARKMGFQTVDLSKDATLGEQIEQILGKPEVDCAVDCVGFEAHGHGSSGSHEEAPAIVLNSLMEITRAAGAIGIPGLYVTDDPGAADAAARKGSLSIRFGLGWAKSHSFHTGQTPVMKYNQNLMQAILWDRLPIADIVNVTVVSLDQAPDGYRQFDGGAPKKFVIDPHGLLKAA

SEQ ID NO: 609 - protein, 272 aa, Mesorhizobium sp. BNC1
MGDRIRLTILGCGSSPGVPRIIGDWGACDPSNPKNRRLRAAALVERIRPDGRVTRVVIDTGPDFRTQMIAAKATSLDAVVYTHPHADHIHGIDDLRSYVLAQRQLMDIYADEQTLQRLKDAFDYCFETLPGSNYPPIVVPHLIRHEQTFTVSGEGGPLTFTPLPQIHGDIRSLGFRVGNIAYCSDVSDFPPETLPLLQGLEILVLDALQYRPHPSHLSLGEALQWIGRLAPRRAILTHMHTPLDYEAVRQETPDNVDPAYDGMTLEVEALDL

SEQ ID NO: 610 - protein, 359 aa, Arabidopsis thaliana
  misc_feature (123)..(123): Xaa can be any naturally occurring amino acid
  unsure (1)..(359): unsure at all Xaa locations
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGXLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 611 - protein, 273 aa, Buchnera aphidicola str. APS (Acyrthosiphon pisum)
MPKNFKKHLPLKKYGQNFLINKDTIKNIIKIIDPKTTETLVEIGPGLAALTKPMCELLEELIVIEIDQDLLFLLKKRSFYSKLIVFYQNALNFNFLNLFHKKKQLIRIFGNLPYNISTSLIIFLFKQIKVIQDMNFMLQKEVAERLISTPGNKSYGRLSIISQYYCDIKILLNVSPEDFRPIPKVHSVFINLKPHTNSPYFVYNVNILSAITKDAFQNRRKILRHSLKNLFSEKELIKLEINSNLRAENVSVSHYCKLANYLYKKSNNLLKIN

SEQ ID NO: 612 - protein, 370 aa, Prochlorococcus marinus subsp. pastoris str. CCMP1986
MVYSQAKVIAGGLAHIPIVISVFYLIMTFFNKRAIKFEEANKSKKTEAKVVESKSESKSLDAAKVASQKPLKKKHADVPVNIYRPKTPFEGTVTGNYSLLKEGAIGRVNHITFDLKESDPFLNYIEGQSIGIMPEGEDANGKPHKLRLYSIASTRHGDDFEGNTVSLCVRQLQYEKDGETINGVCSSYLCDIKPGAKVKITGPVGKEMLLPDEEDANIVMLATGTGIAPMRAYLRRMFEATEKEKNKWNFKGKAWLFMGAPKSANLLYEEDLQRYLETYPDNFKYTKAISREQQNTKGGRMYIQDRVLESANEIFNMIEDEKTHIYLCGLKGMEPGIDEAMTKAAEEKGLNWSELRPQLKKAGRWHVETY

SEQ ID NO: 613 - protein, 264 aa, Escherichia coli
MKPTTIASLQKCKQDKKRFATITAYDYSFAKLFADEGLNVMLVGDSLGMTVQGHDSTLPVTVEDIAYHTAAVRRGAPNCLLLADLPFMAYATPEQAFENAATVMRAGANMVKIEGGEWLVETVKMLTERAVPVCGHLGLTPQSVNIFGGYKVQGRGDEAGDQLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 614 - protein, 173 aa, Triticum aestivum
MFLRRILSGGGGLAAMRSARAVKETTGIVGLDVVSEARDVLIGLYTRTLKEIEAVPKDEGYRKAVESFTRYRLQICQEEEDWKRIEDRLGCGQVEELIEEAEDELKLIGKMIEWDPWGVPDDYECEVIEDDTPIPKHVPQHRPVALPEEFFKTLDAIKSDPALQGDSPPQVKS

SEQ ID NO: 615 - protein, 329 aa, Aspergillus oryzae
MPSALLIGEITHARKEWEELSSILTLTEFPSGTREDFIRNCKEGQYDDVLVIYRSNTSTKFTGPFDAELLAVLPKSLKYICHNGAGYDNIDVKGCTDKGIAVSSTPVAVNHATADVGIFLMIGALRQAYVPLSALRAGQWQGQTTLGRDPQGKVLGILGMGGIGREMANRAKAFGMKIQYHNRSRLSPELEGDATYVSFDELLASSDVLSLNLALNASTRHIIGEKEFQKMKDGIVIVNTARGALIDEKALVAALDSGKVLSAGLDVYENEPVVEQGLVNNPKVMLLPHIGTMTYETQKDMELLVLNNLRSAVEKGKMITLVPEQKNVF

SEQ ID NO: 616 - protein, 240 aa, Bacillus cereus G9241
MNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 617 - protein, 149 aa, Oryza sativa
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 618 - protein, 553 aa, Photorhabdus luminescens subsp. laumondii TTO1
MDKIIPWWLQGVIYQIYPKSFQDTTGSGTGDLNGITYRLDYLKKLGVDAIWVTPFYLSPQVDNGYDVADYYAIDPAYGSMDDFKRLVDEAHQRDIRIIVDIVFNHTSTQHPWFKQAQDIDSPYRQYYIWRDGVPGTPPNNWLSKFGGNAWAWHEASQQYYLHLFAVEQADLNWEHEPVRAELKKICEFWAGLGVDGFRLDVINLVSKQQDFPESTQGDGRQFYTDGPRIHEFLQEMNREVFQPAGVMTVGEMSSTSLEHCHRYSSLDGEELSMVFAFHHLKVDYPNGEKWVAAPPDFIELKKIFAKWQQGMYERAWNALFWCNHDQPRIVSRFGGEGVWRVPSAKMLAMVLHGMQGTPYIYQGEELGMTNPHFSHIEEYRDIESLNIYQEKIEQGNDKQQILSVLAKKSRDNGRTPMQWDTTANAGFTQGEPWIALNSDYQDVNAENAMQDDDSVFHCYARLIKLRKEYPVLTYGSYEDLLPSHPSLWCYVRRWENQTLLVIANLSVEVQKWSLDASLSDCSWVKLMGNYPENHVPAKDMQLQPYEAVYWLAE

SEQ ID NO: 619 - protein, 412 aa, Nicotiana tabacum
MLKCFYIFKDKSRSRRRGESAPELSNESRRDGNSEGKKVAKSTGSVSSARSIPQMYREKEQNLRVFSLSELKEATRSFNRMLKIGEGGFGSVYKGTIQPPSGRGDPIVVAIKKLNTLGLQGHRQWVAEVQFLGVLEHPNLVKLLGYCATDGERGIQRLLVYEYMQNKSLEDHLFNRAVPVIPWKTRLKIILGAAQGMAYLHEGLEVQVIYRDFKSSNVLLDEDFNPWLSDFGLAREGPAGDRSHVSTAPVGTLGYAAPEYVETGHLSVKSDIWSFGVVLYEILTGRRTLERNLPVMQQKLIDWVKQFPADSRKFSMIIDPRLRNEFSLVAARRIAKLADSCLNKIAKERPKMSEVVQILTQAVQESQETTSLEITGPGPGPSRPTQLASPKQQLKNKTIAETARPMRPIAQA

SEQ ID NO: 620 - protein, 141 aa, Mannheimia succiniciproducens MBEL55E
MSLERTFSIIKPDAVERNLIGKILARFEQSGFEIVAAKMVRLTKAQAEGFYAEHQGKPFFEDLVEYMVSAPILVSVLQKENAVKDYRTLIGATDPAKAKEGTVRKEFAESLRRNSVHGSDSLESAAREIAYFFIDSEICSR

SEQ ID NO: 621 - protein, 1267 aa, Kluyveromyces lactis NRRL Y-1140
MSCAVQAAVVAMKDNSSHGQVPYRANNEHLNRVVQSVTDATKRLSQISTASSNANVNNTKTSKRRNRDTVGPWKLGKTLGKGSSGRVRLAKNMETGKLSAIKIVPKKFVKSNQIKQLPYGIEREIIIMKLISHPNVMGLYEVWENKSELYLVLEYVEGGELFDYLVSKGKLPESEAIHYFKQIVQAVAYCHGFNICHRDLKPENLLLDKKKRSIKIADFGMAALETSDKLLETSCGSPHYASPEIVLGRKYHGSPSDVWSCGIILFALLTGHLPFNDDNVKKLLLKVQSGKYQMPQWLSVEAKDLISRILVVDPNRRITIDQILQHELLTKYDQKSRSKSNSDLNLLNRTPNIVSFSSERDIDETILSNLQILWHGAARKHLVTRLMKPGFTEEKMFYSLLWNYQEKQQKSMQKDLIPVPTLKTSSASSVSPLNISSDVNSVTNTAKKQQQSSNGTVLPASMAPTISAFGQQISSDSSESSTLQAPKIHQKSHFSISSLKNGSSKSPKKTKQGFIASSSSSKLFQPNFGAKSSSQSISKSSSKKSLTPTTPKKRTLQNSASKRSLYSLQSISKRSINLNELLHDELQHEYPPPPLPSISSSEHTSSKLESIVDDYDRSTSVHGATMDNFLGESGQHMKAQQNEKLTQPSKNILAQPKLNNQPQTENRQSVTSMKRKTADNTIATVPVSMTPLKDMTNTFQSKSMYVSSLDPKRNKPKPSLENLLRKVSVPQRIKSRSTIRKLRDSGDWTVSGEAQALFGGKGSSEGENQLQRQKTNPSKLTAPETVLTTSTPMTDIKPDLLRMPSSLINSSMTFKDLSQFIMNIDEDKVPVTQASNPVNTDHEKLSENQTLMIENDSNRFETSSNYDDYNVNTAPAVTTAGDIDIFEDAPDDANESVTTSESMIDQSQLNLKKKAASIDSIDTSHVLTPATDVRVSLYINQMDKLDNLPRETTEQIISKFKLSPIKDIKQKRFSNGDRDLTITGSMISMFKDLDGDESRAEYDDNGLGLLGSALDTRPVENETNEDTNGTTVKRNSTVLVSSINGDNLDLSTEEQKNDDGNHGQGQTRRVTLLFDDGSSESEQVFKPVAAERRQPTLNANSTTTNNVGSKRKSNYINKLPKIKEDEVKPITSMKSSSPVNWFSKLLQRIKTSKPKRTVYEYRTSSIPFDNIHILLMTQFGKNGVDCELKKMERKGDKEYVTYDCNFGGIKRNRPKSKFTVEMRCMNGTETVLSLETRSKRFVNDKDTMASFERFNKDVAGAISAQEE

SEQ ID NO: 622 - protein, 95 aa, Glycine max
  misc_feature (54)..(54): Xaa can be any naturally occurring amino acid
  unsure (1)..(95): unsure at all Xaa locations
ASSKISFPVVTTDNRAGAGMVAPFTGLIFMAGFPTIKTNIDITSIASNGGRVQXFQVWPPAGNKKFETLTFLTDLDNAQLSNEVKYLLKKGWIPC

SEQ ID NO: 623 - protein, 474 aa, Clostridium perfringens SM101
MQKTKMIFTIGPSSDSEEILREFIRIGMNAARLNFSHGDHASHKEKIELIKRLRKEEKSATAILLDIKGPKIRTHNFKNGEAELKNGDEFTFSCGDEILGDNTKCSISYKELYEDIKPGGSILVDDGLLEFKVKEVRRTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFQIAETGDNIMVAAGFPTSITGGTNMLKIEKI

SEQ ID NO: 624 - protein, 319 aa, Shewanella sp. MR-4
MSDNWVRKREILGLLSSEYFVSGEELATQLGISRAAVSKHVDALEDYGVAIYSVKGRGYKLANPISLIDSARLIQSIDNRCFYFDEIPSTNGFMLSHTGELKSGDLCVAEYQSAGRGRRGRTWVSPYGHHLYFSQFWSFPQGMAQAMGLSLVVACSLVEVLKSFGVDNIGVKWPNDIYLNYKKLAGILIEMSGQADSECQLIIGIGVNMAMSEDQGKGIDQPWSDLSALATMPNKTDLVIALQKQLKKDIQLFEREGLAAFKLRWQAADLFYGKEIRLLMGENHVEGICRGVDEQGAVLLETADGTQAYIGGEISLRPR

SEQ ID NO: 625 - protein, 311 aa, Streptomyces coelicolor A3(2)
MSLAPGGALLVVGDVVTDIVARHRGPLAPGTDTAAAVRRLPGGAGANVACWAAHEGCGDVRLLGRVGTDASAWHERELTACGVRPLLVVDSAAPTGTVICLVDTADSAERTFLTDSGAALRIGPGDWSDTLLDGVGRLHLSGYLLFSEPGRALVSVALAAARARGVPVSLDPASAGFLTELGVDRFLGLVEGVDVLLPSRDEACLLTGLPDVADAAAKLSRHVPLVIVKQGAKGALVARSGTVGARVAAVTAAPRDSTGAGDAFTGAFLAALLAGAEAEEATAAGCRAGARAVERVGGRPPRAAGRGPGDG

SEQ ID NO: 626 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALAIHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGAAFSKIGKEFVPVYLHRDYLNLGERAVNVSKEDQNCASFVEVGQPIDYCQLRISDETNERVEDGIIGHIQIKGDNVTQGYYNNPESTEKVLTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLNGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSAMNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAEFTSGDEPLRGGVSSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEDEKRGEAALNINQSKAHIESFLKTVISNASGIRAEELDLNAHFIGLGMDSIMLSQVKKAIADEFGVDIPMDRFFDTLTNLQSVIDYLADTVPSSFASAPPQENVPAQEIQVISEAQSESDRREGHQEHMLEKIIASQNQLIQDTLQAQLNSFNLLRNSGHHSDEKEYAKAQEKSIPSVKQGPPTVTAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGEMQYTSLKQAVRHIVDRHEALRTVIHPDDEVQQVLERMNIDIPVIDFTGHPHEHREPEIQKWLTEDAKRPFHFHEQKPLFRIHVLTSAHNEHLIVLTFHHIIADGWSIAVFVQELESNYAAIVQGKPISPKEADVSFRQYLDWQQAQIDSGHYEEGVRYWRRHFSEPIQQPILPSTASIRYPNGYEGDRCTVRLGRPLSEALRSLSIQMKNSVFVTMLGAFHLFLHQLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQHALQALYAEHQKRVSSIGSNTANFTEAYEAPVNETERQLARIWEELFGLERVGRSDRFLALGGNSLQATLMLSKVQKTFHQKVSIGQFFNHQTVKELARFIQNETKVVHLPMKAAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSKAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPENRIQYMLRDSRAEVVLTQRSLLDQLPYDGDVVLLDEENSYHEEHSNFESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGDTAIRKMIVGGENLSTRLAKSVSEQFKGRLDIFNEYGPTEAVVGCMIYHFDAVRDKREFVPIGTPAANTDIYVADASRNLVPIGVIGEIYISGPGVARGYWNRPDLTEEKFVENPYVPGAKMYKSGDLAKRLKDGNLVYIGRVDEQVKIRGHRIELGEIEAAMHNAEAVQKAAVTVKEEEDGLKQLCAYYVSDKPIAAAQLREQLSSGLPDYMVPSYFVRLEHMPLTSNGKINRKALPAPESSLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMKVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPGPLSIQYKDFAVWQQSDLQKRNIKSQEAYWLDQFHGDIPVLDIPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELIFDSLQLKPYPFHHSVAKFDLTLSIQADRDNYYGLFEYSKKLFKKSRIEVLSNDYLHILSAILEQPSILIEHIGLSGSNEEEENALDSIQLNF

SEQ ID NO: 627 - protein, 637 aa, Sulfolobus tokodaii str. 7
MSSLRLNIIATIYNNIPKEAGITKIEFEGPEIAIYVRSPTILADKTDLLKKIAKDIRKRIVLKADEKARKDKKETIEIIKNIVPKEAEITDIKFDDELGEVLIKAKKPGLVIGKGGTIQNKIFFETFWRPIIVREPPLKSRTYDSILTHIYNETEYRAKMLKIFGERIHRELLFKDRNVRITALGGFQEVGRSAVLVETPESKVLLDVGLNPSVSYGEKLFPKLDIDQVRLEDIDAVVITHAHLDHCGMVPLLFKYGYNGPVYTTAPTRDIMALMQLDALDVAEKEGRPLPYTAKEVRKELLHTITLDYEEVTDIAPDIKLTFYNAGHILGSAMAHLHIGDGTHNIVYTGDFKYARTKLLDKANDEFPRVDTIIMETTYGDHEQENREEAEAKLIEIINRTISRGGRVLIPVLAVGRGQEIMLVLNDAMKKKLIPEVPIYVTGLVEEITAIHNAYPEMLSREVREAILYKDENPFMSEFFHRIEGYREDIAQGEPSIILATSGMLNGGPAVEFFKTMAPDSRNSIIFVSYQAEGTLGRKVSDGAQEIQIIDRDGRIENIQIKMEVTRVEGFSGHSDRRQLLNFLKNLNVKPKNLLLNHGEPGSIESFRRLVEREKEKIGMKGTKVYAPQILDSIRVV

SEQ ID NO: 628 - protein, 92 aa, Zea mays
MAAAAAATKASSWMVAMSVGAVEALKDQGGLCRWNYALRSVHRTAKANVRSGFAAQRDKELAPAAEKGRQEDKAAAEEGLRTVMYLSCWGPN

SEQ ID NO: 629 - protein, 347 aa, Escherichia coli CFT073
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 630 - protein, 71 aa, Arabidopsis thaliana
  misc_feature (62)..(62): Xaa can be any naturally occurring amino acid
  unsure (1)..(71): unsure at all Xaa locations
MASSMLSSGAVDTSPAQATMDLHLTGLKSSAAFPVTRKTNKDIISYSGNGGRVSSMKVWPPXGKKKFGTLF

SEQ ID NO: 631 - protein, 90 aa, Triticum aestivum
MAGAAKASWMVAMSVGAVEALKDQVGLCRWNYALKSIHRAAKARANVRGGVLQGAKQLPASAEAAAEKRRGEKAEEGLRTVMYLSCWGPN

SEQ ID NO: 632 - protein, 168 aa, Zea mays
  misc_feature (31)..(31): Xaa can be any naturally occurring amino acid
  misc_feature (77)..(77): Xaa can be any naturally occurring amino acid
  misc_feature (116)..(116): Xaa can be any naturally occurring amino acid
  misc_feature (129)..(129): Xaa can be any naturally occurring amino acid
  unsure (1)..(168): unsure at all Xaa locations
PGQNPTINQCTPPSLSRRVGYTFVMTKPDRXQRGLIAETMSRAENKGFYLHAPNLVNDQRSIAEKHYTGLAFKPFLXGLGDYIIYRPVAAMVWEGKSFTTTGRKIIGPTNPLASEXPGTIRGDFADDIXRNVIHGIDSIESANKEIALWFPDGPADCAQHQHPWIYDK

SEQ ID NO: 633 - protein, 309 aa, Yarrowia lipolytica CLIB122
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLRPDGSRDIDESGSQPKTWKQMEAVLKTGKTKSIGVSNFSIPYLQELLKEATVVPAVNQVELHPLLPQLELMEFCKKNNIIMTAFSPFGSVGGPLLKNELVLKLADKYETSPGGILTSYHIGNGTVVIPKSVTNSRIIENGKSAVNLSKEDLQALNDLHKTEGIHRTSKPKWGVDLGFPDFDFC

SEQ ID NO: 634 - protein, 600 aa, Buchnera aphidicola str. APS (Acyrthosiphon pisum)
MIDLMPKKNTFLLKKKYKEDSNNSVINNLFDFFGKEFCFHQITLTGFPIIWIDKTLLIEVGKFLYHLSQPYIMLYDLHGVDERIRLHREDLPKADFSVFYHLISIERNSDIMIKVPLLENDLILPTFTGLFPNANWYERETWDMFGIIFNNHPNLTRIIMPSTWKGHPLRKNYSARATEYEPFFLNEQKEDLEMEGLKFKPELWGMKRKNDNVEFMFLNLGPNHPSAHGAFRIVLQLDGENIVDCVPDIGYHHRGAEKMAERQSWHSYIPYTDRIEYLGGCVNELPYVLAVEKLANISVPEKAEVIRVMMSELFRINSHLLYISTFIQDVGCMTPVFFAFTDRQKIYDLIEAITGARMHPAWFRIGGVANDLPQGWNILLKEFLDWMPKRLKYYINTALKNSILIHRSKGIAEYNKKEALQWGVTGAGLRATGLNFDVRKWRPYSGYQNYTFEVPVGSGISDCYSRVMIKVEEIYQSLFILKQCLCNMPSGPFKSEDSLTTPPSKECVLQNIETMITHFLQVSWGPVIPENESFQMIEATKGINSYYLISDGGTMSYRTRIRTPSFPHLQQIPSVIRGSLISDLIVYLGSIDFVMSDVDR

SEQ ID NO: 635 - protein, 291 aa, Rubrivivax gelatinosus PM1
MPDAAVPPLRRAVDAPGAGLAPLRWPLEALWAQLEPLRPGLSVEALVETDSTSTRLLERARNGDSAPCLLVAERQTAGRGRLGRTWFSDTGSSSTADGLGSLTFSLGLTLAPADWSGLSLAVGVALAEALHPRVRLKWPNDLWLTDETAPDTPGRKLGGVLIETVALSDGSRHAVIGVGLNLTRPETRPEFTQAPAGWREIEPLARAPELLARLAPPLFIALGIFEQQGFAAFTARFAARDALAGRPVQTTDPGAEHGVADGVDARGALRVRTERGEECLIRSGEVSVRPC

SEQ ID NO: 636 - protein, 338 aa, Yarrowia lipolytica CLIB122
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKDYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYLLK

SEQ ID NO: 637 - protein, 1080 aa, Frankia sp. EAN1pec
MTIETTAQTPISDTAASAAAADGVREIDPGTASENGGDTQARQAPPRPESAGPARPESTGSARPDTAGPGLPAGFVPRFTDRHVGPDQADRRAMLDLLGLGSLKGLTDAAVPAAIRDTELDLPPAVDETEVLAELRGLAGYNRRVTSMIGLGFHPAVMPGVIQRNVLENPAWYTAYTPYQPEISQGRLEALLNFQTVITDLTGLAVAGASLLDEPTAAAEAMQIAHRAARGRRSTFVIDADTLPQTIAVVRTRAEALGITVLVADLRDGLTGRPSPAPGERPAAGPAAPAQPAAPSAPSEVPSVVPSDVLGDAFGVLLSYPGAGGEVRDLRGVIAQARERDIVVTVAADLLALTLVRSPGALGADIAVGSTQRFGLPLSFGGPHAGYLAVRSGLERTLPGRLVGVSVDAAGNPAYRLTLQTREQHIRREKATSNICTAQVLPAVLASMYAVYHGPEGLAGIAARVHGHAVSLAAGLRAGGVEIVHDGFFDTVLARVPGRAAQVVADALAHGVNLRLVDGDHVGVSCNETTVAADLRAVWSAFGVGGADGPAAAVGPAAGPALPAALIRTGEEPYLAHPVFHAHRSETAMLRYLRRLADVDFALDRGMIPLGSCTMKLNATTEMAAVTWPDFADIHPFAPLDQAAGYVSMIRDLEEWLARITGYAGVSVQPNAGSQGELAGLLAIRAYHRDHAAAGNPVRDVCLIPSSAHGTNAASAAMAGMRVVVVACDAEGNVDLDDLTAKAAAHAPALAALMVTYPSTHGVYEEGIARACAVVHDAGGLVYVDGANLNALVGLSKPGRFGADVSHLNLHKTFCIPHGGGGPGVGPVAVGAKLLPYLPNHPLRPEAGPETGVGPISGAPWGSAGILMIPWAYIRLMGAEGLREATSVAVLNANYVARRLAPHYPVLYTGRNGLVAHECILDLRPLTKETGVTVDDVAKRLIDYGFHAPTMSFPVAGTLMVEPTESEDLGEIDRFCDAMIAIRAEAAKVGAGEWPREDNPLRNAPHTAEMVTGDEWAHPYPRSVAAYPVASLRAAKYWPPVRRIDGAYGDRNLVCTCPPVEAFDATAEPVRVPLPAATPA

SEQ ID NO: 638 - protein, 84 aa, Triticum aestivum
MGFLICACLLQLLFLGSSPAAAQSPSPARALDAMLQGYAYRAFVRPHTGIVYNGTVPADLAGVAVSGLRLRSGSLRRTGFSDYP

SEQ ID NO: 639 - protein, 305 aa, Helianthus annuus
MPSQSDLDRQIEHLMDCKPLPEEVRTLCDQARTILVEEWNVQPVKCPVTVCGDIHGQFHDLLELFRIGGSAPDTNYLFMGDYVDRGYYSVETVTLLVALKVRYRDRITILRGNHESRQITQVYGFFDECLRKYGNANVWKHFTDLFDYLPLTALIESQIFCLHGGLSPSLDTLDNIRALDRIQEVPHEGPMCDLLWSDPDDRCGWGISPRGAGYTFGQDIAAQFNHTNGLSLISRAHQLVMEGYNWSQENNVVTIFSAPNYCYRCGNMAAILEVGENMDQNFLQFDPAPRQVEPDVARRTPDYFL

SEQ ID NO: 640 - protein, 307 aa, Cryptococcus neoformans var. neoformans B-3501A
MASIVSVSHGHSPQLILHSPSPPRTRSSSPSSEQSQAHRTSTAPPTPSPLTHHRSAEAAKYIKRYKHIEAAVDAFYNNEPAPRADPAQERKLGEIWEKFKDPSDPKLIKIDGTMELCEELDIDPGTDAVLFCLAADLGSKATGEWEKAPFVAGIASYPGNIDSLPKLKAYLPTLRKKLVSDPEYFKKVYNHAFQLARGGPQSLTRSLPLDTAIDLWTLFFPPAFNHSPSALSHLPDNSPPQFTQPEFDLWIEFMQQKNKAVSKDTWALLVDFARGIDKDFKEYDEDGAWPSMIDDFVEYVREQKRGQ

SEQ ID NO: 641 - protein, 572 aa, Wolbachia endosymbiont of Drosophila simulans
MHSGSQHLFDIIILLSAAVFIVIAFWKMNISPVLGYFVAGAVIGSRGFNLIHSAGAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTEPLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAAETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHGNIVIRLPDLSNVEVYRDLGASKIIPETSEIGLQLGGAALSLSGISESGVTSLKSRFRKGNYSMLKDLGSDKDE

SEQ ID NO: 642 - protein, 231 aa, Synechococcus sp. RS9917
MKQAVAAAAVDAIQDGMVLGLGSGSTAALMIQGLGAKLAAGELRDIVGVTTSFQGEVLAAELGIPLRSLNAVERIDLAIDGADEVDPAFQLIKGGGACHVQEKLVAARAERFIVVVDATKLVDRLNLGFLLPVEVLPGAWRQVQARLASLGGAAELRMATRKAGPVVTDQGNLVLDVRFGEGIADPRALEQTINNIPGVLENGLFVDLADEVLVGEVTDGVAGVRRLERQG

SEQ ID NO: 643 - protein, 603 aa, Solanum tuberosum
MNSKEEGAYRLFSEPSPRYYDEKKVFQKSNLFHMLPKGIPVPPSGPSRRHNGDATVAPIQWMKPCNMSSLKGVQLTFQQLPKELKRPFQLDKYQLPSIRRRFDKANFFVLQNMGLGGDGEKGESWDVEKSKGKKKKEVTEEETGCWTKLWFIGSCISSRSKVDSSISGISTHCDKSTYVLTSCIALAESKSTNTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQVLSIWQAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSDVVEALKPLPNLKDMASSSYYFQTMQADRVGSSPSTKNGVRTQGSFSRNGQQHPRSLSIPNGSHASPYHQQFPQNSPKPNGKT

SEQ ID NO: 644 - protein, 474 aa, Triticum aestivum
  misc_feature (207)..(207): Xaa can be any naturally occurring amino acid
  misc_feature (255)..(255): Xaa can be any naturally occurring amino acid
  unsure (1)..(474): unsure at all Xaa locations
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATXLGLPDSPGVPKGATVGTLTAPYNDAEAVKKLFEDYKGARAAVFLEPVXVGNAGFIPPQPASLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFGRFHRGMLEEGVYLAPSQFEAGFTSLAHTTLDIEKTVEAAEKVLRRI

SEQ ID NO: 645 - protein, 671 aa, Hypocrea jecorina
MARADQPQDKTKTEQRIGAYTVVRTLGEGSFGKVRLAIHNGTGQKVALKIITRKKLISRDMAGRVEREIEYLQLLRHPHIIKLYTVIKTPSEIIMVLEYAGGELFDYIVQNGRMKEAEARRFFQQMICAVEYCHRHKIVHRDLKPENLLLDENLNVKIADFGLSNIMTDGNFLKTSCGSPNYAAPEVIGGKLYAGSEVDVWSCGVILYVLLVGRLPFDDEHIPSLFAKIARGTYSMPQWMPPGAAALIKGMLVVNPVQRMTIDEIRADPWFNTDLPAYLQPPVEEFFNTGVDPNKAIKKSDIAPNAPEKVQEKLHNEVTEKISKTMGYGKDDVEEALQSDEPSAIKDAYMIVRENKLMLANNPDAGLTGDEGSPMMSISSTRSAISPGGASPRPYVTKIGILPSSLPAYHKDYMEREKNGTGHDPVTPAITINDELPVTRTEVEKEEAARRLNPHSRSALRLDESSKRPQGMTPITAPVKKPKPVRWQFGIRSRNAPWEALLCIHKALNKLGASHLRDEGYDEAQRRGVEDATSRDSSFANGAPLERDPNGHDKDPTKRYKLPADPWHIQVRWPSTSMQAGADRRDELGSKAGSPDSFVYTRGDAASRKDFVALHMDIQIYEMEQGVYLVDFKCSGYETQDGRLLEEKEVTSPFPFLDRAAKLIMQLAEAD

SEQ ID NO: 646 - protein, 334 aa, Escherichia coli CFT073
MEYMTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 647 - protein, 464 aa, Salmonella enterica subsp. enterica serovar Typhi
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAVFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLMLSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 648 - protein, 496 aa, Anaplasma phagocytophilum HZ
MSGSNVVLCILDGWGNGSGGRYDAIHAAYTPFWDTAVSCCPMSSLSASGTDVGLPSGQVGNSEVGHISIGCGRIVLQDLLRINLEINEVHKNPKLLDFVRDIQAKGGVCHMIGLLSDGGVHSLQAHMETIIEVITGFGIKVFIHVILDGRDVPPRSAEKYIGMLNAKIEHLNAEIATVAGRYYAMDRDNRLDRTCKAYDAIAYATGPRSGSAMEALEKSYNSGVTDEFMVPTVIGDYDGMGAEDGVLFTNFRNDRVLQLLGMLLHRFPEVSNVLGMRQYSEKMRIASLFPPREIHRSLGEVISERGLKQLRIAETEKFAHVTFFFNGGREEPFTGEDRIIIPSPDVSTYDLKPEMSAVEITDSLVERINSQQYALTVVNYANADMVGHTGNMEAAKKAVTTVDSCLQRVFYAAVNAGAVMLITADHGNAEKMFDVQNDSPFTAHTSSMVPFVVCNADGDISLSDGRLCDVAPTVLDLMNIPQPSDMTGCSLITRNS

SEQ ID NO: 649 - protein, 187 aa, Oryza sativa (japonica cultivar-group)
MAMVAMVVAAMAVAAVARGDMSADRTECADQLVGLAPCLQYVQGEAKAPAPDCCGGLRQVLGKSPKCLCVLVKDKDDPNLGIKINATLALALPSACGATHANVSHCPQLLHIPPNSKDAAIFSPGGDKGSPAAPAKDNSTTTTDSRAVQAANGGSRSSAATAGAALTALLAGYFLLLLPEFSAPSSF

SEQ ID NO: 650 - protein, 429 aa, Bacillus thuringiensis serovar konkukian str. 97-27
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 651 - protein, 488 aa, Ralstonia metallidurans CH34
MRRQRKAKIVATLGPASTDIAVIRQLFDAGADVFRLNFSHGTHEDHRARYDAVRQVEAETGRPIAILADLQGPKLRIGTFAAGKVAVSAGDTFVLDSDPTPGDAKRVYLPHPELFKAANAGQSLLIDDGKVRLNIESVASGSITTRVANNGTLSDRKGVNVPDAVIPIPALTEKDRKDLAFALELGADWIALSFVQRPSDILEARELIGTRAGVLSKIEKPAALQQLEEIVRVSDAVMVARGDLGVELPPERVPGVQKRILRICRQLGKPIVIATQMLESMIDSPVPTRAEASDVASAIYDGADAVMLSAESANGRHPVAAVSIMNRIITEVENDPLYRNMIDAQHEAPLSTRQDAICAALREVTQIIGAKATVTYTSSGATALRAARERPCAPIVSITPNLEIARRLAITWGVHSTVSPDVQSVDEMVEAAARAALVEGYAAPGDQITIAAGMPFGQGGTTNLLRVAEVGTEVAGLDIGKVPAAEAV

SEQ ID NO: 652 - protein, 400 aa, Rhodospirillum rubrum ATCC 11170
MSIVAERLSAIKPSPTLAVTTKAAELKAAGRDIIGLGAGEPDFDTPDHIKQAAIAAIERGETKYTAVPGTAALRKAICAKLKRENDLEYTIEEISVGCGGKQTIYNALMATLNPGEEVIIPAPYWVSYPDIALLAGGVPVFVPSGPEVGFKLQPADLERAITPKTKWLILNSPSNPTGVAYSAADLKALAEVLLKHPHVWVMTDDMYEHLVYDGFKFATIAQVEPKLKDRTLTLNGVSKSFAMTGWRVGYAAGPVAVIKAINKIQSQSTTHTSSISQAAALAALEGPMDFLIERNAIFKERRDLVVRMINDCPGLSVGTPEGAFYVYPSCAGVIGKTTPEGKLLETDSDFVAALLESEGVAAVQGVAFGLSPYFRISYATATATLEDACQRIRRFCESLR

SEQ ID NO: 653 - protein, 470 aa, Frankia sp. EAN1pec
MTPEPDHTRADGTRADHTQADDTPEHPGLATLLGDVDEVIVAVPDLQGRLVGTGLSPEYFREEVLGGDGLGACAYLHAVDVEMETGPGYAYDPWEGGFGDLRLVPDLSTLGHAPWHPESAIVIADAVWPDGTPVDVAPRTVLRRQLDRLAALGLRALAGTELEFLVFEEAYRKAAGRDYARLTPASSYNVDYALAGTERMDDLVRSIRRAMAAAGAPVESARAEVHPGQYEIVFRYDEALRTCDRHALYKTTAKKIAGTAGRALTFMAKYDQGEGNSCHVHLSLRAADGGFVLSAGAEEGMSELMRWFVAGQLACMAELTLLYAPTVNSYKRLAPGGFAPTGISWGLDNRTCAIRVVGRGRSLRIEHRVPGGDANPYLAIAGMLAAGLHGIENRLPLPPPRAGNVFAAPDVPRLPASLRDAARAWRESATARAAFGERVVDHLAHAADVELAGYERTVTDWERRRGFERY

SEQ ID NO: 654 - protein, 419 aa, Gonyaulax polyedra
FLAPLCLAAVVLGAWQLLPTSFVAPSPRLRGVTSESAQVSTAAPLERSNASQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVSCASCTTNGLAPAVKAVNDAFGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVRPDKAHGEG

SEQ ID NO: 655 - protein, 358 aa, Streptomyces avermitilis MA-4680
MRAAVLHEIGQDKLEVLDDVESVGFGPGRVRIRVRATGLCHSDLSAMSGVLPQPAPFVPGHEGAGEIVEVGEGVSHLKPGDRVVVCWLPACGVCPACKRGQSQLCLAGFMNAGTPNFRRPGGDVFGFAGTGTFAEEVVVDAGSAVPIPDDVPFDIAALIGCGVTTGLGAALNTADVAAGSSVAVIGCGGVGISAVQGARLKGAAEIVAVDPVASRRESALRFGATQAVSPDELAAAKQAVTGGEGFDYVFEVVGRSATARTAYENTRRGGTLVVVGAGALDDFLQLNMFELFFDEKRILPSMYGGGDVLRSYERTIALWRAGRIDLEGLITHRVPLAEINEALDQMRTGTALRTCIEI

SEQ ID NO: 656 - protein, 429 aa, Gonyaulax polyedra
MARGSFLAPLCLAAVVLGVWQLLPISFVAPSPRLRGVTSESAQVATAAPLERSHGSQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVFCASCTTNGLAPAVKAVNDALGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVDLIKHMAKVDAAAA

SEQ ID NO: 657 - protein, 255 aa, Candidatus Pelagibacter ubique HTCC1002
MKLGFIGTGKITSAVITGICSSSISYNKIIISHRNKSTSSTLKKKFKKITISKDNQEIINSCDWIFLSVTPTVGEKIIKNLKFRSNQTIISFISTITLAQLKKAIKVKAKIIRAIPLPPISLKKGPVPICPPNKKVKDFFNKIGTTVEIKNEKSSINFWSTSGMMAPFYELLRVMTDWLVKRGVKRNNAQKYITSLFLALSEDAVANSKKDLKYLVKESQTPKGLNEQGVKELTKAGFYKSLEKTLNSIHKRLNK

SEQ ID NO: 658 - protein, 599 aa, Physcomitrella patens
MALRIENPYYKLLDTDEEIVEDFELMSRNARETQLELLRKILERNANVEYLQRQGLNGRTDEASFKACVPVSTYANIEADVDRIADGDTSPICCVDPPTSFALSSGTTGGKCKLIPRTDALLAQAMKAGQIGSVYRRRAFPRKHEGPPVVMSFQYAGRQFDTKSGLKAGTGTTNFYRSAAFKNAKSAPFSATSPVDIVLGYDVPQQMYCHLLCGLYRCQEVEQMSAIFAYMIVEPFRLLERVWRDICKDIREGTVNERVSDPELRSSVLKVLSPNPELADLIERECAKGWSGIIERLFPNINYIMSIFSGSMLPYVAPMRQYAGSVPLMNADYGASEAWIGINLDPRCPAEDASFTIIPNFAYFEFIPVNRDSAGYDSVEGDEIVGLTDVKVGQEYEIVLTTVGGLYRYRLGDIVKVTGFFNSTPKVAFVCRKGVVLSVNTDKTDEEELRLVVGKASLLLKESNMELADYSSYTDQDSQPGHYVIFWELRSHEHLDMDLLSECCKVLDQSFNNPYMRGRAARTIGPLELAIVKEGAFARLMEQFVRKNGVGASQYKVSRCFKNPATLKHFRDETIATLRSPDFPPELLAAWRPSTKIVG

SEQ ID NO: 659 - protein, 342 aa, Gonyaulax polyedra
MPPTMGINGFGRIGRLVFRAALANPDIEVKAVNDPFMDVKYMVYQLKYDSVHKRFPGTISTKEVDGKEFLVVDGKDVQVFHEKDPASIPWGAAGANYICESTGVFTAQEKAELHIKGDAKKVIISAPPKDAVPIYVVGVNHEDYKTDRHSWSNASCTTNCLAPLTKVVHEKFGLLEGLMTTVHAMTATQLTVDGPSVAARTGVVAAAHPQNIIPSSTGAAKAVGKVIPAVNGKLTGMAFRVPTPDVSVVDLTCRIEKAAKYDDIVAAIKEAAAGPMSGVLDWTDEEVVSTDFVSCKSSSIFDVGAGISLNDNFVKLVSWYDNEWGYSNRLVDLAIYMAKKDG

SEQ ID NO: 660 - protein, 544 aa, Aspergillus nidulans FGSC A4
MVKLGKTSKRTPVRLRHKIEKASAAKQRKQRKLAKKNPEWRSKIKKDPGIPNLFPHKEKMLQEIEERRRMKAEEQARIREEARARRIAAKQGGDATAESTNPIPVDLEGDDILDDEMDEDMGDDANPMAALLASARARAAEYEGSESDEDQDQMDEDDEMEGMSEDDEVADEDGVPALVAAGKETSRRAFDKVFKKVVEAADVILYVLDARDPEGTRSKEVEREIMAADGGQKRLILILNKIDLVPPPVLKNWLIHLRRYFPTLPLKASNGAGNAHSFDHKQLSIKGTSETLFRALKTYAQNKGLKRAISVGVIGYPNVGKSSVINALTARMNKGSSNACPTGAEAGVTTNLREVKLDSKLKLIDSPGIVFPNTSEKKGKKKQDDQARLILLNAIPPKHIEDPIPAVNLLLKRLSSSEGLLQKLLQVYGIPTLYSGTSTTDRTNDFLIQVARKRGRLGKRGVPNLEAAAMTVINDWRDGRIQGWATPPVLKVVDTTADGATGDANNSAAAPGVDTRQVVSEWAAEFKIEGLWGDGNAEDEAMEE

SEQ ID NO: 661 - protein, 454 aa, Haemophilus influenzae
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQSECEEFIKRFKQSVVDALKVVRS

SEQ ID NO: 662 - protein, 177 aa, Triticum aestivum
ECVKKVLFTKHMKIIHQDAKLHAQRVAAIKRTKGTAAARNQASEKQKAFFRDPENRLKRSIAMKGVKFYCSKCGQEGHRSFYCPTVREISARVQFRCRLCGEKGHNSRTCGNPKSENEHQRQPRHCSLCGEKGHNRRNCPESPEAEVGASGHITKKVNRHNSGVYSCSFCKDRGHHT

SEQ ID NO: 663 - protein, 284 aa, Agrobacterium tumefaciens str. C58
MLFQDDKGVGVAIYRRRFTVLGCASSPGVPRINGDWGACDPQNPRNRRTRAAFMVEQIGPDGGKTTVVIDTGPDFREQMIAAKVQAVDAVLYTHAHADHLHGIDDLRIYFALQKSRIPIWADPVTMARIRDGFAYCLETPAGSNYPPIVRPQLIADINDPVIIDGAGGPIPFKVHMQQHGDVHSLGFRIGDVAYCTDVSDFPAESLPKLTGLDVLVIDALQYRYHPSHLSLEQALGWIEALAPKRAILTHMHIPLDYDTVMRETPDHVEPAYDQMRFEVEIEAP

SEQ ID NO: 664 - protein, 440 aa, Synechococcus elongatus PCC 6301
MGVERDMDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDADGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 665 - protein, 348 aa, Zea mays
LEGRASAAAKKKSSRETLLTLTEGDMMRKLRELLQKSDNRVCADCGAPDPKWASANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHKDNTVSLSASFSSEAGMVEFIGILKVKVIRGTKLAVRDLMSSDPYIVLTLGQQKAKTSVSKRNLNPVWNEELKLSVPQQYGPLKLDPTQQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 666 - protein, 393 aa, Mycobacterium avium subsp. paratuberculosis K-10
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMAARIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 667 - protein, 314 aa, Oryza sativa (japonica cultivar-group)
MEPMSVDGGGGCGGLDTQIEQLMQCRPLAEQEVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 668 - protein, 275 aa, Hordeum vulgare subsp. vulgare
MAAAPPAPAPAFRLGFVGAGNLAESIARGVAASGVLPASAVRTAPHRRPERAAAFASLGATILASNAQVVDDSDVIVISVKPQIVKQVLVELKPLLSEEKLLVSIAAGIKMKDLQDWSGQRRIIRVMPNTPSAVGQAASVMCLGETATENDENRVKSLFSAIGKLAAEEKFDPVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 669 - protein, 249 aa, Xylella fastidiosa 9a5c
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRASEMVANQGKAK

SEQ ID NO: 670 - protein, 479 aa, Helicobacter hepaticus ATCC 51449
MSRVSIDKQAVAEFFRFCDENEVEFIDFRFSDIKGVWHHLSFSRNAINEESFEGIPFDGSSIPAWQPVDKSDMMLIPEPVRYFIDPFTADTTAVVFCDIWDIYNNKPYEKCPRSIVKRAMKYLKESGIGDIAYYGPENEFFVFDSIKIKDSVNCQYYEIDSEEGEWNRAREFEGGVNMGHRPGTKGGYFPVPPVDSMVDLRAEIVKVLNQVGLETFVLHHEVAQGQNEIGVKFGDMLEAADNVQKLKYVVKMVAHLNGKTATFMPKPLYGDNGSGMHVHISIWKDGHNLFAGEAYQGLSEMALHFLGGVLKHARALAAFTNPSTNSYKRLIPGFEAPSILTYSAQNRSASIRIPYNSGEKAKRMEFRFPDSSANPYLAFASLLLAGIDGIKNKIDPGAPMEINLFELTLDEIREKGIKQLPHTLRHAIEEMLVDKAYLKEGGVFSEEFIQTYKAYKFETEIWPWEARPHPFEFLTTYSC

SEQ ID NO: 671 - protein, 506 aa, Oryza sativa (indica cultivar-group)
MDSRPLLPNEEEEEALPGVSDFRGRPVYRATSGGWRSALFVAVLELAGSFAYFGVSANLITYLTGPMGQSNASAAAAVNAWSGAACMLPLLGAFLADSFLGRYPSILLACTLYLLGYGMLTVVASKSQVGILYVSLYLVALAQGFDKPCGLALGAEQFDPEHPRESASRSSLFNWWYFSMATGITVSIATVSYIQENVSWGVGFAIPFAVVSCAFLLFLLATPTYRLSSAAASPLLSLRHYKQSSEEARRMLRLLPIWATCLAYGVAYAQIMTLFNKQGRTLDRHIGHAGLELPPAALQTLGPVTIMVSVPIYDRAVVPMLRRMTGNPRGLTTLQRTGTGMALSLAAVAVAAAVEGRRLETVREQRPAMSWAWLVPQYVAMGVADVLAVVGMQEFFHGEMPEGMRSLGLALYYSVMGIGGFISSALISALDGITRRDGGDGWFADDLNRGHLDYFYWLLAGVSAAELAMFLCFARSYAYRNANKGPLLLVVPSNTPVSPCTNHHHA

SEQ ID NO: 672 - protein, 350 aa, Oryza sativa (japonica cultivar-group)
MGSIGGDEAAVLRAEESASGGVDVWSDAVSSHDPDHLLVMVHGILGSNADWQYAANEFVKQLPDDVIVHCSEKNINTLTLEGVDVMGERLADEVIDVIIRKPELTKISFLAHSVGGLAARYAIAKLYRHPSDTSKSETKGTIGGLEAMNFITVATPHLGSRGNNQVPLLFGSIAMENFASRVVHWIFRRTGKHLFLTDDDEGEPPLLQRMAEDYGDLYFISALHAFRRRVAYANADCDHIVGWRTSSIRRKTELPKWEESISEKYPHIVHEEYSEELGDETCQNSATVCDSDILEEKMVTGLRRVSWEKVDVSFHTSMQRFAAHSIIQVKYQFMNEGADVIQHIIDHFQV

SEQ ID NO: 673 - protein, 423 aa, Synechococcus sp. WH 5701
MSLRTYHDPLHGAIRLERSQPAEGLAMELIDTAPFQRLRRIRQLGPAFLTFHGAESSRFTHSLGVLHLARLALHQLERQAPELAQDQGVLYAAALLHDVGHAPLSHSGEEMYGLRHETWSARLVREHPALREALERHAPGSADAVADLLERGHHRQPALASLVSGQLDCDRLDYLLRDSHSTGTRYGQLDLERILGALTVAPDGSLALHPKGLMAVEHYLVVRSLMYRSLYNHRLNVVCNWLLTRTIQLARRLGPEGGVDADAVMAKWLWRPESLDLETYLANDDLRTGYHLMRWREAGPADLQELCGRLLDRRLLRARDVSHLDAGGRLELLALAQRLSEAAGLKPSLCCALQQRQNRGYDPYKGGLRLWDGESLAALEEHSPLVASLVKPMELAWLIHPPEVSEPLRERARALGSSRRGAA

SEQ ID NO: 674 - protein, 1064 aa, Ralstonia metallidurans CH34
MSTATPAAALEPIPRDPGWPIFGNLFQITPGEVGQHLLARSRHHDGIFELDFAGKRVPFVSSVALASELCDATRFRKIIGPPLSYLRDMAGDGLFTAHSDEPNWGCAHRILMPAFSQRAMKAYFDVMLRVANRLVDKWDRQGPDADIAVADDMTRLTLDTIALAGFGYDFASFASDELDPFVMAMVGALGEAMQKLTRLPIQDRFMGRAHRQAAEDIAYMRNLVDDVIRQRRVSPTSGMDLLNLMLEARDPETDRRLDDANIRNQVITFLIAGHETTSGLLTFALYELLRNPGVLAQAYAEVDTVLPGDALPVYADLARMPVLDRVLKETLRLWPTAPAFAVAPFDDVVLGGRYRLRKDRRISVVLTALHRDPKVWANPERFDIDRFLPENEAKLPAHAYMPFGQGERACIGRQFALTEAKLALALMLRNFAFQDPHDYQFRLKETLTIKPDQFVLRVRRRRPHERFVTRQASQAVADAAQTDVRGHGQAMTVLCASSLGTARELAEQIHAGAIAAGFDAKLADLDDAVGVLPTSGLVVVVAATYNGRAPDSARKFEAMLDADDASGYRANGMRLALLGCGNSQWATYQAFPRRVFDFFITAGAVPLLPRGEADGNGDFDQAAERWLAQLWQALQADGAGTGGLGVDVQVRSMAAIRAETLPAGTQAFTVLSNDELVGDPSGLWDFSIEAPRTSTRDIRLQLPPGITYRTGDHIAVWPQNDAQLVSELCERLDLDPDAQATISAPHGMGRGLPIDQALPVRQLLTHFIELQDVVSRQTLRALAQATRCPFTKQSIEQLASDDAEHGYATKVVARRLGILDVLVEHPAIALTLQELLACTVPMRPRLYSIASSPLVSPDVATLLVGTVCAPALSGRGQFRGVASTWLQHLPPGARVSASIRTPNPPFAPDPDPAAPMLLIGPGTGIAPFRGFLEERALRKMAGNAVTPAQLYFGCRHPQHDWLYREDIERWAGQGVVEVHPAYSVVPDAPRYVQDLLWQRREQVWAQVRDGATIYVCGDGRRMAPAVRQTLIEIGMAQGGMTDKAASDWFGGLVAQGRYRQDVFN

SEQ ID NO: 675 - protein, 269 aa, Mycoplasma gallisepticum R
MMINKINKFFKNNEFSPSKQRGQNFLIDQNIINNVVEAVSKINPSKVLEIGPGLGAISEQLIKRFADNYYAIELDKKLFHHLNERLLKDHILHADALEIDWKSIFDNLGDNPTMVGNLPYNISSKLIKKFILSTYRCAIIMVQKEMGLRLLAKINSKDYSAFSALCQYSLSVSKIIEINETAFIPQPKVRSTLLFLEKKDIAFNEGYEKFLKLIFLSRRKTILNNLKNNYDPKLIIQSLVSLGFKKTSRAQELSPTQLFSLYESLSKLC

SEQ ID NO: 676 - protein, 156 aa, Triticum aestivum
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKEPKSPKKATKSPKKATKA

SEQ ID NO: 677 - protein, 706 aa, Zea mays
MATRRLTPDCFPSLLAGVLAAFLHAALHAPLAVAQERQPPWLLCSPPPDSGIAGNYTENSPYQGNINLISATLPKNTSSSPVLYAKDRVGSVPDIVYAHALCRGDANASACESCVATAFKGAQQGCPLVKDVLAFYDLCQLRFSNRNFFLDNDNFITAYYLQGSKLAAGTGTGTPMGAFDAAVLLLVNATANYAAGNSSRRFGTGEMGLGDDNRTRIYALAQCTPDTAPDICQTYLQPIVNQLPVSFSSVSGGGIFGTWCSFRYELYPFFSGSPLLQLPTFVGTTPAPAPAPPPPATSQDKSRNKTGIVLAILMPSIAALLGINMVLFWIRRRRSAEQRPLQSYSTPRPGIQGADMLILDLSTLRVATDDFAESKMLGKGGFGMVYKGVLPDGQEIAVKRLCQSSRQGIGELKSELVLVAKLHHKNLVRLIGVCLQEQEKILVYEYMPNRSLDTILFDSERNRELDWGKRFKIITGIAKGLQYLHEDSQLKVVHRDLKASNVLLDLDYVPKISDFGLAKIFGGDESKCVTHRVAGTYGYMAPEYAMRGLYSIKSDVFSFGVLVLEIVTGRRNGGLYNSDQDVDLLNLVWEHWDRGNVIELIDPSLSDHHHHPPIEQMLKCLHIGLLCVQRKPAARPMMSWVSVMLCSSTVRLPSLSRPALCVQEVVTATDDDSSSGASALLCAAESSVMTTIMSCNDASITELLPR

SEQ ID NO: 678 - protein, 119 aa, Synechococcus sp. RS9917
MNLQPGPRVERPWGWYEDLLEGPGYKLKRLWIRDGQRLSLQRHQHRSENWTVAAGRGELFCEGHWHPATPGATLHIPCGAIHRARAGQGDLLIIEVQHGTDLRESDIERLEDDFGRVIG

SEQ ID NO: 679 - protein, 648 aa, Zea mays
MAPHLLAVAVAVAAIIATVSLLAPGAAAYPWPVCGTSNDFEPNSTYQANLNLLAAMLPNNVSASPVLYATAVVGAVPEQVWGMGLCRGDANASSCLACLTQAFQDLPNDCSYNKDAAIYYDPCTLHYSDVHTLADDDTGPTTMSYNINNNANVTSDPARFERLLAALVNATAEHAASNSTRRFATGEADADFDRQFPKVYALAQCTPDQTPAQCRKCLAGLISQSLDGFQNNIGGRVLWVNCTWRYETSPFFNGPAMVRLASSSSPPAAAAAGGGERKYSVFIVVLAVVLPTLAALNLVFCFCFWRRPAPQAKQSQPMYSTEAEDVETVDSMMIDVSALRAATGNFDESNKLGEGGFGAVYKGVLPDGDEIAVKRLSKSSTQGVEELKNELALVARLRHRNLVRLVGVCLEQQERLLVYEFVPNRSLDLVLFGTDTREPLSWEQRYRIINGIARGLQYLHEDSQLKVVHRDLKASNILLDVEMNPKISDFGLARIFGRDQTQAVTSRVVGTYGYLAPEYLMRGNYSVKSDAFSFGVMVLEIVTGRKNNGSSHKSGDLLTTVWEHWEAGTVAELVDPSLGGSFPEGDVLRCIHIGLLCVQGDPAARPVMSSVVTMLGTDTVTLQAPSKPGFFARKSGTSTTVSADDGSI

SEQ ID NO: 680 - protein, 787 aa, Clostridium perfringens SM101
MNKEQIKRGIERYLKVKYGKSSIKDAKDFEIFNALSLTLLEGIVDDWNHTEELYEKEKNAYYFSAEYLMGRALGNNLISLGLYNEVKEVLDELGFDLNRIEEIEEDAGLGNGGLGRLAACFMDSGASLEVPLKGYGIRYNNGLFSQYFEDGFQKEDVDSWLKYGEPWSIRKEDEFVTVDFEDMTVKAIPYDTPIIGYASKNINTLRLWKCEPVKEFDFKLFNEQKYDEALELKNRAEDISRVLYPNDSNRDGKLLRLRQQYFLVSASLKDIIRKHKEVFGNVTEDFAKMHAVQLNDTHPVLAIPELIRLLVDEEGFTFEEAYNVASKTFAYTNHTILAEALEKWDVDLIEELFPRILEIIEKIDAEFIVSLEEKGYSEEEIEEFRIVNDGKVRMANLAIHVGFAINGVAKLHTDILKNIELKNWYELYPEKFQNKTNGITPRRWLRLCNQELSALITELLGSEDWVKNLDLLKGLEKYKDDEEVLKRFMDIKHTKKEQLAAYIKEHEGVELDPDSIFDIQIKRLHEYKRQLLNTLYILDLYYRLKENPDMDIPKVTFIYGAKAFPGYKRAKSIVKLTNEVAKLINNDESIKGKIKVVFVENYRVSYAEKLFPAADVSKQISTAGKEASGTGNMKFMLNGAPTFGTNDGANVEIVRESGVDNNFIFGLEVEEIEELKGKYNPVDYYESDADLKRVLDSLVDGTFDDGGNGDFEDLYNSLLEEGDQYFLLADFKAFKDTEDKVFEAYKDKLGWAKKAFENTCNAGMFSSDRTIQEYCDDIWGIKKCTNK

SEQ ID NO: 681 - protein, 575 aa, Arabidopsis thaliana
MLEKVETFDMNRVIDEFDEMTRNAHQVQKQTLKEILLKNQSAIYLQNCGLNGNATDPEEAFKSMVPLVTDVELEPYIKRMVDGDTSPILTGHPVPAISLSSGTSQGRPKFIPFTDELMENTLQLFRTAFAFRNRDFPIDDNGKALQFIFSSKQYISTGGVPVGTATTNVYRNPNFKAGMKSITSPSCSPDEVIFSPDVHQALYCHLLSGILFRDQVQYVFAVFAHGLVHAFRTFEQVWEEIVTDIKDGVLSNRITVPSVRTAMSKLLTPNPELAETIRTKCMSLSNWYGLIPALFPNAKYVYGIMTGSMEPYVPKLRHYAGDLPLVSHDYGSSEGWIAANVTPRLSPEEATFAVIPNLGYFEFLPVSETGEGEEKPVGLTQVKIGEEYEVVITNYAGLYRYRLGDVVKVIGFYNNTPQLKFICRRNLILSINIDKNTERDLQLSVESAAKRLSEEKIEVIDFSSYIDVSTDPGHNAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 682 - protein, 404 aa, Clostridium tetani
MNKKIIILGTLDTKGEEFKFIKDIIEKEGLETIVIDVGVVGEAKLRPNIDKKEVAIVGGSSIEDLIKKKDRGYAMEVMMKGSAAIVKRLSKEEGISGIISLGGSGGTSIASYAMRALEVGIPKVMVSTLASGDTRPYVGEKDITMIYSVVDISGINTLSSKILSNAAYALIGMVKGKAPELKGEKPLIGATMFGVTTKGVNIAKEYLENNGYEVLVFHATGAGGRAMEDLIRSGYIKGVLDMTTTEWCDEVVGGVLNAGPNRLEAASDMGIPQVVAPGALDMVNFGPIETVPEEFKKRNLYKHNATVTLMRTTKEENIEIGKVIGEKLNRAKKDTALFIPLKGVSAIDAEGEVFYGYEEDKALFNTLKETVNKDKVQIVEMNNNINDEEFAIAMAKKLINMMEK

SEQ ID NO: 683 - protein, 689 aa, Arabidopsis thaliana
  misc_feature (376)..(376): Xaa can be any naturally occurring amino acid
  misc_feature (396)..(396): Xaa can be any naturally occurring amino acid
  unsure (1)..(689): unsure at all Xaa locations
MASCDDDFSLLGDDQSNPNQHHHHHQVLHHTPYAPRRFNPKPSNQILLPHHQRNGDEDDENDVVVEASSAFHGHGVNPFTADENSNPYDDNNAAVDEDEDEDLGANRSRIGGVRVEKRQSQEELSDGGTTNGGEITPYGSFKRPRTSSSSAGEYKKDREEWSDAAIACLLDAYSDKFTQLNRGNLRGRDWEEVASSVSDRCEKLSKSVEQCKNKIDNLKKRYKLERHKMSSGGTAASHWPWFKKMEDIVGNSLALKGASDEDRSGSSMGNTVKPARRYPLVTYNPGVQINNVKSKATSNPRWRRVVLKISGAALACTGPNNIDPKVINLIAREVAMACRLGVEVAIVVGSRNFFCGSTWVTATGLDRTTAYHISMXASVMNSALLQSSLEKLGCRXTVPTAISVKGVGEPYNRQRATRHLDKGRVVIFGGIGATLGNPLLSSDASAALRAIDITVNAEAVVKGTNVDGVYDCHSQDSNVTFEHISFQDLASRGLTSMDTMALNFCEENSIPVVVFNFLEAGNITKALCGEQVGTLIDRSGRGAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKSGDDVAVELVKGEVEVAKEAPAGVARVEVDPRLVGR

SEQ ID NO: 684 - protein, 156 aa, Triticum aestivum
  misc_feature (76)..(76): Xaa can be any naturally occurring amino acid
  misc_feature (81)..(81): Xaa can be any naturally occurring amino acid
  misc_feature (84)..(84): Xaa can be any naturally occurring amino acid
  misc_feature (94)..(94): Xaa can be any naturally occurring amino acid
  misc_feature (105)..(105): Xaa can be any naturally occurring amino acid
  misc_feature (108)..(108): Xaa can be any naturally occurring amino acid
  misc_feature (112)..(112): Xaa can be any naturally occurring amino acid
  misc_feature (121)..(121): Xaa can be any naturally occurring amino acid
  misc_feature (126)..(126): Xaa can be any naturally occurring amino acid
  unsure (1)..(156): unsure at all Xaa locations
LEGTLLKPNMVTPGSDSKKVAPEVIAEYTVRTLQRTVPAAVPAIVFLSGGQSEEEATLNLNAMNKLQTKKPWNLSXSFGRXLQXSNLKAWSGKXENEEKGKAAFXVKXKANXKATSGTKKXNANLXEGASEEPQVKDYKLLIDLPSWLLALGSRLQ

SEQ ID NO: 685 - protein, 478 aa, Francisella tularensis subsp. holarctica
MRRTKILATLGPASESREALTEMIKAGVNAVRCNFSHGSAEDHRKRVDLIRQIAKEQDTHVGILADLQGPKIRLSKFKNGSVEIKKGQKFTLDADLGINDGDENTVGIDYKELIQDVKKGDILLVDDGKIVLEVDSVKGNKAVTKVVVGGKVSNNKGINKKGGGLTAPALTEKDKEDIKIAAMLQVDFLAVSFVRDGKDMEYARQLVHEAGWRPAMVAKIERAEAVLEDNLKSIVDASDLVMVARGDLAVEIGDENVPTIQKLIINTARRNEKGSITATQMMESMIENSSPTRAEASDVANAVFDGTDAVMLSAETAVGKYPVETVSAMSRICKSAEKSKYTHISKKQKIADCDRIDHAVSVAAVKIANDIGAKGLIVLTEGGNTSRWMSRINTDLPIYALSRNATTLGAMTLFRGVVPIYFDSTRMSKLYVNRSACMELESRNLAKDGDIFVLTSGDSMGVHGSTNKIKVIIAGQVR

SEQ ID NO: 686 - protein, 458 aa, Aeropyrum pernix K1
MRGPVKIVATVGPSSSSASILAQMLSLGVDVARINASHGGVEQWNSMLESLRRAEEAVGKRVGVAVDLEGPRVRTGNSEPVKLEKGDLVTLGFMEGDVPVDARQFFETIDEGDIVLLDDGKIILQVESVEGFRVKARVLEGGVLGPRKGVVVRGKEPDLPPLSAKDRRALEFFADKGVSHVYVSFARSAEHVEKVRTVVRRLGLRQARIFAKIEGPSGVSRIGEIAEASDGVIIARGDLGMHYSLEELPEIQELIVWEARKRYKTVVLATEFLSSMIEKPVPTRSEVVDIYQAVLQTADALMLTGETAIGKYPVKSVQWMAKISSRAYKKLATSPPERPRPTSTPYKLALGLVELAESLDSPLVVYSKTGRFAERLASFKPLKTFYVGVPSREVERVVRHLWGAEPIVVGDYPYEAGLAKTYEKLRRENIIHGDETVVEAAWSSERGIYIIRVRNLEF

SEQ ID NO: 687 - protein, 598 aa, Myxococcus xanthus
MSFLQQALVFLAAVVLADPLSRRLGLGSVLGYLAGGAVIGPWGLKLISDVEHIFHVAELGVVVLLLFVSLELQTSRLWALRRSVFGLGGAQVLFTGALLASVGLLCSLTWGAAIVTGFGLSLSSTAFALQLLVERNRLTTPYGQLAFGILLFQDLAVVPLLALLPLLGDGGAPSPGTVWLLLLKDVGVLLAEVLSGRYLVRPAFRAVAATHRQELFTATALLLVVATASVINAVGLSMGLAASLAGVLLADSEYRHELEADLAPFKGLLMGLFFISVGMTVNLSLILQKPLLVFGLVLGLVALKGAVLYGLGRMALGRREPALDLAVVISQGGEFAFVLFSLATAQHVMERSLSELLVVVVGLSMAVLYAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFVRARNRVHAYELLDMGIERVMRETFLDRLEMGAGVLQELGLTYSESRRAQERRMMEHDERLLRETGRFHRDEQKLVGLGDKDRKELERLFEKEEGRNPTEPREPPPA

SEQ ID NO: 688 - protein, 334 aa, Aspergillus oryzae
MTAKVGINGFGRIGRIVFRNSFSHENTEVVMVNDPFIEVQYAAYMLKYDSTHGNFEYDVHIDGDSIVVNGKKVKFYAEKDPAKIPWKDAGAEYIIESTGVFTTVEKASAHLQGGAKKVIISAPSADAPMYVMGVNEKTYAGADVVSNASCTTNCLAPLTKVLHERFGVVEGLMTAVHAYTATQKLVDAPSKKDWRGGRAAAQNLIPSSTGAAKAVGKVIPELQGKVTGMSIRVPTSNVSVVDLTCRLEKGASYEEIITAIKEAAQGELKGILDYTEDDVVSSDMKGNPHSSIVDIKAGISLNPNFLKIVSWYDNEWGYSRRVLDLTAYIASVGK

SEQ ID NO: 689 - protein, 331 aa, Thiobacillus denitrificans ATCC 25259
MHTRLHKDLFPILRRLGDGRFHSGEGLAQEFGLSRSTVFNVLAQAQEMGLTIHAVRGRGYQVPRPVEWLDRRALERALGARAARYSLHLLDDVESTNACVMSAALGGAPDGTLYCAEHQANGRGRRGRRWHSVLGGGLTFSLLCRFETGLQSLAGLSLAAGLAVARAVNRHSRHPARLKWPNDVLVDHRKLAGILVEVQGDMHGPAFAVIGIGINVRLDAAQRDAVDQALIDLAEIGVTVGRNRLLADCLLELDTVLAQFRQQGFAGLREAWLALDAYAGRCVTLSLPDARSVNGVASGVDETGAFLLQAPNASVAPYSGGEISLRLDARR

SEQ ID NO: 690 - protein, 410 aa, Haemophilus influenzae R2846
MTNKVSLDKSKIKFVLFEGVHQSALDTLHAAGYTNIDYYKKALDGDELKEAIKDAHFIGLRSRTHLTAEMIEAAPKLIAVGCFCIGTNQVDLNAAKVRGIPVFNAPFSNTRSVAELVLGEILLLMRNVPQANAEVHRGVWNKSATGSHEVRGKKLGIIGYGHIGSQLSIIAESLGMDVYFYDIENKLPLGNAKQLRGLQELLSSCDVVSLHVPELPSTKNLMNAERIAQLKQGAILINAARGTVVDIDALAQALKDGKLQGAAIDVFPVEPASINEEFISPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 691 - protein, 240 aa, Paracoccus denitrificans
VLARTDSTNAEALKLAPGLSGSAWVLAREQFAGRGRRGREWVMPAGNFAGTLVLRPQGGALAAAQLSFVAALALYDALGLACGPAARLAIKWPNDVLLNGGKVAGILLESSGSGPGVQAVAVGIGVNLAGAPDAGAVEPGATPPVSVQGETGHAVDPEEFLDLLAPAFARWQAQLDTYGFAPIRNAWLARAARLGEPIIARTGTAESHGIFEGIDDSGALILRGPAGRQVIPAAEVFFGG

SEQ ID NO: 692 - protein, 148 aa, Medicago truncatula
MASKRITKELKDLQKDPPVSCSAGPVGEDLFHWQATIMGPADSPYAGGVFLVTIHFPPDYPFKPPKVSFRTKVFHPNINSNGSICLDILKEQWSPALTVSKVLLSICSLLTDPNPDDPLVPDIAHMYKTDKAKYETTARSWTQKYAMN

SEQ ID NO: 693 - protein, 149 aa, Methanosarcina mazei
MEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 694 - protein, 209 aa, Triticum aestivum
  misc_feature (92)..(92): Xaa can be any naturally occurring amino acid
  misc_feature (108)..(108): Xaa can be any naturally occurring amino acid
  misc_feature (116)..(116): Xaa can be any naturally occurring amino acid
  misc_feature (156)..(156): Xaa can be any naturally occurring amino acid
  unsure (1)..(209): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXTMWKLPMFGCTDATQVINEVEEVKKEYLTRIPHIGFDNMXQVQCVSSSPNGLQGSGRLNSNHTGILSAMRLEPMLWFPPLPLVSRKVHVSHMK

SEQ ID NO: 695 - protein, 440 aa, Listeria innocua
MSYLTEKLIEEKVFKDPVHGYVHVSDKLIWDLIATKEFQRLRRIHQLGTTSLTFHGAEHSRFNHSLGVYEIVRQIIDVTFAKEPQLDSEERMVALCAALLHDLGHGPFSHAFEKVFGTDHEEYTQAIIIGNTEVSEVLSRVSDDFPLKVASIIKKNYPNQTLVKLISSQIDADRMDYLLRDAYYTGVSYGKFDLERILRVLRPSPDGNGVIVKYSGMHAVEDYIMSRYQMYQQVYFHPVSRSGEVLLWKILERAKKLYCAGYDFKVSPIQVLPFFVNEVSLKDYIVLDDIVLMYYFSIWQEETDPILSDLCSRFLNRRLLRYLNYNPKEDAELYAELKGLLEKADIDPSYYLVVDSSSDLPYDYYLPGVGGGKEPIKLLMGNGELRELSTESPVVEAIGRERRTDIKLYYPLDFIESGRVEPEIAERMISLIHAHSLKEK

SEQ ID NO: 696 - protein, 393 aa, Magnetococcus sp. MC-1
MPLVTKRGHPLSTIKRSPKPAPLSRPTAPFTNPCSTACVMSPWDAIDVKQTFWTQPATLEIKNMAKIDVFGIGNALVDQVYAVEESFLTQIGEEKGRMSLVDPQRQAELSRALASTPALRACGGSAANSLIALTQLGGSAFHACRVAEDETGHFFAQDLTANGVQHQLHTLPAGSSGSCMVFITPDAERTMCTFLGASADLQPEDVPDAILTTAQWCYVEGYLVTAPNTLAAALKGLQQARANGVKTALSFSDVNMVKFFRDGFSQMLGESGVDLIFCNAEEALAFAETDDMAQATAALKKQSRTFVITLGAEGALLWDGQQEIQVAGQPAKAIDTNGAGDMFAGAFFYGITQGWDFTKAAQLACRCCAVLVTHAGARLPKSRTQEILAQFVP

SEQ ID NO: 697 - protein, 373 aa, Magnaporthe grisea 70-15
MHPPAATTALARSCASVASTLVRGRAINLPRTQQPCRTLSSIAVSPARPSNHPDQVSTAASQKPQQQQQCRHSSHSPMGAPIANQRKKVTLGTLRSLYKKGEPITVMTAHDFPSAHVADAAGMDIILVGDSLAMVALGMEDTSEVVLDEMLLHCRSVARATKSAFTIGDLPMGSYEVSPEQALQTAIRFVKEGRVQGIKIEGGREMAPTIRKITGAGIPVLGHIGLTPQRQHSLGGFRVQGKTSAAAQSLLQDALAVQEAGCFATVVEAVPAEVSALLTKKLSIPTIGIGAGNGCSGQVLVQIDMTGNFPPGRFLPKFVKKYGDVWGESMRAIEAYRDEVKSRAYPGPEHTYPMPSEELAAFKAVIEGEKSLE

SEQ ID NO: 698 - protein, 92 aa, Zea mays
  misc_feature (18)..(18): Xaa can be any naturally occurring amino acid
  misc_feature (37)..(37): Xaa can be any naturally occurring amino acid
  misc_feature (81)..(81): Xaa can be any naturally occurring amino acid
  unsure (1)..(92): unsure at all Xaa locations
KGLVQYIILGNVVLMVWXGEVINVDCPQDLWGQQGLXAAPGTIGWDYSVEVARNVIHGTDSLEIGNKEIALLCSLEGVAQXKSNLHPWIFKA

SEQ ID NO: 699 - protein, 1030 aa, Candida glabrata CBS 138
MNNDPNNGTQTSNTGKPNKKPNPQSASIMQTIFRNIGTPSFKLSQIPQQYLQNLTPQQLQMIQNRHQQLLYARMQQQQAQNSQASTPQEQVSAANKISTQRKPASNAPSPAVQEIQQNHAFQQSNSTPTAFHNSPPNSSTGSVNPNTGGVPPTLPPQIAQLPLASQQQVLQTLKQQAIAKNNPAVVAAITAAEQHVKNLLEQQDQQNTGSKSQTKMTANKQGSRVVNQKMTTAANYVPESPGITNQIPPMALPQNIPPPQIDMRKYELPSFQTINYDPPETKLPNPSYWSSRNPTTDILLYEQITQRDKANVSAQHREVNGYDPFSIYGFSNKEYVSKLWHTLKYYQDLKTTRMKSITNTSQNIPTASIWGNGYSGYGNGITNTTTKVVPFHPIAGRNFYSPDKIKLYKQAMSEDAENLVPVRLEFDLERDKFFLRDTLLWNRNESVVDINEFVEDMVADYQFDTSIKRHAIDMISQSIKEQVQEYQPNPFIEEHLSRIGGDDMRITIKLDIVVGQTQLIDQFEWDLSNPDNSPEEFAECMCRELELPGEFVSAIAHSIREQVHMYHKSLIMLGYGFDGGIVEDDDIRSRILPVVTVDDVYRPPADCKVFTPNILQISPAELERLDKDKDRDTRRKRRQGRFSRRGNTNIGGMSMSSTNANASAANNSSVGGEATLPDIADIPRTFRTPIPSTILPGGVDLGPSVFSYNLETSVEYQSRGPPPEPVMPPCYVVDHIPGKSMLVSIKLPQKTAAPLAVEQHGQHFGGDSTNTDVPIKKEDDNISAEAAPSMQNISNPSQTIQAASEVPEDKREQDIDAITPIVESQTEEKKEEPETATENSEKIEDKETMDKVVEAESGEKQVVSEQELNSHIDEKLDGEKPPVDSTDIKKVGESEQVNGTPPLEVNTTQKEAKSPSDEVPQSIESGMKSPEEENKEGSSNDNRLESENINTSNENDNADTEVAGKDNEETEVAGKDNKETEVAGKDNEETEATRMGSEESGNQYDDNQTHNETTEKPDTDNTDGQEKTQL

SEQ ID NO: 700 - protein, 546 aa, Synechococcus elongatus PCC 6301
MIGRICGSSIPVARWLTMPKVLVSDPIDQVGLDILSQVAQVDVKTGLSPSELAQIIGEYDALMLRSGTRVTAEVIEAGQKLRIIGRAGVGVDNVDVPAATRRGIVVVNSPEGNTIAAAEHTLAMMLSLSRHIPDANASTKSGGWDRKSFVGTEVYKKTLGVVGLGKIGSHVATVAKAMGMKLLAYDPFISAERAEQIGARLVELDILFQEADYITLHIPKTPETANLINAETLAKMKPTTRIINCARGGVINEQALADAIAAGKIGGAALDVYDQEPLQADSPLRALGKNLILTPHLGASTTEAQVNVAVDVAEQIRDVLLGLPARSAVNIPGLYPDILEKLRPYLQLAETLGNLLSQVAGGRLEQLTVRLQGELAAQQSQPIVVAALKGLLTQALRERVNYVNAMIEAKERGIRIIETRDESVRDDYAGGSLQLVATGSNGEHRVMGALLGDGEIRITNVDEFPVNVPPSRYMLFTRHRDMPGIIGKIGSLLGSFNVNIASMQVGRRIVRGDAVMVLSLDDPLPEGILAEITKVAGISDAYTVVL

SEQ ID NO: 701 - protein, 254 aa, Mesorhizobium sp. BNC1
MTPTIRPLIAGNWKMHGTESSLGELKAIGSGFVEAAGAGADGVICVPATLLARASDILAKTPVATGGQDCHPATSGAHTGDIAAEMLADCGASYVIVGHSERRTDHHEADEDVAAKAEAAWRAGLTAIICIGETKIQREAGETLSVLSRQIAGSVPPGATAKNSVIAYEPVWAIGTGLTPTVEDVAQAHAHLRAELGMKLGIEADGMRLLYGGSVKPSNAGELLSILNVDGALIGGASLKAADFLAISAAVKGK

SEQ ID NO: 702 - protein, 293 aa, Mycobacterium avium subsp. paratuberculosis K-10
MPDWTAAQLPSFAGRTVIVTGANAGLGEVTARELARVGGHVILAVRNTDKGRAAADRMAGVATGRVEVRELDLQDLASVRRFADGIDTVDVLVNNAGIMATKHAVTVDGFEGQIGTNHLGHFALTNLLLPKLTDRVVTVSSLMHHFGYISLKDLNFRSRPYSAWLAYSQSKLANLLFTSELQRRLDAVPSSLRALAAHPGWSHTNLQGNSGRKLGDAAVLAVDRIVSTDADFGARQTLYAVSQDLPGDTFVGPRFGLYGRTQPTWRNWPAKRAGTAAALWELSEELTGTKFPL

SEQ ID NO: 703 - protein, 340 aa, Gibberella zeae PH-1
MVLASLRNWRAQWLPPKPIFTEQDVLAQNGRVFIVTGGNAGIGYELVKMLYGTGATIYMTSRSNDRAETAIKTITSANPRPSNPGTIKSLCLDLNDLESVKDAAETFARQESRLDVLWNNAGTGGTGVPVGARTKQGLEPMVGMHCVAALLFTQLLIPQLRAAATSSPRSSRVVWTSSFLGEAATPTNGIDFDFLKEGSSDRVQNYAVSKVGNWMISREMATRYAEDGIISVAQNPGNLKAGAYDGTPAIAMFFMKFFLHDPKFGAYTELYSGLSLDITSEHNGCYVIPWGRIRSDDKCPRRDIIRAMIPQSAGGLGYTGKFWDWCERQWQPFVGDVFTG

SEQ ID NO: 704 - protein, 1018 aa, Candida albicans SC5314
MALFKLGGKLKKKDHQSDPDTTVSSSSSTNSANRKSTSRFSSILHSSAAPMPSISNQPAHTSRPPPHANLSVTTPWNRFKLFDSPFPRYRHAAASIASEKNELFLMGGLKDGSVFGDTWKIVPQINHEGDIINYVAENIEVVNNNNPPARVGHAAVLCGNAFIVYGGDTVDTDTNGFPDNNFYLFNINNHKYTIPNHILNKPNGRYGHTIGVISLNNTSSRLYLFGGQLENDVFNDLYYFELNSFKSPKATWQLVEPLNDVKPPPLTNHSMSVYKNKVYVFGGVYNNEKVSNDLWVFDAINDTWTQVTTTGDIPPPVNEHSSCVADDRMYVYGGNDFQGIIYSSLYVLDLQTLEWSSLQSSAEKSGPGPRCGHSMTLLPKFNKILIMGGDKNDYVDSDPHNFETYESFNGEEVGTMVYELDLNIIDHFLAASAPVNAPTIIPPVASYEELPKPKKPAASARNDLQGYDRHARSFSGGPEDFATPQASARGSPSPERTQGGGDNFVEVDLPSTTISQVDDDPPYDTTSLNQPQEVTNGHVDDEPFRRRSLDPKFDDHSGAPEVAPVAVPVTEPVSAPVTAPVAEPVVAPAVAPDASGKVKKIISELTNELVQLKATTKEQMQKATEKIEQLERQNSLLHQSQQRDAESYTKQIEEKDVLINELKSSLDPSAWDPEQPQTATNISELNRYKLERLELNNKLLYLEQENVKLKDQFAEFEPFMDHQIGELDKFQKVIKVQEEQIDKLSNQVKDQEALHKQIYDWKSKFESLSLEFENYRAIHNDDDISDGEVELQDDDRSILSSAKSRKDISSQLGNLVSLWNQKHASSSSRDLSAPPVINPESHPVVAKLQSQVDELLKIGKQNETTFSQEIEALRKELQEKTTSLKTVEENYRESIQSVNNTSKALKLNQEELSNQRILMERLIKENNELKLYKKASSKKLGSRDGTPVVNEYQQGEDSPGVDELNNDDDDDEDVISTAHYNMKIKDLEADLYILKQERDQLKDNVTSLQKQLYLAQNQ

SEQ ID NO: 705 - protein, 666 aa, Oryza sativa (japonica cultivar-group)
MATRVLLSSKVILALVLASLFSLPRHGRALELMNWSCNNGSAYAANTTYDTNVHSILATLTARTPNTTTGFATATTGRGTDTEAWGLALCRGDTDRVGCASCLAAVPAVAFNECRGDMDVTVFYDRCLARFSYVDFTARPDNTEVLIGSPSADRITADAGHFDALVADLAGALADWAAYNSTLRYAAGVMTSGDGFMSTTEDMVHNIYGVVQCTPDQAAAACRACLEALRVDMPKVFAGKMGGRFNAVWCNLRYETFVFFDGDPSVKLVAPPVVPEDGKRRSSPENAAAVVGAVLGALVILLSLFIIYLWKKLQAKQYAADKNVDSGSLLFDLAIIRKATANFAEHNKLGHGGFGAVYKGFLPDVGEIAVKRLDRTSGQGLEQLRNELLLVAKLWHNNLAKLLGVCIKGDEKLLVYEFLPNRSLDTILFDPQKREQLSWETRYQIIHGTARGLLYLHEDSQIKIIHRDLKASNVLLDSNMNPKISDFGLARLCSGTKTTSITSQVVGTLGYMAPEYAVLGHLSVKVDVYSFGILVLEIVTGRRNTDVFDADEESSNLLSYVWDHWQKGIPLEITDTLLLLSGSRGLQDMELLKCVHIGLLCVQENPADRPTMLSVLVMLQDVDTTNFAAPSKPAFTFANVRNTTSSSPSAAALSANEVSISEFHPR

SEQ ID NO: 706 - protein, 263 aa, Buchnera aphidicola str. APS (Acyrthosiphon pisum)
MESITISQLKNWKINKKKFAAITAYDFSFSRLFSNCGIPVILIGDSLGMTIQGHTSTLPVKIEDIAYHTKAVRKGAPNTFLISDLPFMSYYDTKQALKNTAKIIRSGANMIKMEGGKWLIEIIRELSNRLILICGHIGLIPQSFHYLGGYKVQGRKENDANKLIDEALLLEESGINMLILECIPEKLAKKITESLSIPVIGIGSGKNTDGQILVMHDLLGITEGKTPSFTKNFLSESDSIQKAIQKYIYEVEHSIYPSKKHSF

SEQ ID NO: 707 - protein, 363 aa, Gibberella zeae PH-1
MTSTQSVKAVRYHGQQDIRLESVPVKPLDPTTVRIAPKFCGICGTDVHEYLGGNNLIPKPGTPHGITGETSPLTLGHEFSGIVEEVGSEVTRLQKGDRVCVQPIIYDNECRSCKRGLQNCCDQNGFIGLSGWGGGLAESTVVPQDAVKKLPDNVSLEVGALVEPLAVGWHATKISPYEDGNSAFVVGGGPIGLAVVQALVGRGCKNIMLTEVSSKRREFAKKFGAHHVFDPTKDDVVAMVKKLTGGLGADVGFDAAGSQHAIDVAFDCLKARAVLVNIAVWEKRAQLNMNQIVFRERSYVGCATYALGDFEEVIDALSNGKIKPEGMITKVIKMDKVVEEGFQTLINDKDNHVKILVDVSAGV

SEQ ID NO: 708 - protein, 257 aa, Arabidopsis thaliana
  misc_feature (17)..(17): Xaa can be any naturally occurring amino acid
  misc_feature (80)..(80): Xaa can be any naturally occurring amino acid
  unsure (1)..(257): unsure at all Xaa locations
MASSMLSSAAVVTSPAXATMVAPFTGSKLFAAFSVTRTTNKDITLIVSNGGRVSCMNVWPPIGKKKFATLSYFPDLSDVXLAHEVDYLLPIKCISCVALPLQHGLVVRALRAHFPLTFDGLALWPIRALLHFPRAPDSLSSLSLLSPFLHQCVLLSFPFTTNWFPSITLYSYSIPLIVFSLPLLTFLYSFLYTLFLHLLPIYSSSLLSPLLSPISHCPFTILLSYSTPSSLPLIYLVWLVLIFPYFLPFSPPSLPPF

SEQ ID NO: 709 - protein, 303 aa, Anabaena sp.
MTQAKAHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNEKTHTYICGLRGMEEGIDAALSAAAAKEGVTWSDYQKDLKKAGRWHVETY

SEQ ID NO: 710 - protein, 513 aa, Zea mays
MANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 711 - protein, 678 aa, Xanthobacter autotrophicus Py2
MPHETPLIATLVGAFVLAFVFGAIAQRFKLSPLVGYLLAGVMVGPFTPGFVADQSMALELAEIGVILLMFGVGLHFSLSDLLSVKAIAIPGAVLQIGVATLMGMGLAYALGWGLGAGIVFGLALSVASTVVLLRALQERRMVESEQGRIAVGWLIVEDLAMVLALVLLPALSGALGGRVVATPTVEWLGGDDVWMTLGITLAKVAGFVVLMLVVGRRVIPGIMHWVAHIGSRELFRLAVLAIALGVAFGSAKLFGVSFALGAFFAGMVLSESPLSHRAAEETLPLRDAFAVLFFVSVGMLVDPSIVIKSPIPLIITVLIVLFGKSLAAFLLVRAFGYGNITALTISASLAQIGEFSFILVALGVDLHLLPEEGRDLILAAAIISILANPFFFLALDRYRAKAVKVSTANAAAAAPAQAAADKAATAKGAEKGAEKAPPAPTLPVTAQQAHTVLVGYGRVGHLVADGLKAAGLPFLVIEDQEDRVEELRRGDIEVIDANAASPAAITAANVAGASRLILAIPDGFEASGVLRKARQMNPGIEIIARAHSDAEVEHLRQGGANFIIMGEREVARGMLAHVLDRSDADLAAAVQAAGVASGTEAASPSPDAPVAEVEVSPVTPPTQSIAAAGATPAPAPTMVPAGIAGPAATQPPLSAPESAPGPVPALAESAAAEQNEKG

SEQ ID NO: 712 - protein, 302 aa, Musa acuminata
MAQESTWSSFDATMLAEEESRMIAQLLSNYQCFGEQDRDVGCCELPPSSCCSSHAADSCYCWSANENSNPGLCYWSQSGDESDGAHAIGTVPVFTNHCLVGDQVAVNQTLSIHEPTAAHAEMPKRKIESHASEDDFRRQSSKKKLQAPTNALKSVKKARPGRNQKSIVCGDEEENNARSSGRSCCSYSSEEDSQAFQADLNAKTRSNRWPATDPQSLYAKQRRERINARLRTLQNLVPNGTKVDISTMLEEAVRYVKFLQLQIKLLSSDELWMYAPVVHSGMIDGQVNSEIFVSANTRNEWF

SEQ ID NO: 713 - protein, 469 aa, Desulfovibrio vulgaris subsp. vulgaris str. Hildenborough
MRTKIIATIGPASRSHEVLSRLVNAGVGIFRLNFSHGDASMFVELIGLLRELERESGRPLTILQDLSGPKIRIGEIAKGALSVSKGDRLLLGPAPAPADNRPFIPFDHPAVLAEFEIGDRVVLSDGGLQFRVVDKGPNGTFELEANNNGMITSRKGLALPGKSVKLAALTAKDRKDLADGLALGVDAVALSYVQTPDDIRDAKEIIRAAGRNIPVIAKLERQNAVDRLDEILAETDIVMVARGDLGVECPLPELPAMQKRIIRACNRAAKPVIVATQMLLSMVNSPSPTRAETTDVANAVLDGADCVMLSEETAMGSFPVETVNFMKEIAMKAEELHFELQRLREPDVGRGSADFLAYSACLLAEKANADAIVSHSLSGSSARLISSRRPQQPVYAITPDPAAQRWLNFSWGVFPEGGDEGISGHLERAEAFIERCPDIPDGADVVITAGQPKPGDTPRGTNLVKIYRK

SEQ ID NO: 714 - protein, 452 aa, Geobacillus kaustophilus HTA426
MSKSFVSSTQTGLLEQIKETIQQKNVELLHLQFVDIEGILKHVTVTAEQLDDVVEGKIMFDGSSIKGFSPINRSDLYLLPDLNTFAVLPWTVEEGYAEARFLCSVTNPDGTLFEGDPRNVLKKTVERAAEKGYAISVGPELEFFLFKADENGNPTLELHDGGGYFEPSPKDLGERVRLEIYRALKAMGFTIEASHHEVAEGQHEINFKYADALGAADNATTYKWVVKTIASKFGLHATFMPKPVFGINGSGMHVNISLFKDGENAFFDPNDANQLSETAYQFIAGLLKNVKHFAAVTNPLVNSYKRLVPGYEAPCYIAWSASNRSALIRIPAKRGVATRVELRCPDPSANPYLAYAIIAAAGLDGVEKGLTAPAPIDEDIFHMSEERRAELGIDNLPENLGEAIAAFESGDIGRATLGEHVFNEYVAMKKDEWNSYRTAVHAWEVERYQGKF

SEQ ID NO: 715 - protein, 589 aa, Musa acuminata
MWLRLLMHLTQGCDNSTYQLLDEHHHLHTPKRQGVFMDNNNDNDAYVVATSSLKLSMPDSDLFKDARISPVSLTYYGLCLLEGNYSVKLHFAEIKITNDGYGSLGKRIFDIYIQGNLVWKDFNIRDEANGSGNAIIKSTNVMVTDKLEIHLYWAGNGTQSLPVRGTYGPLISAISVEPNFSLSSGKRTKIIVGIIVSVSCLIFLLLSILWKKGWLGGQTAKDRELRALDLRTGRFTLRQIKMATGNFSASNKIGEGGFGPVYKGLLPDGTIVAVKQLSSKSKQGNREFLNELGMISALQHPNLVKLHGCCIEGNQLLLVYEYMENNSLARALFGSEEYQLKLDWSTRKNICIGIAKGLAYIHEESRLKVVHRDIKATNILLDKNLNAKISDFGLARLDEEENTHISTRIAGTVGYMAPEYATRGYLTEKADVYSFGVVTLELVSGTSVMSFRKEGGMHLLDWVQILREEGKLEKFVDPRLGTDFNKEEAIRLINVGLLCINSSPVPRPPMSAVVSMLVEAQTSIVDATPEQIFSTDDFEIQVSGKRYPSSGDSQTKSILVEGGSVHGSTTSSSDLYPLNLDSLYRNRRC

SEQ ID NO: 716 - protein, 373 aa, Pseudomonas putida KT2440
MAFNTIEELLEDYRQGKMVLLVDDEDRENEGDLLIAAERCDAQAINFMAREARGLICLTLTDDHCQRLGLEQMVPANGSVFSTAFTVSIEAATGVTTGISAADRARTVAAAMAPNARPEDLVQPGHIFPLRAREGGVLTRAGHTEAGCDLARLAGFSPASVIVEVLNDDGTMARRPDLEVFAARHGIKIGTIADLIHYRLSTEQTVKRIGERELPTVHGTFRLVTYEDRIEGGVHMAMVMGDIRREQPTLVRVHVIDPLRDLVGAEYAGPANWTLWAALQKVAEEGTGVVVILANHESSQALLERVPQLTHPVRPYQRGQSKVYSEVGTGAQILQDLGVGKLRHLGPPLKYAGLAGYELEVVQSIPFDPGMDG

SEQ ID NO: 717 - protein, 391 aa, Magnetococcus sp. MC-1
MQWAKKIAQIQPFYVMEMLAKAKALEAQGRHIVRMEAGEPDFTTPAPVLAAARLALDEDRTRYTPSLGIPELRAAIAQWYQTRYGVAVSPQRVVVTPGTSGAFQLIFGLLLDAGDRVALSDPGYPCYPNMVRFVNGEPVAIPVSPQSHYQLSAELLVEQLAPQHARGLKAAIVTSPSNPTGTLIPDAQMQTLLSAVEGQGGYVISDELYHGITYGCKARTALEFSENAIVINGFSKYFGMTGWRLGWMIVPPSAVRGIEMLSQNLFISAPTIAQYAALQAFDCAGAMDEQVARYDLNRRYLLTALPKLGFGIGVEPKGAFYIYADATQVLSKTGLANGEALCMAALEQAGCAFTPGLDFGRYRSHEHVRFCYAAELAQLKIAMERLAAWLG

SEQ ID NO: 718 - protein, 272 aa, Nostoc punctiforme PCC 73102
MGFNLQNLESALKAGRKYTYLPFSPHFFESVSSTNQTLWNLLHQGAISGTVVIATQQSAGRGQWGREWISPIGGLYVSVAISFDRKIEATDSYQLTFATAWGIASQLRQCGIDVGIKWPNDLVLNSRKLGGILTETKVNKGQITQAVIGVGINWTNPVPDTGINLESWQASQDFRPISSLEILTSKVLLGIESGMECLQQEGVSILLSRYLDLLTNMGDRVYVNNLLGTVVGVTPQGNLRVDLETHDTKELITPEIYIQPGTISLGYHKSSV

SEQ ID NO: 719 - protein, 367 aa, Haloarcula marismortui ATCC 43049
MVLSPSVAGQVAVAGYGLPVVESSEFIELGAELGIVFLLFFLGLEFNLDRLLDSWERITRAGTIDLGINFGVGLVLGFALFRDPLAAFLVAGIVYISSSAIITKSLIDLGWIANDEANPMLGTLVFEDLFIAVYLTIAAALVTGGSDLGAAATSVGVALSFIVALLLLARYGTPWFERALQTTSNEFTVVRAVGITVFISGLALAIGVSEAVAAFFIGMAFAPTTHTHKLERLLEPLRDTFAAVFFFWIGVETDPRLFAGVAELVVAAIVVTTPTKILSGYLSGRAYALTPRRSMRVGLGMVTRGEFSLIIAAVALTGAGASLSTELANAVYSFTVAYVLLMSILGTMLMQYSAPFEAFATARFGAE

SEQ ID NO: 720 - protein, 341 aa, Mycobacterium sp. JLS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCKQCKAGRYNLCPEMKFYATPPIDGAFCRYVVIDDDFAHPVPESMSDDAAALLEPLSVAIATMRKAGVVPGSTILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWPAAIHLVNSGAVDLDAMVTGRYDLEHVADALDSDTDPASLKSIVNP

SEQ ID NO: 721 - protein, 412 aa, Salmonella enterica subsp. enterica serovar Typhi
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQRSSVAVFGAGPVGLLTIACARLLGAEQIFVVDHHAWRLRFAEERYGAIPINFDDENDPAEKIIEQTAGHRGVDAVIDAVGFEAKGSMTETVLTNLKLEGSSGKALRQCIAAVGRGGVVSVPGVYAGFIHGFLFGDAFDKGLTFKMGQTHVHAWLGELLPLIEKGLLKPEEIVTHYMPFEEAARGYEIFEKREEECRKVILVPGAMSAQAAQKQATGVINPMPGGVV

SEQ ID NO: 722 - protein, 480 aa, Bifidobacterium longum DJO10A
MRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADVIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMIYTDKVLKDAGKVADGDKIVILSSAQGEHQPGRTDSIYVHTVGACD

SEQ ID NO: 723 - protein, 355 aa, Clostridium tetani E88
MLYALILAGGKGTRLYPLSREDKPKQFLKIINNKSFLKSTVDRIKTLVNMENIYIVTNEVYLEKIYEELPELNKENIFLEPENKETATCIGLSAVKLLKKDKDAVMMVLPSDHHIQDEKVFIDTMKQAVETVEKKRGLVTVGVKPIRPETGYGYIEAGERVQGSIATYKVERFVEKPNVEVAKDLIMKGNYLWNSGMFVWRADIYLREMEKYLPKMYKSMMNIYSSLGTEEEEEVIRQEYNLIDGISVDFGIMQKTRKAYVIKCEFTWDDIGSFMSLSRFLKNFRGNNVEGNTFLEQSNNCIVFSKEKLIIGFGINDLIIVDSGDVMLIMDKNKDQEIKHLVDELKCSKEFNKFT

SEQ ID NO: 724 - protein, 128 aa, Brassica napus
MSWAGPEDIYLSTSLASYLDRKILVLLRDGRKLMGTLRSFDQFANAVLEGACERVIVGEQYCDIPLGLYVIRGENVVLIGEMDTEREELPPHMIRVSETEIKRAQKVEREAGELRGTMRKRMEFLDFD

SEQ ID NO: 725 - protein, 137 aa, Brassica napus
MASLSFVSSSHLTLRTPSLTLRRTSPSSSSVSFSVKAQSVALSQDDLKKLAAEKAVEAIKPGMVLGLGTGSTAAFAVDQIGKLLASGELHDIVGIPTSKRTEEQARSLGIPLVALDTHPRIDLAIDGADEVDPNLDL

SEQ ID NO: 726 - protein, 528 aa, Xanthobacter autotrophicus Py2
MAPRVLISDKLSPAAVQIFKDRGIEVDFQPDLGKDKDKLAEIIGNYDGLAIRSATKVTPKILQKAGRLKVIGRAGIGVDNVDLPAATAKGVIVMNTPFGNSITTAEHAIAMMFALAREIPAADASTQAGKWEKNRFMGVEVTAKTLGIIGCGNIGSIVAERGVGLKMKVIAFDPFLSVERALDLGVEKVELDDLLARADFITLHTPLTEKTKNILSAENIARTKKGVRIINCARGGLVDEAALRAALDSKHVAGAAFDVFAVEPAEQNPLFGHPNVVCTPHLGAATNEAQENVALQVAEQMSDYLLTGAITNAVNFTSITAEEAPKLKPFIALAEKLGSFAGQLTDTDIKTVHIVYEGAVADQKVKALTSAAVAGLLRPMLSEVNVVSAPTVAKERGIVIEETTRAATGDYDSLISITVVTDTYERAISGTVFADGRPRIVNIKGINVDAEFAPSMIYVTNEDKPGFIGRFAGLLGDAGLNIATFALGRDHLGGDAIALVAVDGTVPADVLGKVQALPQVKAAKALAF

SEQ ID NO: 727 - protein, 268 aa, Aspergillus nidulans FGSC A4
MAGVLFSPEKDIPNLSGKVILITGGTAGLGAAAAIHLAKHSPSHIYISGRNAKSADAVIQQTQKSGTKVSFLACDLASLDSIKKAADTILAQESRLDLLMCNAGIMAVPPGKTSDGYEVQFGTNHLGHALLIQKCLPLLQQTAALPGADVRVVILTSLGFRMHPSAGIVFSDLKSEQNFPAFGSWIRYGQSKLANILYARELARRYPSITSVSVHPGVVGTGLVENLGWAKRTFVYVTNLWKLMKPEEGKLEERAALRAGWDPVVQVG

SEQ ID NO: 728 - protein, 956 aa, Musa acuminata
MLTTEMMGVAALRVIASKLAKKWDFSVDPCSQTNGWVVPGRSDMPVFTDNVTCDCNRTSNVCHVTSIKLKGLNLTGTLPAEFSKLPFLTDIDLTWNYLNGTIPAAWASLPLVHLSLLGNRVSGPIPEEFAKMITLEELVLEGNQLQGPIPAALGKLANLKRFLANGNNLSGELPESLGNLKNLIMFLIDGNPISGKIPSFIGNWTQLQRLDMQGTAMEGPFPPRFLALKNLKELRVSDLKGGIGSFPQLQNMRNMTKLVLRNLSISGELPDYIGEMKALNSLDVSFNNLSGPIPGTYAALTSSLNFMYLSNNNLNGKIPDWILNSAQKFDISYNSFTGSPAPAICQRGKGCWCNLTAPFYRTLSCLRRNLPCSGESRNYNLFINCGGPKMRIDDIEYEGDILDLGTSEFYDSESGKWAYSSTGDFVDNQNPKFITANTTALDITKPELYMTARLSPLSLKYYGRCLYKGNYTVNLHFAEIMFTDDETYSSNGRRLFDVSIQGRKVLKDFNIAKEANGTGKEIIKSFTVMVDGTLEIHFYWAGKGTNSVPLRGVYGPLISAISVTPNFKIDTGENKLTVGTILAIVAAACIIVLLILCLIFLYIRRKNSKNNELRGLELQTGQFSLRHIKAATKNFHPANKIGEGGFGPVYKGVLPDGSEIAVKQLSSKSKQGNREFVNEIGVISALQHPNLVKLYGCCIEGNQLLLVYEYMENNSLARGLHGRWKICLGIARGLAYLHEESRLKIVHRDIKATNILLDKDLNAKISDFGLAKLNEEENTHISTRIAGTLGYMAPEYAMRGYLTDKADVYSFGVVALEIVSGMSNTKYRPEEDCVYLLDWAYVCHEKGNLLELVDPALDSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 729 - protein, 223 aa, Arabidopsis thaliana
MFFRSQLSDGVSSTVQDMKNNIGEGNRGEEEKGRSGIGKLRSQKGKCEWRRLSFRIPMSWAAPDDIFFSTSLAAYLDKKLLVLLRDGRKLMGLLRSFDQFGTCLSLLHRKSKVFEMVLRNVSFVFGFLEANAVLEEAYERVIVGDLYCDIPLGLYIIRGENVVLIGELDVEKEELPAHMVQVPEAEIKRVSANILLSLAQKAEKEEMLLKGTMRKRMEFLDLD

SEQ ID NO: 730 - protein, 472 aa, Pseudomonas putida KT2440
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 731 - protein, 275 aa, Agrobacterium tumefaciens str. C58
MYDVSANGANIPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWDD

SEQ ID NO: 732 - protein, 425 aa, Kluyveromyces lactis NRRL Y-1140
MKNRNYDMQFYKMYQYRLNVLRNRVESCCQSKWNSEFRLQGRKVVKKSKVLDIQAGEPCWCIGTVYCEMQYKPNILQEIVDDTYGAPDLIKSYTDPEGTDEIMLDDESGRVILVGELVRKTPFVSGTVVGILGMEADAGTFQVLDICYPQALPQKSLPPLPGKKIALISGINATPRSPILSLRMQLLQDALTGELSTNSGLNEVSRCIILGNSLNPGENRQDLPGSLREFTPFLSNILKSLPVDLLPGENDPSDRSLPQQPLHKALFDDALSPYFDLENADIFHSVSNPYWFDIEGLQLLATSGQQINDITKYVIPFYEETKSLKGDTIDHRLDLAEATLKWQNIAPTAPDTLWCYPYSDNDPFILKEWPHVYIIGNQPEFGYRKTQLEGAVEVLIVSVPEFSTTGQYLVLDLDSLVPEVHTIAV

SEQ ID NO: 733 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 734 - protein, 817 aa, Burkholderia xenovorans LB400
MTAVDLEFDQLNSTVDALRRSISNRMMYGVGKDAVTAHPHDWLHAAALAVRDRLVARWMKTTRLQYEQDVKRVYYLSMEFLIGRTFTNALLALGIHDQMKEALASLGVDMQMLTDIEPDAALGNGGLGRLAACFLDSMATLGIPGFGYGIRYEYGMFRQQIVNGEQVEAPDYWLRAGNPWEFPRPEVTYMVHFGGRTVQRGDHVEWIDTEHVNATAYDTVIPGYDTDATNTLRLWSARATEELDLGAFNRGDYRNAVDTKNMSENVSRLLYPDDSTPAGRELRLRQEYFFVSATMQDLIRRYQRTHSTFGRFSEKVAVHLNDTHPVLAIPELMRLLVDVHRLQWDKAWNHVTQIFSYTNHTLMPEALETWDVEMLARLLPRHLEIIFEINAQFLKHVSEQSDHDGEMIRRISLVDEYGQRRVRMAYLAIVASQKVNGVSKLHSQLMTRDIFADFARIYPDRFTNVTNGITPRRWLAQASPSLSSLIDQKIGRHWRTNLFELEQLRELRNDSGFIDAFREAKRQNKLRLVHRLAHHTKLHFDPDALFDLQVKRIHEYKRQLLNVLHVIVRYNQIRANPERDWVPRVVLFAGKAASAYRMAKSIIKLIGDVSQKVNHDPLIGDRMKVVFVPNYGVSVAELIIPAADLSEQISMAGTEASGTGNMKLALNGALTIGTMDGANIEICDAVGRENMFIFGYTADEVDRLRATGYRPRQIYEENPELRMALDQIRSGFFSPDDPLRFADIFHTLVDWGDHYMVLADFAAFAKAQDEVDARFVDKRAWTESAIENVAGMGQFSSDRTIGEYARNIWHVSPLNIE

SEQ ID NO: 735 - protein, 450 aa, Lactobacillus plantarum WCFS1
MAYRQQLLPMEKVFRDPVHDYIYIQHQVILDLINTSEFQRLRRIKQLGTTSLTFHGAEHSRFGHCLGVYEITRRICDNFERNYPTQAPGDGGWDDHERLVALCAALLHDIGHGPYSHTFEHIFHTDHEALTVQILTSPETEVNQVLQQVSPDFPAQVAAVIQKTYPNPQVVQMISSQIDADRMDYLLRDSYFTGTNYGNFDLTRILRVMKPYQGGITFAMEGMHAVEDYIVSRFQMYMQVYFHPVSRSMEVILDRLLERANDLYQSHAVDAEATPVMLLPFFNNNFTLHDYLRLDDGVLNTYFSHWRDSRDQILADLATRFLDRRPLKSARVAATTQPLIPTLQKLIEQAGFDTHYYTDINDSYDLPYDAYDPKMKKPRTQIELQQKDGSLLELSTVSDLVRAITGKVSGDQRFFFPKEMLSKNAENDLFKPIYQEFQQYILNDRLVVPH

SEQ ID NO: 736 - protein, 259 aa, Oryza sativa (japonica cultivar-group)
MPQGDHIELHQKRHGRRLDYEERKRKRAAREVHKRSRDARQLLGAKGKRFAKKRYAEKAQMKKTLKMHDESTSRQKVDDVQEGALPPYLLDRDQTQRAKVLSNTIKQKRMEKAGKWEVPLPKVRPVAEEEMFKVLRTGKRKTKQWKRMVTKATFVGPGFTRKPPKYERFIRPTGLRFTKAHVTHPELKCTFNLDIISVKKNPNGQMYSTLGVLTRGTIIEVNVSELGLVTPAGKVVWGKYAQVTNNPENDGCINAVLLV

SEQ ID NO: 737 - protein, 158 aa, Zea mays
  misc_feature (14)..(14): Xaa can be any naturally occurring amino acid
  misc_feature (42)..(42): Xaa can be any naturally occurring amino acid
  misc_feature (79)..(79): Xaa can be any naturally occurring amino acid
  misc_feature (93)..(93): Xaa can be any naturally occurring amino acid
  misc_feature (104)..(104): Xaa can be any naturally occurring amino acid
  misc_feature (151)..(151): Xaa can be any naturally occurring amino acid
  unsure (1)..(158): unsure at all Xaa locations
DEVIKNADYIVTRXMGILGADEFTGTIEKRLYSMKGENVMEXSRALCYVAIVVPWCSSRISGVIFFEETLYQKTKDGKXLTADFLKEGGEAPXEKVDKGTIEVXAGTDKVTTIHRHDDLVKGCAKDYKVGCLYDKRRACLKIGPNEPSQCXIDLNAQG

SEQ ID NO: 738 - protein, 286 aa, Oryza sativa (japonica cultivar-group)
MSVIDILTRVDAICQKYGRYDAEKLHGSGVAGEDPFARLYASVDADLNECLEKAEAAKQEKNRATVVALNAEIRGTKAKLLEEDLPKLQRLALKKVIDASLVLSPLLLCIASRYVDMQGGWCEELVPACTVLQRYLEWKLIYVGSAEDENYDQLLESVLVGPVNVGTYRFVLQADPPDPSKIRKEDIIGVIVLLLTCSYMGQEFIRVGYYVNNDNDDEQLREEPPAKLLIDRVQRNILADKPSVTKFPINFHPETSAGAGQEQQQQQQSGSPENHPNQGSKPNPDQ

SEQ ID NO: 739 - protein, 253 aa, Calystegia sepium
MASSLPALQIILPLLLLLGTCSANLIRGGHKEFDYFTLALTWSGTECLSVKDSCPTNACSRSEVETGFTIKGLWPDYDDGTWPSCCEGAKYDENEISILSNDLSKYWPSYSCMSSSACGSFDASDLAYEWAKHGTCSSPVLGNQYEYFSTALMLYFKYNISEILSESGYLPSNTAEYKLEGIMSAIQSALRVTPVVKCKSDAVEQVQICFDKTLQLQECPSTASTCPSLVSLPIKNTIKPLETNNLSFRGMRA

SEQ ID NO: 740 - protein, 399 aa, Pseudomonas syringae pv. phaseolicola 1448A
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPKRLVHAKAQGFEIADLSLDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADVVGVEVISLDDAPRGYGEFDSGVPKKFVIDPHRLFGAV

SEQ ID NO: 741 - protein, 131 aa, Cryptococcus neoformans var. neoformans JEC21
MFRASRVVLSALRPLKASTNITGLAVHPDPLPALTSIYTSTLSSLSQLPAASVYRQATEALTKYRLAIVEKAQGDVEKVESELGSIVEIVIEEAKSEEGLVVKMKDWKSWEGLMEEPHPGQWRYFEPLSDE

SEQ ID NO: 742 - protein, 864 aa, Zea mays
NSTRGTSAVEEALAAHRPRRAMASPLLCVLLYLLRHLTACHAARDTITPDRPLAGNETLVSGGEGNFALGFFTPPGANSTYLGVWYNKVSLRTVVWVANREAPIAGAVGDNPGATLSVSAGGTLAIAAGNRTVVWSVEPASRLASPAAQILDNGNLVLKDGAGGGAVAWEGFDYPTDTMLPEMKLGIDYVKGKNRTLTSWKSPSDPSPGPVAMVMDTSGDPQVFIWNGGEKVWRSGPWDGVQFTGVPDTATYSGFTFSFVNSAREVTYSFQVHNVSIISHLGVVSTGNYGLLQRSTWVEAARAWNLYWYAPKDQCDAVSPCGPNGVCDTNNMPVCSCLRGFTPRTPAAWALRDGRDGCVRSTPLDCRNGTDGFVTVRHAKVPDTERSAVDWSLTLDQCRQACLRNCSCTAYASANVSGGAGGGRRAGAGSGCVMWTTGLTDLRVYPDFGQDLFVRLAAADLDVEAKSREARIKIAVGASVSALALLLAVAGLLIWSWRRRLTRTDGSSKWSSSRPTGRRYEGSSHGDDLELPIFDVGTIAAATDGYSIENKLGEGGFGPVYKGKLEDGMEIAVKTLSKTSAQGLDEFKNEVLLIAKLQHRNLVRLLGCSVSGQERMLVYEYMANKSLDYFLFEKDNVVLDWQVRYRIIEGITRGLLYLHQDSRYRIIHRDLKAANVLLDKEMTPKISDFGMARIFGNEETEINTRKVVGTYGYMSPEYAMDGIFSVKSDVFSYGVLLLEIVSGRRNRGVYSYSNNQSLLGHAWSLWNEEKSIELADERMNGSFNSDEVHKCIRVGLLCVQENPDDRPLMSQVLLMLASTDATSLPTPKQPGFAARRVLMETDTSSTKPDCSIFDSATITMLEGR

SEQ ID NO: 743 - protein, 404 aa, Frankia sp. EAN1pec
MEFAQSDKLADVCYDVRGPILDEATRLEAAGQRILKLNIGNPAPFGFSAPPSVLAAVVENLAAAQGYSDSKGLLPAREAVVRYAAGKGMTSVTPDDVYLGNGVSELIMMSLQALLNNGDEVLLPAPDYPLWTAVVSLTGGRPVHYLCDESAGWNPDLDDIIRKITPRTRAIVIINPNNPTGAVYDRPVLEELIEVARRHHLMLFSDEIYDRILYDGAEHHSPAALAPDLFCVTFNGLSKAYRLAGFRSGWMTLSGPRQHASSYIEGLNILANMRLCANVPGQFALQAALAEGSGAGDLVLPGGRLLEQRDTVVKLLNDIPGVSCVPPRGALYAFPRIDPEVYPIDDDESFVLDLLQAERILLVQGTGFNWPRPDHVRLVTLPCVDDLTDAVGRIDRFLTTYART

SEQ ID NO: 744 - protein, 227 aa, Streptococcus pyogenes MGAS10394
MKALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 745 - protein, 137 aa, Leuconostoc mesenteroides subsp. mesenteroides ATCC 8293
MVERTFMMIKPDGVSRGKIGEIIQRIEHKGYAIKAMKMVQPTPELLAKHYAEHVGKSFYPSLVQYMTLGPVIAMIGEGTNIVSGWRTIMGTTNPTLAAPGTIRGDLGREWEGEAVMNIVHGSDSVEAAEYEIKLWFA

SEQ ID NO: 746 - protein, 334 aa, Oryza sativa
MSASIGINGFGRIGRIVLRAALEKGVNVVAINDPFIPLDYMVYMFKYDSTHGRFKGDIHHANGFLYVNGHQISVFTEKDPTQIPWGKSGAEYVVEAAGVFTTIDKCQAHITGGAKKVIITAPSADAPMFVCGVNEKTYNPSINILSNASCTTNCLAPLAKVINDKFGIVEGLMTTVHSYTATQKTVDGPSNKDWRGGRTAATNIIPSSTGAAKAVGKVIPDLNGKLTGMAFRVPTADVSVVDLTVRLAKPAKYDEIKAAVKAASEGELKGILAYTEDEVVSSDFIGDHHSSIFDAKAGISLNDNFVKLVSWYDNEFGYSCRVIDLIKHVHSVSH

SEQ ID NO: 747 - protein, 351 aa, Alkalilimnicola ehrlichei MLHE-1
MSTMQAAVFVEPGRIEVQEKPIPEIGPTDALLRVTTTTICGTDVHILKGEYPVEPGRIVGHEPVGVIEKLGEAVTGYEPGQRVIAGAITPCGQCHACQDGVSSQCGGKAMGGWQLGNTIDGCQAEYVRIPNAQANLTPVPDELTDEQVLMCPDIMSTGFGGAENGHIRIGDTVAIFAQGPIGLCATAGAKLMGATRIIVVDGVPERLETARKLGADVGVNFREQDPVEAIMELTGGRGVDVAIEALGLQETFEACLRVLKPGGTLSSLGVYSGKLSMPLDAIAAGLGDHTIVTTLCPGGKERMRRLMEVVAAGRVDLTAMVTHRYTLDQIVEAYDLFSHQRDGVLKVAITP

SEQ ID NO: 748 - protein, 146 aa, Triticum aestivum
  misc_feature (70)..(70): Xaa can be any naturally occurring amino acid
  misc_feature (80)..(80): Xaa can be any naturally occurring amino acid
  misc_feature (93)..(93): Xaa can be any naturally occurring amino acid
  misc_feature (99)..(99): Xaa can be any naturally occurring amino acid
  misc_feature (101)..(101): Xaa can be any naturally occurring amino acid
  misc_feature (108)..(108): Xaa can be any naturally occurring amino acid
  misc_feature (111)..(111): Xaa can be any naturally occurring amino acid
  misc_feature (114)..(114): Xaa can be any naturally occurring amino acid
  misc_feature (119)..(119): Xaa can be any naturally occurring amino acid
  misc_feature (133)..(133): Xaa can be any naturally occurring amino acid
  misc_feature (136)..(137): Xaa can be any naturally occurring amino acid
  unsure (1)..(146): unsure at all Xaa locations
MEKAGQKRRPLTVMASSSSQVAAARGMGMTNPLAEWTDRVRSLEAGVRAWLAKQPTHVEAAVVTAVGAVXGAALGGLMGXLAPDGGAALPVPXPPPGNXPXVLGSFKXQTXALXGGPLXQTRNLRHNGAKCWXTCXXKRIKGLRSR

SEQ ID NO: 749 - protein, 402 aa, Mesorhizobium loti
MKIVYVVGTCDTKGSELRYLRDLIRDAGCDVVLVDVSVSEFHSEASDVDVQPAEVARCHPNPLKAEELKDRGKAVAAMSQALVEYIRSRPDVDGIIGAGGSGGTALIAPAMRALPIGVPKVLVSTVASGNVAPYVGPTDISMMYSVTDVSGLNRISRVVLANAAHSIAGMVLKQVGAAADERPAIGLTMFGVTTPCVQAVTRALEANFDCLVFHATGTGGQSFEKLADSGLLVGGIDVSTTEVCDYLVGGVFPCTPDRFGAFARTKLPYVGSCGALDMVNFGAMETVPSQFRSRRLHVHNPQVTLMRTNPEECSRIGEWIGERLNLCEGPVRFLIPELGVSAIDAPGQPFHDPEADAVLFAALERTLRCTDKRQLARVPLHINDPQFADLLVTNLKEAFREH

SEQ ID NO: 750 - protein, 283 aa, Listeria innocua
MKTVKLNNGIEVPILGFGTYQITDAGEAEQAVKEAIAAGYRHIDTAQSYMNEEAVGRGIAASGVDRKELFITTKIWVENVSYKGVMSSFDRSLKRLGLDYIDLLLIHQPYNDVYGAWMAMEELQAQGKIKAIGVSNFGVDRVVDLAAFNDITPQVNQIEINPFQQQSKNIEALRKEGVAVEAWAPFAEGKNDIFTNPILTKIAEKYGKSVAQVILRWLIEQDIIVLAKSVKPERMAQNLAVFDFELSEEDKSAIATLNQGESQFFSHADPEMVKWMASRKINI

SEQ ID NO: 751 - protein, 676 aa, Aeropyrum pernix K1
MWWSGLASQSKAQETPGRRGLEERKQLIMEIYNSLRSADIASIEFEGPEIAVYIRNPKFIVENENVVKDLARKLRKRIVVRTHPKSRKSMEYTIKFIRENVPPDVGIVDIQFDDVLGEVRVIAEKPGKLMGRGKVFRNLVLAETGWRLEVYRKPLLQSGLLDSVLRHLQRHAEERRRALRDIGERIFRDTLIGTRHVRVVGLGSFGEVGRSAILVDTGESKVLLDAGLSPSGYGPDSYPYYWSPEFRVDELDAVVISHAHLDHVGTLPLLFKYGFRGPVYATPPTRDIMIIVLRDLINLMRKAQGEPPFEPRDVEKALTRLIPVNYNTVTDVAPDIKMTFINAGHILGSSMVHLHIGQGLYNILYTADFKFYRIKNDRSTRLLPPAEYSFQRVEALIMEATYGSKETQPRAEAEEELINLVNKVYKRGGKLLIPVMAVGRGQEILVVLNEALRSGKIPEIPIYVDGMVYEVTAVYTNYPELLVKPIRDRILKQGENPFEGPTTVYVTDHYKRDEAMYSDKPAIILSTSGMMNGGPIVEYFKYLADDPRNALAFVSYQAPGTLGRRLQSGEREIELEMDGGIRRIKVNMEIVSIEGFTGHSTRGELLSFLRRLNPKPRNIVLNHGEPSAIAALAHTVKTGWSKLGFESPPIIEAPENLEGVRLYPRNLKMKLALQHS

SEQ ID NO: 752 - protein, 123 aa, Solanum carolinense
EQHVVLNDCDKTFTKFWDPKLKEELDERWTDLIYSKYDAKKEQSFWKHEYNKHGTCCSEVYNQEAYFRLAMKLKDKFNLLQILKNQGIIPGSTYTVNKIEQAIKTVTQEYPNLNCLGDPQKTM

SEQ ID NO: 753 - protein, 406 aa, Oryza sativa
MLLRLPCARGPAPAAAARWRPPGRAARTAPRLGRGHAAASSADGSGAPSSPLFVLCHSQALTLALPPQSLHYDYDPLADLLGPDVDPTSSQRSFNAGVILVTWLIWKEHNESLRGVQSLRNTAPVAEKGKLRSWVGPNGQYYRELPCPSCRGRGYTPCKQCGIDRSSLDCPMCNGKGIRECVQCAGECVIWQESIDEQPWEKVRSSSPLKVKEDDEVDKLEIKINTSKRSRRTYPSPSPEVALKISRSLRSLNAKTGLFTKHMKIIHQDPKLHAQRVAAIKKTKGTAAARKHASETQKAFFSNPENRLKRSIAMKGVKFFCSKCGQEGHRSFYCPTVREISGRAHFRCRLCGGKGHNSRTCGKPKSENECQRQPRHCSQCGERGHNRRNCPRSTTVEVEDVKIYSE

SEQ ID NO: 754 - protein, 120 aa, Solanum carolinense
IKGTVLNNCNSQARYTPVTGNDFDKRNKNWPDLFHTEADARKNQGFWRYEFVKHGTCCSDLFNEEKYFDLAVGLKDRFDLLKIFRNKGIIPGSNYTVNKIEKTIRTVTGVVPNLSCTGAM

SEQ ID NO: 755 - protein, 124 aa, Solanum carolinense
HTSFVMYDCDPTKSYEIIGDPDMLKKLKPRWPQLTSTESFGLKHQTFWAYQFEKHGTCCADVYNQSVYFEISIKLKDSIDLLKILKTKRIIPGFKYTGDQIRGAIKSVTQNEPNPKCATLKGGL

SEQ ID NO: 756 - protein, 342 aa, Arabidopsis thaliana
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNPWKFC

SEQ ID NO: 757 - protein, 428 aa, Geobacillus kaustophilus HTA426
MQWTKSEQLYKEALQHIVGGVNSPSRSYKAVGGGAPVVMERAQGAYFWDVDGNKYIDYLAAYGPIIAGHAHPHIAEAIRRAAETGVLYGTPTPHEITFAKMLKEAIPSLEKVRFVNSGTEAVMTTIRVARAYTGRSKIVKFEGCYHGHSDLVLVAAGSGPSTLGTPDSAGVPPSIAQEVITVPYNDVESFREAMNVWGEQVAAVLVEPIVGNFGIVLPKPGFLEAINEIAHKEGALVIYDEVITAFRFMYGGAQNLLGVEPDLTAMGKIIGGGLPIGAYGGRQDIMEQVAPLGPAYQAGTMAGNPASVLAGIACLEVLKQEGVYEHLDRLGAMLEEGILAHARQCGLPVTVNRLKGALTVFFTDEKVENYKQAQRSDGELFAKFFKLMLKQGINLAPSKYEAWFITLAHTEDDIAYTIDAVGKAFRQL

SEQ ID NO: 758 - protein, 450 aa, Silicibacter sp. TM1040
MTFEDLKEQIAAGQVDTVLVCIVDMQGRLMGKRFHAEAFLEMADGETHCCNYLLATDLAMATPDGYASTSWERGYGDYIMKPDLTTLRPVPWLEGTAMVLCDVIDHHTHAPVAHSPREMLKAQIARCEALGLSPVMATELEFFLFKGTHDEIAAGGFNKLEPISTYNEDYSIMQTSKEEPVMRPIRNHLRAMGLPIEGSKGEAEAGQEELNIKYDAALATADHHTIAKHGIKEIAHQQGFAATFLPKWHHERVGSAAHVHQSLWKDGGNAFFDESAPLGKSKLMDHYMAGLLKYAADYTYFMAPYINSYKRFAKGTFAPTQVVWSVDNRTAAFRLCGDGTKGVRVECRVPGSDMNPYLAQAAMLAAGLKGIEEKLELQDPFNGDAYAGDTQQHIPRSLLEARKALLGSEMLREAFGEDVITHYARAAEWEIEEFNRVVTDYEVARGFEKA

SEQ ID NO: 759 - protein, 462 aa, Oryza sativa
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLHDIAYFEFIPLKPVAGDGGYAEAEPVGLTEVAAGELYEVVMTTFAGNTRSSSSCMTLVAYYYLQSKKWMNICRFCISVHETSRNLVTCTFAATGHIMFAQK

SEQ ID NO: 760 - protein, 473 aa, Pseudomonas syringae pv. phaseolicola 1448A
MSSSSTSAAADPQGRQSASPNRLIFISVLVATMGALAFGYDTGIIAGALPFMTLPTDQGGLGLDAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLVGTFFVPPSPRWLASKGRFDEAQDVLEQLRTNKQDAQREVDEMKAQDEEARHRPKARELLRQGWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 761 - protein, 146 aa, Brassica napus
MSSGGTVRRVSRQDIQLAQNLIERCLQLYMNQKEVVETLLEQAKIEPGFTELVWQKLEEENREFFKAYYLRLMVKHQIMEFNKLLEQQVHHMQQMHPSGVAPVQNTNGSHIQSMNQKHLGYASEHTDQSLKSIPSSLSNAYLNGSS

SEQ ID NO: 762 - protein, 709 aa, Zea mays
MISHLFFSWQSSSSFVPDCEHSLKPVIGMSFDSLDELEGFYKTYAHECGFSVRIGAQGKKNDVVEHKRFVCSREGFTRRCAEAKNQKKHFETRCGCNARVYVRLGQDKRYYIASFVEEHNHGLVSPDKIPFLRSNRTICQRAKTTLFTCHKASIGTSQAYRLLQVSDGFDNIGCMKRDLQNYYRGLREKIKNADAQLFVAQMERKKEANSAFFYDFAVDEHGKLVYICWADATCRKSYTHFGDLVSVDATYSTNQYNMRFAPFTGVNHHMQRVFFGAAFLANEKIESYEWLFRTFLVAMGGKAPRLIITDEDASIKSAIRTTLPDTIHRLCMWHIMEKVSEKVGHPTSHDKEFWDALNTCVWGSETPEEFEMRWNALMDAYGLESNEWLANRYKIRESWIPAFFMDTPLAGVLRTTSRSESANSFFNRFIHRKLCFVEFWLRFDTALERQRHEELKADHISIHSTPVLRTPWVVEKQASILYTHKVFKIFQEEVIAARDHCSVLGTTQQDAVKFVVVSDGSMRDRVVQWCTSNIFGRCSCKLFEKIGIPCCHIILAMRGEKLYELPSSYILKRWETRCKRECVYDDDGNLLEEKPEDANEAEKRKKITVVRNKIEEAIQRAKSSNEAMDFLVSSVLNIGESLGHIVSSMVQPTQEEYENFIGCKIPADIQIHPPNDVRSKGRSKRIKRAKELPKSRKGKNARKDMEAPL

SEQ ID NO: 763 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 764 - protein, 384 aa, Synechococcus sp. RS9917
MRVSTAGSGDSQERMFTVVVLGLQSGRQRRAERRFTVGFSQLQATVRRITASGGTIQAVIPGAADGASPAPSSTPAAAAVTASAPKPAHKAVPVNLYKPKSPFIGTVTENYSLLAEGAIGRVQHITFDLSGGDPQLHYVEGQSIGIVPEGEDANGKPHKLRLYSIASTRHGDNYADHTVSLCVRQLQYEKDGETVNGVCSTYLCDIEPGSKVKITGPVGKEMLLPDDEDANVIMLATGTGIAPMRTYLRRMFEPKERELNNWHFRGKAWLFMGAPKTPNLLYDADFEHYQEQFPDNFRYTKAISREQQNSKGGRMYIQDRVLEHADEIFAMIEDPKTHVYMCGLRGMEPGIDEAMTAAAAAKGLDWSELRPQLKKAERWHVETY

SEQ ID NO: 765 - protein, 343 aa, Vibrio parahaemolyticus RIMD 2210633
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 766 - protein, 354 aa, Aspergillus oryzae
MASSRAAAQLMLPLRSVSRSIVSRSTHISMIKPFLAVVNSSISRGPAQCAHSVRHSSHSPMGATTTNPRKKVTLQTLRNLHKKGEPITMLTAHDFPSGHIAEAAGMEMILVGDSLAMVALGMEDTSEVVMEEMLLHCRSVARASKSAFTIADLPMGSYEVSPEQGLQSAIRIIKEGRMQGIKLEGGAEMAPTIKRITQAGIPVVGHIGLTPQRQNALGGFRVQGKSTAGALKLLKDAMAVQEAGAFMMVLEAVPAEIAAIITKKLRVPTIGIGAGNGCSGQVLVQIDMTGNFPPGRFLPKFVKRYADVWGEAFKGIQQYREEVKSRVYPSEEYTYPIPKEELAEFEKVVDKLDQ

SEQ ID NO: 767 - protein, 250 aa, Yersinia pseudotuberculosis IP 32953
MAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 768 - protein, 249 aa, Sulfitobacter sp. EE-36
MRRKLAAGNWKMNGTLAGLDMLADVAAAMDSTRAEAVICPPAPYLLPAVTKAQGTPVGIGAQDCHAEPKGAFTGDISASMIKEVGATYVIIGHSERRDAYGETDADVSAKARAAWDAGLTAIICIGESEADRSAGTTLDVIAEQLAGSLPDGCTGENTVVAYEPIWAIGTGKIPTLDQIVEVHDFIRATLAERFGTDVSDALRLLYGGSVKPDNAAEIFKVDNVDGALIGGASLRAADFVPIFQALAAT

SEQ ID NO: 769 - protein, 488 aa, Arabidopsis thaliana
MSSNDWPYPDYLWQLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGVISLFLLPFVNKIV

SEQ ID NO: 770 - protein, 344 aa, Xanthomonas oryzae pv. oryzae KACC10331
MAQTMKALVKRETNKGIWLEQVPVPTPGPNEVLIKLEKTAICGTDLHIYLWDEWSQRTIKPGLTIGHEFVGRVAELGSAVTGYQVGQRVSAEGHIVCGHCRNCRGGRPHLCPNTMGIGVNVNGAFAEYMVMPASNLWPIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLHKVLTHQLPIDDFQKGFDLMEAGKAGKVVLSWN

SEQ ID NO: 771 - protein, 509 aa, Ralstonia solanacearum
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 772 - protein, 512 aa, Ralstonia solanacearum
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 773 - protein, 150 aa, Lolium perenne
MAEQTFIMIKPDGVQRGLIGEIISRFEKKGFYLKGLKLQNVEKSFAEQHYADLSSKPFFGGLVEYIVSGPVVAMVWEGKSVVATGRKIIGATNPLASEPGTIRGDFAVDIGRNVIHGSDSVENARKEIALWFPEGLAGWTSSQHNWIYEA

SEQ ID NO: 774 - protein, 297 aa, Ustilago maydis 521
MKFTATTLAVLAAASAVAAEPLLGQLEQLGQQYAKKGQELAACAKAGFQLSCHASYDIPASSAGSCCFNGALVEGGKQSGLVLSTSFWTTNAADTANNGPKDSTTIHGLWPDYCDGTYPQFCSSVSGIPTYTGEQIEAVMQKYDPALYAYYQTYFKDLNGDRADFLAHEYNKHGTCYTTMRPQCQPQLPWISQADFAMLNYFRQIAHKFKERPTYNFLQAAGIVPSATQNYTLAQVQQTLKNAHGATPFVGCNKKGEMNEFWYFWNVRGQVNFGLFEPVESTTKSTCPASLRYLPKP

SEQ ID NO: 775 - protein, 508 aa, Cryptococcus neoformans var. neoformans JEC21
MSIPIPDRNRRQSVSASDPPNNIPIPANTRGIPVSSFAPHSPPTGTSPRNSSFSFSTSPSTSYLRNASGAFHGIARQLTAFLPPDYPTQENHEKRQGKTKILLLENINLDAADYLKSQGYEVDHVTKAYTEEELIAKLPNYHAIGIRSKTKITAKVIDANPQLLAIGCFCIGTNQVDLEHAAKRGIAVFNSPFSNSRSVAELVISEIIALSRQIIDRTHEMRAGIWNKLSKNCWEIRGKTLGIVGYGHIGSQLSVLAEAFGMSVIYFDVVPIMPLGSARQVDTLEDLLSRADFITLHVPEIPDTIGMMGAEQFSQMKKGAFFINNARGKVVDLSALCDALESDHLAGAAIDVFPKEPGSNGPGFNETLGDFIPRLRKIPNLILTPHIGGSTEEAQRAIGTEVSNALTRYLNYGTTLGAVNFPEVDLRAITAADERHIRVCHVHKNEPGVLRGINNILADHNIEKQFSDSKGDIAYLMADISGVGQEEVEGLYSAIKNTRSNILTRLLY

SEQ ID NO: 776 - protein, 330 aa, Oryza sativa
MMPEAALSSGKPMPRVGMGTASFPLGATDPSTVKDVVLRAIEAGYRHFDTAAVYQTEAILGDAVAEAVRAGLVASRDELYITSKLWVAHAHPGHVLPSLRRALRKMQMEYLDLYLIHFPVSMRLAEDPESMTYSKDDLVMMDMEGVWKEMEECQRLGLTKAIGVSNFSCKKLETLLSFATISPAANQVEVHPYCRQNKLREFCKEKGIQLCAYSPLGGKGTPWSNNAVMDCPLLKQIAMERGKTIAQVCLRWVYEQGDCVIVKSFNKSRLRENLGIFDWELTNDDRHKISTLPEWRGTLDIFVHKTGPYKTVDEFWDGEITGDKTFSNGP

SEQ ID NO: 777 - protein, 340 aa, Xanthomonas campestris pv. campestris str. ATCC 33913
MKALVKREASKGIWLEQVPVPTPGPNEVLIKLEKTAICGTDLHIYLWDEWSQRTITPGLTIGHEFVGRVAELGSAVTGYQVGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADLGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLQKVLTHQLSIDEFQKGFDLMEEGKAGKVVLSWN

SEQ ID NO: 778 - protein, 295 aa, Elaeis guineensis
MTYMFKYDTVHGKWKHHYIKVKDSKTLLFGEKQVTVFGIRNPEEIPWGETGAEYVVESTGVFTDKEKASAHLKGGAKKVIISAASKDVPMFVVGVNEHEYKSDIDIVSNASCTTNCLADLAKAINDKFGIIEGLMSTVHSITATQKTVDGPTSKDWRGGRAASFNIIPSSTGAAKAVGKVLPALNGKLTGMAFRVPTVDVSVVDLTVRIEKSATYADIKAAIKEESEGRLKGILGYTEDDLVSTDFIGDSRSSIFDAKAGIALNDHFVKMVAWYDNEWGYSSRVVDLIRAMDSKK

SEQ ID NO: 779 - protein, 163 aa, Oryza sativa
MEVGAKVPKKAGAGGRRGGGGPKKKPVSRSVKAGLQFPVGRIGRYLKQGRYSQRIGTGAPVYLAAVLEYLAAEVLELAGNAARDNKKNRIIPRHVLLAIRNDEELGKLLAGVTIAHGGVLPNINPVLLPKKTGSAAAKEAKEGKTPKSPKKATTKSPKKAAAA

SEQ ID NO: 780 - protein, 493 aa, Leptospira interrogans serovar Lai str. 56601
MFMVTELSCCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLLAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 781 - protein, 337 aa, Microcystis aeruginosa PCC 7806
MTTTSPKTLTMDIQKPRVLLIGKMYDEAGQKLLEESTNIEILSNPTPEEINEAIQEVSGVFVRYPNNLEASSIRLAKHLKVISTSGFGTDSIDIMAATEQGVIVVNNPGMSTTAVAEHTLSMILALAKKLPFLDHCVKKGNYLIRNQMQPIQLENKTLGIVGLGRIGTLVAHKCNLALGMRVLAYDPYVPASKAETVGATLLKDLDVLLAESDFVSLHTELTSETREMFNISVFKKMKPTAFLINTSRGKVVCEKDLGIALNQKLISGCALDVFEPEPPALDNPLYNFENVILSPHLAGVTPEASLAAAVSAANQILQVLRGEKPPYMINPEAWNLF

SEQ ID NO: 782 - protein, 287 aa, Streptomyces avermitilis MA-4680
MTQLSAAQKPSDSSKALYGGKGTRRITIRDITTAKERGEKWPMLTAYDAMTASVFDEAGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNAMGYRVQGRGEEAAQQLLRDAKAVQDAGAFAVVLELVPAELAAEVTRVLHIPTVGIGAGPETDAQVLVWTDMLGLTGGKVPKFVKKYADLREVMGNAAKAFAEDVVGGTFPLEEHSVH

SEQ ID NO: 783 - protein, 456 aa, Gloeobacter violaceus PCC 7421
MASTSGGVLRRSLGLIDGAALIVGITIGSGIFASPGRVVEQVGSVGMALAVWVVGGLLSLAGALCYAELGAALPVAGGEYAYLSRTLGRPLGFMFTWTQFFVMKTGSQAIISIVFASYLGSVLFGLDPRGAGVDGDWRIKAIAVATILLLTAVNCLGVRQGAVVQVVFTALKLLALAGIIAMGFAAFFQGGSSHFVDPFAGSIAAPSAFGLAMITCLWAYDGWNNLNYVSEELREPERNLPRAIVFGTLGVMAVYVLANVAYLSALTPAQMAGSRAVATNLAVQVIGPIGGVLVPIAVAISTFGSTNGSLITGARVFYAAARDGQFPRFFGYVSPRAVPAAALVAQGAWASMLVLPGDFGTLVDYFGFAAWLFYALAVVGLMILRAQAPDLPRPYKVRPYPLVPLVFLAASGFLIVNSLLTTPQSWFALGFMGLGLGVYFLFFRVPRVAVPTTSQP

SEQ ID NO: 784 - protein, 295 aa, Musa acuminata
MPFVYVSNNLFLINITETLQRTRKILDHLRQQINKGVPIIGAGAGTGISAKFEEAGGVDLIILYNSGRFRMAGRGSLAGLLPFADANAVVLDMANEVLPVVKRVPVLAGVCATDPFRRMDYFIKQVEATGFCGVQNFPTVGLFDGNFRQNLEETGMGYGLEVEMIHKAHELGLLTTPYAFNEDEAIAMTKAGASIIVAHMGLTTSGSIGAKTAVTLDDSVGRVQAIADAAVGINPEVIVLCHGGPISGPRETEYILKSTKGVHGFYGASSLERLPVELAITNTVKEYKSISIKRD

SEQ ID NO: 785 - protein, 606 aa, Clostridium perfringens SM101
MGKVYIYHDSQGTFYREPFGAVSVGSKVSLRLECKECGEVFIEVIKFDGSRYLIPMTIEERRNECIIYKGIIDTTNSLGVINYYFKYIKDGFTKYYGNNDECLGGEGKIYYDFPNYYQITVYEDNKIPSWYKEGIIYQIFVDRFFNGNKDSMILNKKKNSFIYGNWYDEPMYIRDSNGNIKRWDFYGGNLRGVIEKLDYIKSLGVNIIYMNPIFDAVSCHKYDTGDYENIDKMYGTNSDFNELCQKAEEKGIRIILDGVFSHTGSDSRYFNKYGNYGELGAYESKYSKYYNWYRFYDYPNSYECWWGFENQPNVEELEKTYSDYIVNSENSIIAKWLRLGASGWRLDVADELPDEFIQMIKERMKNEKEDSVLIGEVWEDASNKVSYSKRRKYLLGNELDSVTNYPYRDIISNFLNEEISSKDFYKVIMSIKENYPRENFFANMNILGNHDTERILTVLKENLNKLKLALCLQMTLPGVPLIYYGDEAGLLGNKDPENRKTYPWGRENKEILSYYSFFGNFRKNEEVLRKGDFYIFKDTPEDIIAFKRVYKDKEMIIIVNRSNSRKTITLDSEKRRYKDKFSKEEFYGDGSITLEVERENYKILTN

SEQ ID NO: 786 - protein, 445 aa, Musa acuminata
MEWQIQASLVDVSTSNKKIECLEDIPFISRDAILSCYMGVDEHPSYKLPGDRGKAIAVMGNALGCFLQKAYEDGNLVGAIGLGGSGGTSLIAPALRSLPLGVPKIIVSTVASGQTDPYIGTSDLILFPSVVDICGINSVSRLVLSNAGAAAAGMIIGKFLISDMSGQMAKKPTIGMTMFGVTTPCVNYAKERLEKEGFETLVFHATGIGGKAMEELVRAGLIQGVLDITTTEVADYIVGGVMACDNTRFDAIMEKNVPSVLSVGALDMVNFGAKHTVPSLFQHRNIYVHNDQVSVMRTNMDENKKFAKFIAEKMNKSSSSIRICLPQKGVSALDALGKPFYDPEATSVLINELDKLIEKNEDRQVMIFPNHINDPEFAEALVDSFLEIFKFSRSGTPQQTVRTPESQSLVNDILKGNYSDGTAIWRAPIVFPDAKPGFTLFLSNQ

SEQ ID NO: 787 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYVYMCGLKGMEKGIDDIMVSLAAAEGIDWIEYKRQLKKAEQWNVEVY

SEQ ID NO: 788 - protein, 266 aa, Aeropyrum pernix K1
MLGVGKIGGAIVKSLLSCGAVVTGTGRRRETLERISRLGAEATVDNRLAAKVSDVVILSVKPYQLPRLLEEIRDVMEGKIVVSVVAGVRLSTLSRALEGSHVYRAMPNINALIGRSTTAVAEYTGDKRASFVESILSCMGSVYWIPEEWMDVWTALVGSMPAYVAVMIDSLTLGGVSAGLPREVAFKAVIDTLGATAEHLGKRDIHPSVLRDEVTTPAGTTIEGLKVIEGEGVDAALIRTVEAAARRAAAIGEAIDNEVRRSLNLR

SEQ ID NO: 789 - protein, 269 aa, Roseovarius nubinhibens ISM
MKGYLMTKTILITGATDGIGLETARHLAAKGHSLILHGRSAAKLDAARDKIGGTTSGYLADLSDPAETLRLARDIARDHDAIDVIINNAGVYKIPDPVTKTGHDLRFLVNTIAPEILTRALLSTLGENGRVVNLSSAAQSPVDLEALAGRKRLADFEAYAQSKLALTIWSREMAAKHRNGPIFVAVNPGSLLASKMVKDGFGVAGKDLGIGVEILARAALSDRFALASGKYFDNDIGEFTPPHPAALDDQNSAKVYDQIVQLAKELGAA

SEQ ID NO: 790 - protein, 410 aa, Zea mays
  misc_feature (131)..(131): Xaa can be any naturally occurring amino acid
  unsure (1)..(410): unsure at all Xaa locations
MSKPWGGVGAWALDAERAEEEEREQVLAFPAPEPPAAAGGAASFPSLREAASAGGKGKSKKKNKGTTLSLSEFTTFGAAAAQRRAAPVEPKGLTHEEMMLLPTGPRERSAEELDRSRGFRSYGGGGGGGFXQAPVGERRGGFDDEGRRGPGRSSDLDMTSRADEADDWGATKKFTPAPADSGRRDRFRGTSPLGRADDIDDWSRDKKPLPSRYPSLGSAGGFRDSPGFRDSSASSDADRWVRGATPMPHNGQGAGERPRIVLNPPKRDPSTASTPPAEVARNRPSPFGAARPREDVLAEKGVDWKKFENEIDQKTSRPTSSHSSRPNSAHSSRPGSPGSQVSAVGSEGAPRARPKVNPFGDAKPREVVLQEKGKDWRKIDVELEHRAINRPESDEQRNLKEEINLLRVDL

SEQ ID NO: 791 - protein, 224 aa, Haloarcula marismortui ATCC 43049
MSRSEETAVDADSVADAVAAFARGEPVLIHDAADREGETDLVYPAGAVSPDAVARMRNDAGGLVCVALSDRVAEALELPFMQEVLSHPTAADHDLAYDERSSFSLTVNHRDTFTGITDDDRSLTIQELAAVAADPDPDAFSDAFRSPGHVHLLRAAPDGLADREGHTELALALAAAADQPEAAVVCEMLDDETGAALPPAAARAYAEREGLVYVEGASLLERFD

SEQ ID NO: 792 - protein, 400 aa, Burkholderia vietnamiensis G4
MAAVPRDRRARRRTAGARARSGRLSAGEPRGAVLAHPEARPADGAADQRRVPARAGRRLQRILLSLRPHAGTDGRGRTSEPAGFPRRPRAADRAHRHDARPQGILRQGRVDALTRAPPAVPPPFEPDFPMTYLQESSRPAITVPKLQAMREAGEKIAMLTCYDASFAALLDRAGTDVLLIGDSLGNVLQGHTTTLPVSLDDIAYHTACVARVQPRALVVADLPFGTYGTPAEAFAHSVALMRAGAQMVKLEGGEWLADTIRFLVERSVPVCAHLGLTPQSVHAFGGFKVQGRTEAGAAQLLRDARAIEDAGAQLVVLEAVPTLVAAEVTHMLKIPTIGIGAGLDCSGQVLVLHDMLGIFPGKRPRFVKDFMQGQPSIQAAVEAYVSAVKECTFPGPEHSF

SEQ ID NO: 793 - protein, 246 aa, Aspergillus oryzae
MAPQSIVLISGANRGLGYETAKNLLLSGNYHIIIGSRDCSKGDAAADSLRTLPGIHGTVSTIQLDVTDDQSVDDAKARIESDFGHLDVLVNNAGIYLLNQEAVRDALRLTLETNVTGAASLTEALLPLLLKSTNPRLVFVSSSNGSMTYNLDPNSPHGGTHATEHRVAKAALNMLLVQYHMKLKSVKVLGADPGFCATDVIGDADALRRMGATEPEVGAQIIASVVKGEKDDQPGRVHGPQGIVPW

SEQ ID NO: 794 - protein, 469 aa, Pseudomonas aeruginosa UCBPP-PA14
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 795 - protein, 256 aa, Botrytis hyacinthi
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFESKA

SEQ ID NO: 796 - protein, 377 aa, Ashbya gossypii ATCC 10895
MVSKTLPLYSKATLQKHTDRTSCWVSVGNRKIYDVSQFLDEHPGGDQYILDYAGKDITAVLKDKLIHEHTEAAYEILDESYLVGYLATEEEEIKLLTNEKHVMEVTPENLDTTTFVKELPAEEVLSVATDFGTDYTKHHFLDLNKPLLMQVLRGNFTRDFYIDQIHRPRHYGKGSAPLFGNFLEPLSKTVWWVVPMVWYPVVLYYLTRALQNMPAHLALTCFAAGVFVWTLIEYSLHRFLFHFDDNMPESNIAFTVHFLLHGVHHYLPMDKYRLVMPPALFVVLCAPFYRLVFSIFPEYCACGCFAGGLFGYVCYDVTHYFLHHHKLPPFMRKLKKYHLEHHYKNYELGFGVTSWYWDKVFGTYLASNSPVSRPKCE

SEQ ID NO: 797 - protein, 384 aa, Magnaporthe grisea 70-15
MPSLTLPSFTQAEVEAHNTNRSCYVTVGQNVYDVTDFLDAHPGGADLVLDYAGKDIGAILKDEDSHTHTEAAYEILEESLVGFLKPDKSFSNGKANGNGAAKGSSSGVDTPELVDAQGRPVHPRTGMSCEEDLNKETDYTGDYKKHKFLDLNKPLLMQVFLGGFSKEFYLEQVHRPRHYKGGESAPLFGNFLEPLSKTAWWVIPIVWLPPVAYGTYLASQGIESKLNLAALWCSGIALWTIIEYILHRFLFHLDKYLPDNRFAITLHFLLHGVHHYLPMDKLRLVMPPTLFFVLAFPFWKLAHFLFWYNWHVGTAIFCGGIFGYICYDLTHYFLHHKNLPLWYKDLKKYHLEHHFLDYENGFGVTSRFWDRVFGTEIVPLVKTK

SEQ ID NO: 798 - protein, 297 aa, Bacillus anthracis str. A2012
MVESCSNKVVAYKKCNDERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 799 - protein, 3487 aa, Microcystis aeruginosa PCC 7806
MVESIDYKKLMATTLSKMEVMQARINELETRQSESIAVVGMACRFPGGINSPEKYWSFCQAGLDAIVEVPKSRWDISKLYSQKPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDTACASSLVAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALADARIVPEDVSYIEAHGTGTSLGDPIELNAIASVYGKRSDPLYVASVKTNIGHLEAAAGMAGIIKTILILQQGEIPPHLHFQSPNPLINWQDHPIEIPTQNIPWPNNNKVPIAGVSSFGFSGTNAHVIVQQAPVSKISEIQQQIPSHLLTLSAHNKTALKELAKRFHTLLESHPEIGDICYSAAVGRIDLPERLAIVGDTCPELQQRLAAFAEENPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPTLLIGHSVGEYVAACIAGVFSLEAGLALVVKRGQLMQTTTSGKMASIFADEETVIYLIKNYTQTVSIAAINHPQQIVIAGESASIEEVISTCKKQKIPAQYLPVTQAFHSPLMEPILKEFEKEARQISYQRPQILLLSGLDGEVLENAPDATYWSKQCREPVRFLSSLITAFNKGYNLFLEVGPRPILAEQGRRYKDEVIWLSSLNRGLDNWQTILSALAQLYLNGAPFNPEQFNQNYGYKKVRLPNYPFQRKPFQFQPNPRTENQSIDKIFLDSQTSNLTDTETTVFNMQKHQQEIRNQLKSILALLLKEDENDLPEDETLLNLGADSIILTDFSRKVEEKFQVKVKIDQLFTDLQTLVDIAEYLCQFVKEKPLENTSEITTKVIDDETELSNYLQVIEQLQPIATAYIIKALESLGKKLNQGEQWTIENLRQTLPVARKYHILLNRYLQDLEEANILHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDHPYQILEIGGGTGATSEAILNHLNLDHITYSFSEASPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPSIPKFTVFGESSGKEALMMAQLQSLKDLKDLHEKTIIKQLEVLQTATVSPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIEAVQEQMNRGIGLGMQSNLAAETAALISEMGRVERVAFSNTGTEAIMAAVRIARSRTKRQKIVMFAGSYHGTFDGILARVGEDKTTTQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNEDIDRVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKSDHYLLSLKTHHIVADGWSLGLILQEIGQLYSSQNNTTKEVLTPPMQFRQYLTLRAQETQSPQMLEHRDFWLKTYQEELPTFELATDFPRPAVKTYTGGQESQVIPSEVGQNLQKVGRKNKATLFMTMFAAYTAFLRRISGHKDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFIAQVKLTPNTPALIAGKISLSYQELNEKVNRLTHYLQQEYQLGVGKVIGVMLQRNHYLIIGILATFKTGATYVPIDSQYPHSRIEFILKDSGCHVCLTESNFISKLPEKMEKICLDKIDPIVEKYDKDEPKIFRNSSQTAYIFYTSGSTGNPKGVMGRHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIISNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNYLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQSQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLLIDLFKNWLEQVLKFAHEPLINLSLASSENLIQEGQDMFTEDFNF

SEQ ID NO: 800 - protein, 149 aa, Geobacillus stearothermophilus
MAERTFLMVKPDGVQRNLIGEIVSRFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAEREINLFFKEEELLNYTKLLNEWLY

SEQ ID NO: 801 - protein, 115 aa, Elaeis oleifera
GQRECDYFMLCLQWPGTICKSTHHCCSSNGCCRSQPLTHFTIHGLWPNYNDGSWPACCSHSDFDIKKVSSLVPELEKYLAILVLQLSLSLLWWKRNVLGTLVGKAWDMFFPSNTG

SEQ ID NO: 802 - protein, 330 aa, Desulfovibrio vulgaris subsp. vulgaris str. Hildenborough
MDDRGRNGTRRRVLERLFEADGWCSGEELSRELGVSRAAVGKHVRALRAAGYVIEAVTRRGYRLDRTTAPFEAAEVLRGLATEVFGKVGLHWHESTDSTNRDAVALAVGGACEGTVVMAAQQLAGRGRTGRPWVSPQGGVYVSLVLRPRLSPQAAPLVTLMTAVAAAEAVEAVTGLMPEVKWPNDLLMAGLKVCGNLTEVGLVADMVDWVVTGVGVNVSTPAEALVDAGVAATSLQTECGRPVARADVARAFLERAEHWYGALREGDTGAVITRWKELSDIVGRHLRVRHGDELVEGRVADMTPEGWLCILAGNGTLHRLHAGDVIDSRV

SEQ ID NO: 803 - protein, 292 aa, Leuconostoc mesenteroides subsp. mesenteroides ATCC 8293
MEYKTLASDIKMPVLGFGVFQVQEKGAAKQAVIDAIKTGYRLIDTAASYGNEREVGEGIAEAIETGLVTREELFVTSKMWVQDVSADKAAAAIQASLDRLKLDYLDLYLLHQPYNDVFGAWRAMEAAYKAGQLKAIGVSNFDIAQLTNLAEFSEIKPMLNQIEANPFQQNKKDAAYFAEYGVQVEAWAPFAEGKNGLFSNELLQGIADKYNKSIAQVVLRWLTQRDIIVVAKSVKPERMAQNLDVLDFKLTDEEMQEIATLDTNISQFFDHADPDMIKWMAGREISYDVTAD

SEQ ID NO: 804 - protein, 88 aa, Glycine max
MSSSRTWAVAASVGVVEALKDQGLCRWNNALRSAQYQVKNHVRSLSQANKVSSSSSSAVVSSRLKEEGAKQSEESLRTVMYLSCWGPN

SEQ ID NO: 805 - protein, 597 aa, Gibberella zeae PH-1
MTVNKRTKQWWKQATIYQIYPASFCDSNGDGMGDLQGIISKLDYISSLGVDVIWVCPMYDSPQVDMGYDISNYEDVYAPYGTLQDMEELIRKTHEKGMKIMLDLVINHTSDKHAWFEESRLSKDSPKRDWYIWRPAKYSPDGQRLPPNNWRSNFGKGSVWEWDEATGEYYLHLFAKEQPDLNWENPETRRAIYASSMEFWLDRGVDGFRVDTVNMYSKIQDFPDAPIVDLKAEYQPAGLLYCNGPRMHEFLSEMSEVLERYGAITVGELPHTPDLERVLRYVSAKEKQLNMVFQFDVVDVGFGKTHKYETTPRNYTLPQLKDAFGRTQSLIHGTDAWTTVFMENHDQARSVSRFTNDSPQYRVAGAKLLALLQSCLSGTQYVYQGQEIGSVNAPKESYPLENYVDIESYQFLDIVKERSNNDEQEIDKAFNALQHLARDHARIPICWSDSKHGGFSEAAEKAGLPIKKPWMQAHPLSQEVNVASQLDDPQSVLSFWKKAISFRKEFPDLTVYGDYKVIRQDDPDIYAFVKESLADGSKVAVVLNFTTENKAWSAPTSEELGVHSGKDIKLVPIMSTHSGKEKTAVLSPFEGRVYLVT

SEQ ID NO: 806 - protein, 453 aa, Streptomyces avermitilis MA-4680
MDKQQEFVLRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALAKTSDLGFTFYTHPEIEFFLLKDKPLDGSRPTPADNSGYFDHTPQNVGMDFRRQAITMLESMGISVEFSHHEGAPGQQEIDLRYADALSTADNIMTFRLVMKQVALEQGVQATFMPKPFSEYPGSGMHTHLSLFEGDRNAFYESGSEYQLSKVGRSFIAGLLKHAAEISAVTNQWVNSYKRIWGGSERTAGAGGEAPSYICWGHNNRSALVRVPMYKPGKTGSARVEVRSLDSGANPYLAYALLLAAGLKGIEEGYELPPGADDDVWALSDAERRAMGIEPLPQNLGEALALMQRSELAAETLGEHVFDFFLRNKKQEWEEYRSEVTAFELRKNLPVL

SEQ ID NO: 807 - protein, 512 aa, Magnaporthe grisea 70-15
MDFVIDGWGVASEESPKNGDAIAAAETPVMDEFARSKTGYVELEASSLAVGLPEGLMGNSEVGHLNIGAGRVVWQDVVRIDQSIKTGEFSKNEVITQVIEAAKSGNGRLHLCGLVSHGGVHSKQEHLYSLLKAAKEAQVPKVFIHFFGDGRDTDPKSGVGYMEELLEKTKEIGIGQIATVVGRYYAMDRDKRWERVELAMKGLVLGEGEASEDPVKTVKERYEKGENDEFLKPIVVGGDEGRIKDGDNVFFFNYRSDRVRQITQLLGDVDRSPRPDFPYPKIKLATMTRYKLDYPFDVAFEPQKMGNVLAEWLGKQNVPQVHVAETEKYAHVTFFFNGGVEKAFALEERDESQDLVPSNKSVATYDKAPEMSADGVADQVAKRLGEQKFPFVMNNFAPPDMVGHTGVYEAAIVGCAATDKAIGKIYEACKAHNYVLFITADHGNAEEMKFPDGKPKTSHTTNKVPFIMANAPEGWSLKPVGGVLGDVAPTVLACMGLPQPEEMTGENLLVKA

SEQ ID NO: 808 - protein, 116 aa, Triticum aestivum
  misc_feature (52)..(52): Xaa can be any naturally occurring amino acid
  unsure (1)..(116): unsure at all Xaa locations
MASEQTFIMIKPDGVQRGLIGEVISRFEKKGFYLKGLKLQNVEKSFAEQHYXKIIGATNPLASEPGTIRGDFAVDIGRNVIHGSDSVESARKEIALWFPEGIAEWRSSQHNWIYEA

SEQ ID NO: 809 - protein, 271 aa, Campylobacter fetus
MRKIGKILKKVTINDLFMMKNREKIVMITAYDALFARLFDDYVDMILVGDSLNMSFGGKNETIGLSVDDMIYHTKAVQNGAKKAFLVVDMPFGSACTPQIALKNAIKIYKKTGCDAVKIEGTKEMADTIKLLSQNGIIVMSHIGLKPQMSRFEGGYKIKGKDELSAKSILEDAIVLESAGASLFLLEGIVSSVASEISQKLKVPTIGIGSGASCDGQVLVWSDAFGFFDEFKPKFVKRYLEGATLIKNSLKEYADEVKNSKFPSSQYEYTK

SEQ ID NO: 810 - protein, 431 aa, Thermus thermophilus HB27
MRIVPFGAAREVTGSAHLLLAGGRRVLLDCGMFQGKEEARNHAPFGFDPKEVDAVLLTHAHLDHVGRLPKLFREGYRGPVYATRATALLMEIVLEDALKVMDEPFFGPEDVEEALGHLRPLEYGEWLRLGALSLAFGQAGHLPGSAFVVAQGEGRTLVYSGDLGNREKDVLPDPSLPPLADLVLAEGTYGDRPHRPYRETVREFLEILEKTLSQGGKVLIPTFAVERAQEILYVLYTHGHRLPRAPIYLDSPMAGRVLALYPRLVRYFSEEVQAHFLQGKNPFRPAGLEVVEHTEASKALNRAPGPMVVLAGSGMLAGGRILHHLKHGLSDPRNALVFVGYQPRGGLGAEIIARPPAVRILGEEVPLRASVHTLGGFSGHAGQDELLDWLQGEPRVVLVHGEEEKLLALGKLLALRGQEVSLARFGEGVPV

SEQ ID NO: 811 - protein, 425 aa, Chromobacterium violaceum ATCC 12472
MSRNLELFERGKQVIPGGVNSPVRAFGQVGGTPRFVARAEGAYFWDADGKQYLDYVGSWGPAIVGHAHPEVVKAVQDAAVGGLSFGAPTEGEVVIAEEICKLLPSVEQVRLVSSGTEATMTAIRLARGFTGRDLIVKFEGCYHGHSDSLLVKAGSGLLTFGNPSSGGVPADFTKHTLVLQYNDVEQLSRTFAEIGDKIACVILEPIAGNMNLIQPSREFVQALRQLTEKHGAVLIYDEVMTGFRVAKGCAQGLHGVTPDLTTLGKVVGGGMPLAAFGGRADIMGKIAPLGTVYQAGTLSGNPLSVAAGLATLKLIQQPGFYETLGSRTARLAQGLAEEARKAGVTLSTDSVGGMFGFYFSDKAPKSYAEATGCDIERFKRFFHAMLDEGVYFAPSAYEAGFVSAAHSEQMIESTLAAAGRAFARL

SEQ ID NO: 812 - protein, 188 aa, Triticum aestivum
  misc_feature (40)..(40): Xaa can be any naturally occurring amino acid
  unsure (1)..(188): unsure at all Xaa locations
RIITHKESEQAQSWSKIYSEDTKEQSIPVITAWQLNERMXRVCLLLLLFSLPVRFGKEQVHEWRRSYDTPPPNGESLEMCADRAVSYFKDQVVPHLTAGKHVMVAAHANSLRSIIMHLDKLTSQEVISLELSTGIPMLYIFKEGEFIRRGSPVGPSEASVYAYTRVRVYSIFYPSTEQFVSTVYIKTN

SEQ ID NO: 813 - protein, 283 aa, Myxococcus xanthus DK 1622
MESPRDILKRHGLRAKYSWGQNFLGDEDALEAIADALNLRADEPVVELGPGLGHLTRFLAATGARVTAVERDRDMVMVLEKEAIPGVRVVSGNAATVDFAQVAGAPDVAVAGNLPYHLTSPILFRVLEQRAHVSRAVFTLQKEVVERLAAEPGNRDYGLLTVLLGMHYDAENVLTLEAWRFHPPPKVDSAVLRLTRRKSPRAPIIDEARFTRVVKASFAHRRKTLINSIKSDPTLGTTETLIAALEAAGVDPQRRAETLTPEEFAAIERALGPLTPATSTPAE

SEQ ID NO: 814 - protein, 283 aa, Candida glabrata CBS 138
MTYTLTILGCGVMGQAVLSAIYKAPKATSVIKALYPSKIITCNHDEPSAQQVTDLISTFETSPNGIEVVSTYGKNVEAVKQSDVIILGTKPFLAEQVLNGVKDVTSGKLIISLAAGWTIGQLQAYTPSVSRVMTNTPAKYGYGCAVVSHSPQVTEDQKSLVSELISHVGKYVELPEKNMDAATALVGSGPAFVLLVLESLMESGIKMGIPLKESTECALKVLEGTAKMVEESGVHPSVLKHQVCTPGGTTIAGLCVMEDKGVKSGIIRGVEEAARVAAELGKK

SEQ ID NO: 815 - protein, 571 aa, Glycine max
MLEKVEEFNMDKVIQEFELLTRDAERVQRETLKRILEDNASAEYLQSLGLNGRTDPESFKACVPMVTHKELEPYIYRIIDGDASPILTGKPITTMSLSSGTTQGKPKYVPWNDELYETTMQIYQTSFAFRNREFPIKNGKALSFIYGSKQLKTKGGLAARTATSNVFCSAGYKCAMRALQSQCCSPDEVIFGPDFFQSLYCHLLCGLIFREEVEFVSSTFAHSIVHAFRTFEQVWEELCNDIREGVLTRNVTVPSIRMAMSKLLKPNPELANAIHKKCTGLSNWYGLIPELFPNAKYIYGIMTGSMEPYLKKMRHYAGELPLLTADYGSSEGWIAANVNPQLPPEYATYAVLPHIGYFEFIPLLELENTKPLGLTQVKVGQEYEIVMTNPAGLYRYRLGDVVKVMGFHNSTPELKFIRRSSLLLNINIDKNTEKDLQLAVEAAGKLLAEEKLEVVDFSSQVDLSKEPGHYVIFWEISGDASQELLHECCNCLDKSFVDAGYTSSRKVNCIGALELRLVRRGTFQKILDHYLGLGTAVSQYKTPRCVGPTNTRVLQILSENVVNNYLSTAFN

SEQ ID NO: 816 - protein, 390 aa, Burkholderia vietnamiensis G4
MNAPSDMPTAPVFPSRLPNVGTTIFTVMSALAAEKGAVNLGQGFPDFDCDPRIVDAVAAAMRNGHNQYPPMAGVASLRDAIADKIEHLYGRRYDAATEITVTAGATQALLTAILCAVHPGDEVIVIEPTYDSYLPSIELAGGKPVFVTLDAPDYAIPFDRLAAAITPKTRMILINTPHNPTGTVWREADLRRLEEIVRGTNVLILSDEVYEHMVYDGARHESVARYPELAARSFIVSSFGKTFHVTGWKIGYVAAPAALTAEFRKVHQFNVFTVNTPMQVGIADYLRDPAPYLTLPDFYQKKRDFFRAGLERTRFKLLPCTGTYFQCVDYSAISDVSEAEFAKWLTAEIGVAAIPVSAFYHAPHESGVVRFCFAKQESTLASALERLARL

SEQ ID NO: 817 - protein, 455 aa, Francisella tularensis subsp. holarctica
MSFIPHKLEQIKKMLDTIGASSVDQLFDEIPRHLRADTLNIKDGINEIQLANLMRKRANKNHHNINYIGAGAYSHHIPAAIWDIVARGEFYTAYTPYQAEASQGGLQVIYEFQTMMAGLTGMDASNASMYDGATALAESVLMAIRSNKKAKSQKVLIAEALHPTYLRVLETITKHQGIEFDIVNLDSKNGKTDVTKLEDFANTNYAAVVIQSPNFLGQLADVDGITNWAHKHGALVIAVTNPMSLAILKSPAEWGDNGADIVCGEGQPIGVPLASGGPYFGFMTCKMAHVRQMPGRIVGRTVDLDGNEGFCLTLQAREQHIRRAKATSNICTNQGLMVTAATIYMSLLGAEGLERVASISHENTQTLATELAKINGVSIRFNSAFFNEVVIDLPVNAETFVTEMEKEAIDAGYFLGEYHSDLANSIMVCATEIHTSEDIKEYIEATKKVLARIGG

SEQ ID NO: 818 - protein, 331 aa, Saccharum hybrid cultivar H65-7052
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 819 - protein, 92 aa, Brassica napus
  misc_feature (32)..(33): Xaa can be any naturally occurring amino acid
  misc_feature (62)..(62): Xaa can be any naturally occurring amino acid
  misc_feature (77)..(77): Xaa can be any naturally occurring amino acid
  misc_feature (79)..(79): Xaa can be any naturally occurring amino acid
  unsure (1)..(92): unsure at all Xaa locations
MAIRLSRVINSKQSQKQQPRVPKGHVAVYVGXXMENKKRFVVPISYLNHPSFQGLLSRAEEXFGFNHPIGGLTIPCXEXIFVGLLNSYGCIL

SEQ ID NO: 820 - protein, 256 aa, Botrytis paeoniae
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSSKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNNSSIFDAKA

SEQ ID NO: 821 - protein, 256 aa, Botryotinia pelargonii
AYMLKYDSTHGQFKGDIKVLADGLEVNGKKVKFYTERDPANIPWAESEAYYVVESTGVFTTTEKAKAHLKGGAKKVVISAPSADAPMYVMGVNNETYTGDVDVISNASCTTNCLAPLAKVINDEFTIIEGLMTTIHSYTATQKTVDGPSAKDWRGGRTAAQNIIPSSTGAAKAVGKVIPVLNGKLTGMSMRVPTANVSVVDLTVRIEKGASYDEIKAVIKKAADGPLKGILAYTEDDVVSTDMNGDNHSSIFDAKA

SEQ ID NO: 822 - protein, 457 aa, Frankia sp. CcI3
MTRVVARARVAELAARESARLDVRTRGSEALHARAVRSMTSGVPSSYQVRDPWPIYLTRGLGSKVWDVDGNEYSDFHNGFGSMVQGHAHPAIVRAVTERVALGTHFAMPTEDCVVVSEELARRFGLPQWRYVNSGSEATMDAIRIARGVTGRDTIVKIFGSYHGHHDYVMVSIGTPYDDIGPAENMNSLGYGAGIPRVVVDLTVPVPFNDAPAMERRIAALAAEGRLPACVIMEPAMMNLGVVLPEPGYLAAVREITSRYGVILIFDEVKTGLCVAAGGATERFGVRPDLVTLAKALGGGLPSGAIGATAELMEAVASDRVKQVGTYNGNPLTMAAARASLFEVLTPDAYTHLDRLGGRLTAGCDEILTRHGIPGYTVGISSKGCVHFTDAPIRDYTSFMAHQNAELPELAWLYNANRNVLMAPGREEEWTLSVQHTDADVDRYLDSLDQMARDLVG

SEQ ID NO: 823 - protein, 200 aa, Zea mays
LIPRVLTRAQVTLGNILKESGQEGIPVNKTWRLNERHYGSLTGLNKSETAAKYGEAQVQIWRRSFDTPPPPMEPDHPYYNTIVKDPRYAEGPSEAEFPMFESLKLTIARTLPYWNDVIIPQLKEGKSIIIAAHGNSLRGIVKHLDNLSDDAIMALNLPTGIPFVYELDENFKPVVSMKFLGDEETVRKAIESVAAQGKAK

SEQ ID NO: 824 - protein, 561 aa, Ustilago maydis 521
MNSKAAQDRQQRILLDLVRQPGNDVCADCKGRAPRWASWNLGIFICVQCAGVHRKMGVHISKVKSITLDTWTREQVDRMKEVGNLKSNRKYNPDEMRNRPPTNMEESERDSELEKYIRRKYEFRRFVEGRPPPVPSKDATFLTSPSGSVEYSHAPRSPVEPISSSQSSSSLAQGSSIARSRTAPIPSTWSEAQQRVKANAPPLPNPTAAGYRAASGSQINGTSALSTRSTALTQSSLQLPGASVPLRTTSALNTRDGGQIASASKPTTPTVQSSVFDDLISLNESSQPTATQPPLQMNPWASLQAQQQAVLSAPAIQEPTGLFWAGQPSPNGVASPMAPFGISPSNNNMTFDPVRNTPQHANTMPSLSVSSAQNPLSSQATGMLSASNGGMYSQFEQQRSVGLGSMAFSTSPLPSPGFAPSNPFNATQSNSAAPLPQTAGFVGVNSLFQHQPQQLGQVAFQGQANILAPNQAFYGQQQYSIQIQPASNGVGHFQSSMMPNGFGQAQFGTSHLMQQQQRQQQQQQQQQQQQQQQQQQQQQQQQQQQQQQQQQQNTQQFGQRP

SEQ ID NO: 825 - protein, 140 aa, Magnetospirillum magnetotacticum MS-1
MAIERTLSIIKPDATRRNLTGKINARFEEAGLRFVAQKRVQLTKAQAQQFYSVHAERSFFGELVDFMISGPVVVQVLEGEGAVARNREIMGATNPANAAPGTIRADFAESVEANSVHGSDSAENAAIEIAYFFAGSEIVG

SEQ ID NO: 826 - protein, 508 aa, Mycoplasma pneumoniae
MIHHLKRTKIIATCGPALTKKLWTLAMLDDPAYAAMKAEAYANIENIIKNGVTVIRLNFSHGNHEEQAVRIKIVRDVAKKLNLPVSIMLDTNGPEIRVFETAPEGLKILKDSEVVINTTTKEVAKNNQFSVSDASGTYNMVNDVKVGQKILVDDGKLSLVVKRIDTKNNQVICVAQNDHTIFTKKRLNLPNADYSIPFLSAKDLRDIDFGLTHQIDYIAASFVNTTENIKQLRDYLASKNAKHVKLIAKIESNHALNNIDGIIKASDGIMVARGDLGLEIPYYKVPYWQRYMIKACRFFNKRVITATQMLDSLEKNIQPTRAEVTDVYFAVDRGNDATMLSGETANGAFPLNAVYVMKMIDKQSETFFDYQYNLNYYMANSKARHSEFWKQVVLPLAQKTAPKRKLINSDFKYDFVVHATNNLNEIYALSNARLAAAVIILTNDPQVYTGHGVDYGIFPYLIDQKPQSLSKAEFKSLANVAIKHYQQHGEISQLKQCLGVFHNKIISL

SEQ ID NO: 827 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 828 - protein, 454 aa, Geobacillus kaustophilus HTA426
MEHSRPSLQKGLLPRHVQLMALGGMIGTGIFKGSAEAIHIAGPSVVLTYLIGGVLLFWIMAALAEMAIAYPGSNVQHLIRRAFGFRLSWIVGWLYWINWTLVTVVELLAAGSFLNYWVPSAPLWLLALLCACLIMGLNLFPVKYYGEAEFWLAGLKVAALVVFIVLGACVWAGVIPSGISGSFPSAGDGGWFPHGFAGTLSALLIVMFSYGGAELIGVAVTEMKDAEQVLPRVIRTTIWRVVGFYLLPMAIICGIMPWNTVSETNSPFVQVLEAIGLPGAAHVMNAVLLIAVLSAANTGVYATSRLLYTMAEQGEASRRLQRTTKHGVPLYGMGMVAICIAAGVIGAYLAPGRIIGELMTIPGFTVLIVWMMIGAAQLKLRPHYKTKPFFRTKGFPYTTMAAVGALGAIWLGFLLQREHRIGSLLCVAVLVLLFIYSTVKEKQHQATKAPGRTA

SEQ ID NO: 829 - protein, 489 aa, Escherichia coli K12
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 830 - protein, 583 aa, Ricinus communis
MSQSLHFSPNLTFAKQPFPKLPLPFPTSNSRYPVNNYKSLSIKASTSPSSSSDPQVLVADNGTGNSGVLYNNNNKSVTVSDPSSIEVDAVTETELKENGFRSTRRTKLVCTIGPATCGFEELEALAVGGMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 831 - protein, 481 aa, Francisella tularensis subsp. holarctica
MVIFEKTRGKNSPSVMPSKKGDVSNIPTDMLRTKKPILPEQAELDVVRHYTQLSRKNFCIDTNFYPLGSCTMKYNSRAAHKYASLAGFLERHPYASAQSVQGTLECLYDLQNLIKELTGMTGVSLAPMAGAQGEFAGVAMIKAYHHKRSDFERDEIIVPDAAHGTNPATAKVCGLKVIEIPTKKDGDIDIEALDKVLGPKTAGIMLTNPSTVGVFERNIAVIAKKVHEAGGLLYYDGANLNAIMGKARPGDMGFDVLHMNLHKTFATPHGGGGPGAGPVAVNDKLKEFLPVPMVGKKDDKFVWLEEKDVSNTIGRLSAFNGNIGVLIRAYIYGAMLGGNGLTEASEIATLNANYMMTRLKEEGFTIAYPDRRASHEFIVTLKPEFLNYGVTATDFAKCLIDKGVHAPTMYFPLLVPECLLIEPTETENVDSMEKFIQAMVEIRDIAKKDPQYLKGAPYNLPARRLDDVKAAKELDIVWQPK

SEQ ID NO: 832 - protein, 286 aa, Mesorhizobium loti MAFF303099
MATKLPTTDIRIGAELIRRRKGGVPLVCLTAYTYPVARLLDPHVDLLLVGDSVSMVLHGHATTLGASLGMMIAHGQAVMRGSARACVVVDMPAGSYEDSAAQAVASARRIVDETGCQAVKLEGGVDMAGQIAAIAAAGIPVMGHIGLLPQSVEKDGGYKIKGRTDETVAALMADARAVEKAGAFSVVIEGTIEAVAADITRRIAIPTIGIGASGDCDGQILVIDDMVGLTVDRVPKFVKEYADLRSVIANAAERYAAEVRDRTFPGPSHVFSGSKASSDLNGGDES

SEQ ID NO: 833 - protein, 217 aa, Lycopersicon peruvianum
MIKPQLMSVLFLFLFVFSPVCGDFDYLQLVLQWPRSFCKTRYCPNPVPRNFTIHGLWPDKQRIMPINCPAKESYKSITDSKKIKLLEQHWPDLTSNQGSAEFWRYQYKKHGTCSVDLYNQEQYFDLAIELKEKFDLLKTLKNHGITPSKTNTVIDVEEAIKAVTKEVPNLNCIGDSSQTMELLEIGICFNREGTTVIACRRRWINHPNGNQKITLPP

SEQ ID NO: 834 - protein, 414 aa, Arabidopsis thaliana
MDPGDPTSIIFSKIRTFELENASRVIDYFLLQDMEQRDLIRIAFGPDSLIQTFCQKAKVDLGFSSNGFSRPINIHGQSLSSSSPRNGFLEFSRNPSNPLSSSLTLNTLRDNKPNFNSSPFRESSSLFASSSGDEQQQQQFSNNFLFTNDEDPFANSHKRSFSANDACFESEEPWFGGGNGCHQFPQGGLVDGFGSSGVFGSPSEMDYMLEGMMRMKLAQQKSMVAAQFMAACGSPMLHRHGSGHFGEECGNYFSQGRHEREDSVSKQIYLTFPSESSFTDEDVSTYFRDFGLVDDVRIPYQQQRMYGFVTFAKAETVRTILARGNPHFICDSRVLVKPYKEKGKILQKRQQQQLHELLERGNYSPSSSPSGKDSRELYECRLGPRMFSKKTQEMLRRKTEQADLQHAIEVELQR

SEQ ID NO: 835 - protein, 326 aa, Gluconobacter oxydans 621H
MSAPQHDLLCIGNAIVDVLAPVGQDLIDGLGAAAGSMTLIDAPTAHAIESRVDIENVTGGGSGANTAVVAARMGAKVAYLGKVTADEAGDHFTRDIREQGITFPSEPLPAADGTPTARCIVLVTPEGQRTMFTYLGACTEFTPQDVHESVVADAAITYLEGYLYDKPQAQEAFEHAARLARKANRQVALTLSDTFCVERHRAAFHELVAGHVDILFANEAELLALYEVTDFEEAVTQVSAETKLAVITRGEKGAVVIGDGERHDVPTTEVKVVDTTGAGDAFAAGFLAGLSKKHDLVTCAKLGNQAAGEIITRYGARPTEAFTLTA

SEQ ID NO: 836 - protein, 356 aa, Sulfurospirillum multivorans
MNAILSDQKTFQAIIRVNQAIEDIRQGKMVVMVDDEDRENEGDLVYAASFSTPQKVNFMASHAKGLICVAISKKIANRLQLEPMVKKNDSSYETAFTITVDARTAATGISAGERDMTIKILADGGSHESELVRPGHIFPLIAKEGGALVRIGHTEGSVDLCRLAGQGDSAVICEIMKEDGTMARRPDLDIFCAKHELNIVYISDIVEYRMMNESLIRVIAESTTQFLGKDARRYDFVDHNDNHHIAYAFGNIKNRSAVKFHSIMPDNELLADTKKYNSLIQAIHYLQKSGGVLIFMDNGTQDMSKIREYGIGAQIIKHLGIENIELLSDSKNKEFVGISGFGLSVIKSTNVNETVA

SEQ ID NO: 837 - protein, 757 aa, Francisella tularensis subsp. holarctica
MNEKNQIKLHLEKILNCDVSAANDQDLYYALLTYAKDQTAKLPEQDYKKKIYYISSEFLIGKMLISNLINLGVYNEVCQILKESGKDIVQIEEFEPEPSLGNGGLGRLAACFLDSIASLGIPGTGISLNYHYGLFKQKFKNHCQNEKPNPWIEKLGWLNKKDTSYKVDFNDFSVESQLYEIDVVGYQNNFVNKLCLFDITSVDASVIEDNITFDKTAIEKNLTLFLYPDDSDEAGHLLRIFQQYFMVSNAVSLIFSDITKKGYSLANLPEHAVVQINDTHPTLVIPELIRQLVANGIDIDKAIELVSKTAAYTNHTILAEALEKWPLRYLEKVLSKEIIDIIKYLDKKVKQQYKQADLAIIDANNCVHMAHICIHYSFSVNGVAALHTDILKKAELKHFNEIYPNKFNNKTNGITFRRWLLQANPELTNYLKSLIGDSFVQDSKQLEKLLAYHNDKNVLAKLDEIKKTKKAQFIEFASYYSGVELLENGIFDVQIKRIHEYKRQQMNALYIIHKYLEIKSGLYPKPERPINFIFGGKAAPAYIIAKDVIHLILCLQELINNDADVNQYIRVLFVENYNVSIAEKLIPAADISKQISLASKEASGTGNMKFMLNGAITLGTMDGANVEIADLVGSANIYTFGKDSNTIIDLYKTSGYKAIEYYNNPVIKNAVDFITSPTMLAIGDKNKLTRLFNELINKDWFMTLIDFVEYIKVKDKMLRDYENREDWLRMSLVNTAKSGFFSSDRTIGQYNKYIWKI

SEQ ID NO: 838 - protein, 578 aa, Oryza sativa (japonica cultivar-group)
MEEVRGRESKDHRGGGGGGGGDGDGERTGRWRAEEVIAGNRAVLEALRELVMYPVLYAREARVLGLNFPRGLLLHGPSGTGKKSMVRAVVRECNAHLTVIDSISVHKPHAGEGEKFMREAFTEAYSQASQGRPAVIFIDELDDICPPRGSRREQGSRIVGQLLTLMDGKSSKLLPHLVVVASATRVDAIESALRRPGRFDSEIEVTVPTAEERFEILKLYTKNLHLGECVDLQSVAASCNGYVGADLQALCREAARRAYGRLSSSSESENVLTLIMEDWESAKSVAKNSVTRGVTKEIPAVSWDDIGGLKAVKKKLQQAVEWPIKHAASFDRLGISPIRGVLLHGPPGCSKTTLAKAAAHAAQASFFSLSGAELYSKYVGEGEALLRRTFQMARLASPSIIFFDEADAIAPKRTGPSGNSSGNATVGERLLSTLLTEMDGLELATGIIVLAATNRPNAIDAALLRPGRFDMVLYVPPPDAEGRYEILRIHTRKMPLGDDVDLWKVAERTELFTGADLEGLCREAGMAALRESLRSERFVCDDIHFQAALRSLRPSLTQSVVDEYSNAAIHGPLTRRKH

SEQ ID NO: 839 - protein, 270 aa, Burkholderia vietnamiensis G4
MKIAFIGGGNMAAALIGGLVKRGVAADGLYAIDVNEDVRARAAQQFGIRTGAAVDATLADYDAIVLAVKPQVLKEVAQALAPHLKSQLVISIAAGIRGADLARWLGGYTRVVRTMPNTPALVGMGVTGLAALPGVDATGRELASSVLGAVGEIVWFADEVQLDAVTAISGSGPAYVFYFIEALQEAARRLGLNDEQGRALAVATFAGAAQLAAQSGEPASVLRERVTSKGGTTAAALASFDAQQVKEAIVRGALAAHARAQEMGDELGRA

SEQ ID NO: 840 - protein, 252 aa, Hordeum vulgare subsp. vulgare
MAFRRALLCLLGMLIASSAIAVSDSGIYYQIGLMWPGAYCVQTTGGCCMPKSPIVPAADFYVSGFTVLNATTDAPETSCSSTPFNSDEILGISGLRQYWSNIKCPSNNGQKSWKSAWKTSGVCSGLDDKAYFQAAIALRSKINPLSRLVSKGIKPDFGLYSLEKIKKAIQAGTGVAPLIQCSKGPFDKFQLYQIFICVAEDAKTLIECPKPQKFTCSDEILFHPFKKWMLKQAASSVSFAEAFEMAGAAMGY

SEQ ID NO: 841 - protein, 392 aa, Zea mays
MAMSGTFHLTSDYVPGYTLSDSRCFFNSAVSRRTLAILPCSSCLDHKNGRLKSVPNRSSFVCRASSGGYRRNPDFSRLNKHGYRGNNRQSGGREDFDIENSDMLSSRNGPLFNLSSSPKFQATSSPGPREKEIVELFRKVQAQLRARAAAKKEEKKIEEASKGQGKESETVDSLLKLLRKHSGEQSKRQVSKFSSQGEVQGDTVDKQDRTGNLVTSGNKDNNASSFTRPTSSFRRKSPVPRSQSPPAYSSEATFDQSSSYSVTWAQKKDTVELHDEPEHEPAYEHEHEPENESEPGPVTTMLEPDSELKPKSSSFYQEEEEERERERELPSPPPPPRCVSPIFPLASLPFTQKWRNRRITRRTISLPRRIRTESRSQGDTVTHQPEEWILNS

SEQ ID NO: 842 - protein, 612 aa, Triticum aestivum
  misc_feature (170)..(170): Xaa can be any naturally occurring amino acid
  unsure (1)..(612): unsure at all Xaa locations
HASEMGLELSLSRLKALAKFAFGIGLPQVLLSTLAFAAFELPPNGAIGTRILQFLFNSRPDLVNIRSVDEAIVIGAALSLSSSAFVLQLLAEKGELATRFGSATLGILLLQDIAVVPLLVILPVLESQNVVEQSVWPTRPAESLKALGGLGILSLGGKYLIRRIFEPSCXFVAESRSSEAFVALCLLTVSGTSLLTQWLGFSDTLGAFLAGPLLPGPGRRTQIEADIRPFRGLLLGLFFVTTGTSIDMQLLIREWPNVLSLLAGLIAIKTLITTALATRVGLTFQESVRIGLLLSQGGEFGFVVFSLANRLGVLPLELNKLLIIVVVLSMALTPLLNDLGRKAAGIIDERSETKEVKPAEEANYGATEPIVILGLGEMGQVLAKFLAAPLSFGLERDTEGWPYVAFDLNPAVVKSARKSGFPVLYGDGSRPAVMQSAGISSPKAVLVPYSAREETVESVDRLRQAFPAVPVYVRAQDMSHLLDLRKAGATDVVLENAETSLQLGSMLMKGLGVMSDDVSFLSKLVRDSMELQAQEALNNVESRETTTMESLQVRVSDLVESNGNGSGMIPREQSLGLSSRPEVPARAAAPDNPCLIDNKNESETCEICPWKR

SEQ ID NO: 843 - protein, 131 aa, Brassica napus
  misc_feature (116)..(116): Xaa can be any naturally occurring amino acid
  unsure (1)..(131): unsure at all Xaa locations
MGVGGGEGEQRRGEMMAISSLFNDQQNPIQQVQVKFKEVEVGLKTWLSKQSIPVEAAVVSTMSGVQGAFIGGLMGTLSPEMPQTDPQAMASMKQAQALVGGPWVQARNFAAITGVXAGIACVMKRIRGKED

SEQ ID NO: 844 - protein, 377 aa, Nicotiana tabacum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDFEQEMETSKTSSSVEKSYELPDGQVITIGAERFRCPEVLFQPSMIGMEAAGIHETTYNSIMKCDVDIRKDLYGKIVLSGGSTMFPGIADRMSKEITALAPSSMKIKVVAPPERKYSVWIGGSILASLSTFQQMWIAKAEYDESGPSIVHRKCF

SEQ ID NO: 845 - protein, 677 aa, Arabidopsis thaliana
MIPLSFAALGDIVDKKLDEDYVKEEVEMMIQVSLLSTQAAPGERPTMSEVEIFRNSCLCYINWFCNIISIIYSNSLLLRIDSGSSSISVVFLVFTLSRMEQRRMLTAARPRLSSTIRTITSHVAFSASRLLKPYVAYRLGLEDANQRKTENESTGGDKEIANSLLHCLKFHYLLLHFPSFSLQIHNRSTSLSLSRFEKMAKLVMLLVLCILPAIAMAARRGNIGKNTMVVQGSTYCDICKFGFETPESSYFIPGATVKLSCKDRKTMEEVYTDKAVSDKEGKYKFIVHDDHRDQMCDVLLVKSSDKTCSKISVGREKSRVILNHYSGIASQIRHANNMGFEKEVRMATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 846 - protein, 392 aa, Heterocapsa triquetra
MAKALLIPATFGCAAAFVAPGQSLRGVPAAGVQEASQAPTAAPAQSSSVLSTTATLAGAAIAVGGVVRRRGGRAAAKATAMRATGIAINGFGRIGRQVARIAMKDPEVELKLINASYDAEYLAYQMKYDSIHGRYNGTIEVDGDSLVIDGQKVALSHTRDPAEIPFKKHGAEYVCESTGVFLTTEKVQPHLKAGAKKVVFSAPAKDDSHTVVMGVNQETYKSSMECVSCASCTTNGLAPLVKCINDAFGIRRGLMTTIHAMTASQPTVDGASKKDWRGGRAASGNIIPSSTGAAKAVAKVIPEVAGKLTGMAFRVPTIDVSVVDLTCELEKATTYEEICAEVKKRAEGDMKGFLGYCDEDLVSTDFETCTISSTFDSKAGIMLDPTFVKLVA

SEQ ID NO: 847 - protein, 393 aa, Gloeobacter violaceus PCC 7421
MSMLETRAERMVINLGPHHPSMHGVLRLIVTLDGENVVDCVPVLGYLHRSMEKIAESRTIIQYLPYVTRWDYLATMFTEAITVNAPEQLAGVQVPRRARYIRVIMLELSRIASHLLWLGPFMADIGATSPFFYIFREREMIYDLFEAATGMRMMHNYFRVGGVAVDLPYGWVDKARDFCNYLPPKIDEYERLITNNPIFRGRVEGLGYIGREDAINWGLSGPMLRASGVNWDLRKVDHYEIYDELDWNVAWDTGGDTLARYVVRIQEMRESVKMIRQALDQLPGGPYENLEAQRLSGGPKSEWNGFDYQFIGKKSSPTFKMPRGEHYVRVEAPKGELGVYLIGDDSTFPWRWKIRPPGFINLAVLPKLVQGTKLADLMAILGSVDIIMGEVDR

SEQ ID NO: 848 - protein, 543 aa, Oryza sativa (japonica cultivar-group)
MGKKAGTTSSWLTAVKRAFRSPSKDDSPNKAARLRDDTDDDKGKRERRRWLFRKSSSPSPAPPTPPPPQQQQQQSRAAAVTEEQRHAIALAVATAATAEAAVATAQAAAEVVRLTRPSSSFVREHYAAIVVQTAFRGYLARRALRALKGLVKLQALVRGHNVRKQANMTLRCMQALVRVQARVRDQRMRLSQDSISLSAAAASAAPCGSSKSSYSVDTSTFWDSKYTHDFAAADRRSIERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPNYMAATESAKARVRSQSAPRQRPATPERDRMSFGGGGGGGGAKKRLSFPVPIDPYGAYAQSLRSPSFKSAAGRFSSEQRSNVSSSCAESLGGDVVSPSSTTDLRRWLR

SEQ ID NO: 849 - protein, 1114 aa, Saccharomyces cerevisiae
MISTTISGKRPIEQVDDELLSLTAQQENEEQQQQRKRRRHQFAPMTQFNSNTLDEDSGFRSSSDVATADQDNFLEESPSGYIKKVILRNFMCHEHFELELGSRLNFIVGNNGSGKSAILTAITIGLGAKASETNRGSSLKDLIREGCYSAKIILHLDNSKYGAYQQGIFGNEIIVERIIKRDGPASFSLRSENGKEISNKKKDIQTVVDYFSVPVSNPMCFLSQDAARSFLTASTSQDKYSHFMKGTLLQEITENLLYASAIHDSAQENMALHLENLKSLKAEYEDAKKLLRELNQTSDLNERKMLLQAKSLWIDVAHNTDACKNLENEISGIQQKVDEVTEKIRNRQEKIERYTSDGTTIEAQIDAKVIYVNEKDSEHQNARELLRDVKSRFEKEKSNQAEAQSNIDQGRKKVDALNKTIAHLEEELTKEMGGDKDQMRQELEQLEKANEKLREVNNSLVVSLQDVKNEERDIQHERESELRTISRSIQNKKVELQNIAKGNDTFLMNFDRNMDRLLRTIEQRKNEFETPAIGPLGSLVTIRKGFEKWTRSIQRAISSSLNAFVVSNPKDNRLFRDIMRSCGIRSNIPIVTYCLSQFDYSKGRAHGNYPTIVDALEFSKPEIECLFVDLSRIERIVLIEDKNEARNFLQRNPVNVNMALSLRDRRSGFQLSGGYRLDTVTYQDKIRLKVNSSSDNGTQYLKDLIEQETKELQNIRDRYEEKLSEVRSRLKEIDGRLKSTKNEMRKTNFRMTELKMNVGKVVDTGILNSKINERKNQEQAIASYEAAKEELGLKIEQIAQEAQPIKEQYDSTKLALVEAQDELQQLKEDINSRQSKIQKYKDDTIYYEDKKKVYLENIKKIEVNVAALKEGIQRQIQNACAFCSKERIENVDLPDTQEEIKRELDKVSRMIQKAEKSLGLSQEEVIALFEKCRNKYKEGQKKYMEIDEALNRLHNSLKARDQNYKNAEKGTCFDADMDFRASLKVRKFSGNLSFIKDTKSLEIYILTTNDEKARNVDTLSGGEKSFSQMALLLATWKPMRSRIIALDEFDVFMDQVNRKIGTTLIVKKLKDIARTQTIIITPQDIGKIADIDSSGVSIHRMRDPERQNNSNFYN

SEQ ID NO: 850 - protein, 418 aa, Ricinus communis
NAQSHDNVVSIMLDTKGPEVRSGDVPQPMLKEGQEFNPTIRRGVSTQDTVSVNYDDFVNDVVVGDILLVDGGMMSLAVKSKTSDLVKCVVVDGGELKSRRHLNVRGKSARLPSITDKDWGDIKFGVDNQVDFYAVSFVKDAKVVHELKEYLKRCNADIHVIVKIESADSIPNLHSIISASDGAMVARGDLGAELPIEEVPLLQEDIIRRCHSMQKPVIVATNMLESMINHPTPTRAEVSDIAIAVREGADAVMLSGETAHGKYPLKAVRVMHTVALRTESSSPVNTTPPAQGAYKGHMGEMFAFHATIMANTLNTPIIVFTRTGSMAVLLSHYQPASTIFAFTNEERIKQRLSLYRGVMPIYMEFSSDAEETFSRALQLLLNKGLLVEGEHVTLVQSGAQPIWRQESTHHIQVRKVQN

SEQ ID NO: 851 - protein, 483 aa, Magnetococcus sp. MC-1
MKSIRRTKIIATLGPNASSRDFIKHLALTGVDTFRLNFSHGSHEDHRRRHGWIRSVEEELGRPLGIMMDLQGPKLRIGTFENSEVELVRGQKFALYKEERTGDINGVTLPHNELFQVMRPGLELLLNDGRINLRVMEVEDFGVCCEVRVGGILSDRKGLNVPAAMLPVKALTDKDLEDLEFGLELGIDWCALSFVQRPEDLREARKLIHGRAALLAKIEKPQAVDNLEEIVKVADGVMVARGDLGVEYTPERVPAVQKRLIRMCREQCKPVIVATQMLESMIDAPIPTRAEASDVANAIYDGADAVMLSAETAVGSYACNAVSVMDRIARVTEADPDCLQRNLHTPLTFDNSDNDAISKAARDVAMSRGCQAIVAFTKTGSTALRVSRTRASVPILGLTPDIRVARRLTMVWGVHSVNTSDVSNFAEMVGKATRICRREELANTDDRIVVIAGVPFGQEGTTNILRIARIGEAERPLDDGPLD

SEQ ID NO: 852 - protein, 249 aa, Azoarcus sp. EbN1
MYKIVLLRHGESTWNKDNRFTGWTDVDLTEKGVEEARGAGHLLKREGYTFDLAYTSVLKRANKTLNIVLEELDSLWLPVEHSWRLNERHYGDLQGLNKAETAAKFGDDQVLVWRRSYDTPPPPLPEGDERLTSGDPRYASLPRAQFPRTECLKDTVARFVPYWETVIVPNILAGRRILIAAHGNSLRALIKYLDNISDSEIVGLNIPTAQPLVYELDANLRPIRSYYLADADTIRAAEAAVAGQGKAKG

SEQ ID NO: 853 - protein, 503 aa, Listeria monocytogenes str. 4b H7858
MFYEIYMKSFQDSNGDGLGDFKGLTSRLDYLVDLGIDGIWLTPFYPSPQVDNGYDVSDYCDINPDYGDMTDFRAFMKAADARGIKVIIDLVLNHSSTEHAWFKESRSSKTNPKRDYYIWREKPNNWESFFGGSAWEMDELTGEYYYHSFAKEQADLNWANEAVRAEMEQVLAFWLNEGVAGFRLDVINNLTLVLEFTDNPVTSGEMEHVYDRNQSGLEQALEDIASFCRKERDVFLVGEISSDQLAEIARYSSKKMLDVTFNFNFGSVDQLDAKSVFTTLNEMETALNEGQWPTLFFGSHDMSRFRSRLASGDIVKTQLLAFLMLTAKGVPFIYYGEEVGMPDLTFSSVKEMRDIQGTAAYYQALQTGSDEKQALEIAIEKTRDKARGPMIFPDGKPFTLGEPWIKMATLPEKEARTMWRFYQGLLAFRKENDFKEMEYTFLKLDGEVLSYQRGEFIFLLHFGEEEVTYPLQGNYQLVFGEAVMVGNGIRMGAHTGIALRVEE

SEQ ID NO: 854 - protein, 447 aa, Methanocaldococcus jannaschii
MVGMMRKTKILVTLGPSLENKLDKAINLIDGVRFNMSHATTDYCEKFLNILEKNNIAKVMDLKGIKIRIKEVKLKNKILKMGEKVVIGEDIKLNYNIDTIEEGHFILINDGKIKLRVVEKTDKIIAVVEVGGEIKEGMGVNLPDTRIELPIIDETDLKNIKFAVEKDFEYIALSFVRNKEDVKELKDIISEYKGDCEVISKIETKEGLKNIKEIARESDGVMVARGDLGVEVPIENIPIEQKNILRIANRYGILSITATQILDSMINNPFPTRAEVTDIANAIYDGTDCLMLSNETTIGKYPIEAIKVLNKVAKVADEHYEEFGDRVCLEVESIDEGLVYAVYELYKKLNTKLVITPTYSGRTAKLISKLRINSKIIAPTPNIRTLKRLRLVWGVESCLMEEFDDMEKIINTCREMAKKEIGKGIYLITLGHPIGQKKTNTIKVESI

SEQ ID NO: 855 - protein, 361 aa, Mycobacterium tuberculosis CDC1551
MSQTVRGVIARQKGEPVELVNIVVPDPGPGEAVVDVTACGVCHTDLTYREGGINDEYPFLLGHEAAGIIEAVGPGVTAVEPGDFVILNWRAVCGQCRACKRGRPRYCFDTFNAEQKMTLTDGTELTAALGIGAFADKTLVHSGQCTKVDPAADPAVAGLLGCGVMAGLGAAINTGGVTRDDTVAVIGCGGVGDAAIAGAALVGAKRIIAVDTDDTKLDWARTFGATHTVNAREVDVVQAIGGLTDGFGADVVIDAVGRPETYQQAFYARDLAGTVVLVGVPTPDMRLDMPLVDFFSHGGALKSSWYGDCLPESDFPTLIDLYLQGRLPLQRFVSERIGLEDVEEAFHKMHGGKVLRSVVML

SEQ ID NO: 856 - protein, 510 aa, Lilium longiflorum
MANIDIEGILKELPADGRVPKTKLVCTLGPSSRSVPMLEKLLRAGMNTARFNFSHGTHEYHQETLDNLRIAMQNTQILCAVVLDTKGPEIRTGFLKDGKAVQPKEGQEIIVSTDYDLKGGGNTITMSYKKLPVDMKPGGTILCADGSISLTVLSCDPDAGTVRCRCENTALLGERKNVNLPGVVVDLPTLTEKDKEDILEWGVPNNIDMIALSFVRKGSDLVNVRQVLGSHAKNIKLMSKVENQEGVVNFDEILKETDAFMVARGDLGMEIPVEKIFLAQKLMIYICNLAGKPVVTATQMLESMIKSPRPTRAEATDVANAVLDGTDCVMLSGESAAGAYLEIAVKVMAKICIEAESSLDYDAIFKEMIRSAPLPMSPLESLASSAVRTANKAKAALIVVLTRGGTTAKLVAKYRPAVPILSVVVPVLTSDSFDWNVSDESPARHSLIYRGLIPLLAEGSAKATDAESTEVILEAALKSATARRLCKPGDSIVALHRIGVASVIKICIVK

SEQ ID NO: 857 - protein, 317 aa, Mycobacterium tuberculosis CDC1551
MAKDLVATVPDLSGKLAIITGANSGLGFGLARRLSAAGADVIMAIRNRAKGEAAVEEIRTAVPDAKLTIKALDLSSLASVAALGEQLMADGRPIDLLINNAGVMTPPERVTTADGFELQFGSNHLGHFALTAHLLPLLRAAQRARVVSLSSLAARRGRIHFDDLQFERSYAPMTAYGQSKLAVLMFARELDRRSRAAGWGIISNAAHPGLTKTNLQIAGPSHGRDKPALMERLYKTSWRFAPFLWQEIEEGILPALYAAATPQADGGAFYGPRGRYEVAGGGVREAKVPAAARNDADSKRLWEVSEQLTGVSYPKSR

SEQ ID NO: 858 - protein, 498 aa, Lycopersicon esculentum
MAKKNFVLHYNLLLISLLAFLFLLTEGAPQSALVTQLPGFNGTFNSKHYAGYVNIDESHGKNLYYYFVESERNPSKDPVVLWLNGGPGCSSFDGFVYEHGPFNFDFGKPSGSLPSLHNNPYSWSKVSNIIYLDSPVGVGLSYSGNKSDYNTGDLKTASDSHSFLLKWFEIYPEFLKNPFYISGESYAGIYVPTLASEVIKGIDAGVRPAINFMGYMVGNGVADDIIDGNAIVPFQHGMGLISDDLYEEAVVACHGNFYEPVDSNCSEKLNKIDQVVYDLNVYDILEPCYHSKKPSVITTGNSRLPMSFRKLGETERPLPVRKRMFGRAWPYKAPVRAGHVPTWPEILNSVEVPCTDDRVATLWLNNADVRKAIHAEPATVIGPWELCTDKIDLDHDSGSMIPYHKNLTARGYRAIIFSGDHDMCVPFTGSAVWTKSLGYPIVDEWRPWYVNDQVAGFIQGYANNLIFMTIKGAGHTVPEYKPREALAFYSRWLEGKKI

SEQ ID NO: 859 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 860 - protein, 366 aa, Guillardia theta
AAGAYAFTGPAPVALRHGRAGALSQRLSMAATIPKVPFSGVSPTGPSGPTLPAPGEDLEFLEAKPYWDQSGVQVNIAKQKNPLIGKIISVQRIVGPNSPGETCNIIIDHQGKLPYWEGQSYGVVPPGIDPKKNKPYGVRLYSIASTRYGDDKTGKTTTLCVRRATYWCPELKAEDPAKKGVCSNYLCDSKPGDEISLTGPSGKVMLMPEDDPNMTYIMVATGTGIAPFRSFLRRLFGEGNPAGKNFKGLAWLFLGVANKDSLLYDEEFQVYLRQNPDKMRLDYALSREGPLNKKGGKMYIQDKVEEYADEVFDALDKGAHIYFCGLKGMMPGIQDMLRGVCESKGLNFEEYLEGLKKKGQWHVEVY

SEQ ID NO: 861 - protein, 268 aa, Pseudoalteromonas tunicata D2
MTDKVHLGHRAKKRFGQNFLNDAMIIDKIVTAIDPKPEDCLVEIGPGLGAITEPVTDIAGHLTVVELDKDLVERLIHHPFLGPKLTVHQGDAMRFDFSTLVEENKKLKVFGNLPYNISTPLLFHLFDYAEHIEHMHFMLQKEVVKRMVASPDCKAYGRLSVMTQYYCHAIPVIEVPPECFKPAPKVDSAVVRLIPKKPEQLRAKCTKILNTVCLEAFNQRRKTIRNSLSNLLTTDDMIELGLDSKARAENLSLDQYIDIANWLYDNKQ

SEQ ID NO: 862 - protein, 350 aa, Cryptococcus neoformans var. neoformans JEC21
MAAPQATLGADLEPPATDLITLTRHILSQQYALGESATGDLTMLLIAIQVTSKYIASNVRKARLINLVGLAGASNVQGEDQKKLDVLSNDIMVNALSASGKCSVMVSEEVDEAIIVSGIKGTYCVVFDPLDGSSNIDAGVNVGTIFGVYKVQEGSRGTVEDVLRPGREMVAAGYTMYGSSCNLVLSTGNGVDGFTLDESLGEFILTHPAIKIPSRGKIYSFNEGNSLHFYPPTNDYLNSIKYPENGKPYSARYIGSMVADVHRTLLYGGIFGYPDDKKSKDGKLRMLYEAFPMSFLTEQAGGVATTGSQRILDIVPTSIHGRCPVFLGSKEDVEDLKKFYVNYKDDSRKW

SEQ ID NO: 863 - protein, 376 aa, Robiginitalea biformata HTCC2501
MGKKIQLDSIESAIEDIRQGKVIIVVDDENRENEGDFIAAAEKVTPEMINFMATHGRGLICAPLTEERCDALDLKMMVENNTVLHHTQFTVSVDLIGYGCTTGISVHDRAKTIQALVNPDIRPEELGRPGHIFPLRAKNGGVLRRVGHTEAAVDFARLAGFQPAGILVEVLNEDGTMARLPELARVARKFNLKLVSIEDLVAYRMKHDSLIRKEASFDVKTRFGEYRLHAYRQTTNDQIHLALTKGAWKDGDPVLTRINSTLVNNDILGTLTNDADKKLDDMFRALNDEGTGAIVFINQPSESLNLLSRIRGLEENQAKGILKAPGIEMDTKDFGIGAQILHDLRIQKIRLMTNSSQAKRVGIVGYGLEIVDYVPY

SEQ ID NO: 864 - protein, 211 aa, Oryza sativa
MAAAAASRPRRMKRWGASARLRWLPAHGRRRRRLARRCGAHRRPPICADYAKASWMVAMSVGAVEALKDQGGLCRWNYALRSIHKAAKANAAGVSQGKKLPASAAAVAERRRAEKAEEGLRTVMYLSCWAKASWMVAMSVGAVEALKDQGGLCRWNYALRSIHKAAKANAAGVSQGKKLPASAAAVAERRRAEKAEEGLRTIMYLSCWGPN

SEQ ID NO: 865 - protein, 485 aa, Saccharophagus degradans 2-40
MSLTLTNSKLQRQGSVIDGAWLQSSDEFVVENPATGQVVATVANAGAAEAEAAVLAAERAGVQWREFSAKKRSTLLKAWYELVVSNANDLAVLLTTEQGKPLAEAKAEILYGASYIEWFAEQAKRIEGAVIPAPASNQRIVTVKQPVGVVAAITPWNFPMAMLARKIAPALAAGCTVVAKPAKETPLSALAMAYLAQEAGIPPGVINLVTGQDSSAIGGVFTQHPSVKKLTFTGSTAVGKTLLEQSAATIKKCSMELGGNAPFIVFDDADIDAAVAGCIAAKFRNAGQTCVCVNRIFVHDKVKAAFTKKLVEAVAKLKVGDGIEEGVAIGPLINAAAFKKVSELVIDACNKGAKAIVAEGHTHLNGALFYPPTVVTEATTQMDVFNEEIFGPVAVVYSFSSEEEAIALANNTPFGLAGYFYSRDIGRVWRVASALEVGMVGVNDTAISNEMAPFGGVKESGFGREGSQMGLDDYLETKYMLMGGL

SEQ ID NO: 866 - protein, 182 aa, Magnetospirillum magnetotacticum MS-1
MARRGWTVADIPSQAGRRAVVTGASAGLGYETALALAGAGAAVVLAVRDAAKGARAAEAIARAHPGADLAVRLIDTASLASVRAFAADWPARQPIDRLILNAGIAAVPSREESVDGFERQLATNTLGHVALTGLLLPVLSPTAGSSRWRASPIAAAGSASTTSTGARVTGRRPPTVRASSRS

SEQ ID NO: 867 - protein, 394 aa, Gloeobacter violaceus PCC 7421
MVTIETRADQMVLNLGPHHPSTHGVLRLIVTLDGENVVDCRPVLGYLHRGMEKIGENRTIIQYLPYCSRWDYAAAMMNEAPVVNAPEAMAGVKVPRRASYIRVIMLELSRIANHLLWVGPFLLDMGAQSPFFYILRERELILDLFEAATGLRMVGNNYFRVGGVTVDLPYGWVDKAHDLCDVIPGKIDEYERLITNNPIFRRRIENLGYISREDAINWGLSGPMLRASGVKWDLRKVDHYEIYDELDWDIAWDTGGDCLARYIVRIKEMRESVKIIRQALDQLPGGPYEQLEARRLAEGPKSEWNSFDYQFIGKKSSPTFKIPTGEYYARSEEAKGELGIYVVGRDDTTPWRWKIRTPDFANLAILPMILQGTKVADLVVVLGSIDIIMGSVDR

SEQ ID NO: 868 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKELSAKSFFLTLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 869 - protein, 780 aa, Saccharomyces cerevisiae
MAPKSSSSGSKKKSSASSNSADAKASKFKLPAEFITRPHPSKDHGKETCTAYIHPNVLSSLEINPGSFCTVGKIGENGILVIARAGDEEVHPVNVITLSTTIRSVGNLILGDRLELKKAQVQPPYATKVTVGSLQGYNILECMEEKVIQKLLDDSGVIMPGMIFQNLKTKAGDESIDVVITDASDDSLPDVSQLDLNMDDMYGGLDNLFYLSPPFIFRKGSTHITFSKETQANRKYNLPEPLSYAAVGGLDKEIESLKSAIEIPLHQPTLFSSFGVSPPRGILLHGPPGTGKTMLLRVVANTSNAHVLTINGPSIVSKYLGETEAALRDIFNEARKYQPSIIFIDEIDSIAPNRANDDSGEVESRVVATLLTLMDGMGAAGKVVVIAATNRPNSVDPALRRPGRFDQEVEIGIPDVDARFDILTKQFSRMSSDRHVLDSEAIKYIASKTHGYVGADLTALCRESVMKTIQRGLGTDANIDKFSLKVTLKDVESAMVDIRPSAMREIFLEMPKVYWSDIGGQEELKTKMKEMIQLPLEASETFARLGISAPKGVLLYGPPGCSKTLTAKALATESGINFLAVKGPEIFNKYVGESERAIREIFRKARSAAPSIIFFDEIDALSPDRDGSSTSAANHVLTSLLNEIDGVEELKGVVIVAATNRPDEIDAALLRPGRLDRHIYVGPPDVNARLEILKKCTKKFNTEESGVDLHELADRTEGYSGAEVVLLCQEAGLAAIMEDLDVAKVELRHFEKAFKGIARGITPEMLSYYEEFALRSGSSS

SEQ ID NO: 870 - protein, 134 aa, Glycine max
MAWRGNISKSLKELRILLCQSSPASASARFLLHPSLSLSSPIESNSVKIGGSISVVRDFELFGFRTFVEKNYRDLKSLNPKFPFMIRECTGIQPQLWARYDMGVERCVNLDGMSDSQILKSLEDLVKAGGATKA

SEQ ID NO: 871 - protein, 220 aa, Azoarcus sp. EbN1
MTQDELKKAAAIAALDYVENGMIVGVGTGSTVNHFIDGLAGIKGRIAGAVSSSEASARRLQAHGIPVLDLNDITDLPVYVDGADEIDGGFCMIKGGGGALTREKIVAAVARRFICICDASKKVACLGRFPLPVEIIPMARAYVERELVRIGGRPELREGFVTDNGNLIVDVHGLMITSPRALETELNQIVGVVTNGLFARRGADVLLLATLAGVERQVAN

SEQ ID NO: 872 - protein, 496 aa, Oryza sativa
MKLSLVCSANPNNHRSRSSDITRHQKGGSARRKSKPYQEKDDSENIDEFDTDIMSSKNGPPISLTSNSRPQATSVPGEREKEIVELFKRVQAQLRARGKGKEEKKPEQAKAQGERGSVDSLLNLLRKHSVDQRRKSGDEKEQSVDQTKRSNESGNKQNSSIFIKNDTQEEQKKPHPAAFKRPASNFRRRSPVPNVKFQPVTNVDAERVINNINDAVQEAKPTLENKAATDEPDSVSTFEPNSVIEPENLSLDDLDHISDDEPDASDTDEPSGEYDEPSLQIPSVPIIDESHDTTLKSSLGGPDLSTLKVTELRELAKSRGIKGYSKMKKNDLSQGTDWEDFLGIVCLPIINSTISFIKENNAGDAAAALMSRLALKTKVLRDEQWQELDASTLVPGDIISISQLSLVNPFLSPKEPGTIVFTGSTCKHGEIEAVVIATGIHSFFGKAAHLVDSTEVVGHFQKIIKGEISKDIDITSKFIVLQISEKNEYGITGISL

SEQ ID NO: 873 - protein, 294 aa, Thermus thermophilus HB27
MPGLLDLLTESWQSGEALAERLGVSRAAVSKEARRLRAEGYPVEVSRRGYRILPGTPLPHLFHPRGRLGRPYRYLGRVGSTQDVLRAWAEEGAPEGALVLAEVQERGRGRRGRPWESRPGGSLTFSLLLRPGLPLSALGLLPLLAGLALREAVGVGGLKWPNDLLAPDGGKLAGVLLEARAEGEEVSYALLGVGVNVAWAPEGAAFLQAYAPLSRREVLEGFLLKLEALLPLLETPEALLERYRQASLTLGRKVRVHTGKGVVEGLAEDVLPDGSLLVGGVRVGAGEVELLPLL

SEQ ID NO: 874 - protein, 262 aa, Legionella pneumophila str. Lens
MKIHDFKIKKQEQKKISMLTCYDYPSACIVAESNIDCVLVGDSVAMAVHGYPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKIQGKNSEQAETLLQQATTLEQAGCFAVVIECVPQDLAKTITDSLVIPTIGIGAGPGTDGQVLVWHDMLGLQTSFNPKFVKKYFRAKDHFIEALNSYVQQVQQMHFPANEHSF

SEQ ID NO: 875 - protein, 243 aa, Mycobacterium sp. MCS
MLTVDFDRLGIGPGSKVIDVGCGAGRHTFEAYRRGADVVGFDQNAQDLNDVDEILQAMKAQGEVPPSAKAEVVKGDALDLPYADGTFDCVIASEILEHVPQDTEAIAELVRVLKPGGKLAITVPRWLPERICWLLSDEYHANEGGHVRIYKADELRDKVLAHGLRFSHSHHAHALHSPFWWLKCAVGTSNNDHPAVAAYHKLLVWDMISAPWLTRRGEKLLDPLIGKSVALYFEKAAVADAGR

SEQ ID NO: 876 - protein, 525 aa, Crocosphaera watsonii WH 8501
MAKVLVSDPIDQVGVEILSQVAQVDVKTGLPPEELVKIIPEYDAMMLRSGTRVTKEIIEAATQLKIIGRAGVGVDNIDVQAATRQGIVVVNSPEGNTIAAAEHALAMMLSLSRHIPEANQSVKNDKWERKRFIGAEVYKKTLGVVGLGKIGSHVANVAKSMGMKLLAYDPFISKERADQLGCTLVDLDLLFAESDYITLHIPKTKETTHIINKESLSKMKPNARIINCARGGTIDESALAEAIAEGKIAGAALDVFEEEPLKESKLREHENIILTPHLGASTAEAQVNVAVDVAEQIRDVLLGLPARSAVNIPGLTPDVMEKMRPYLQLAETLGNLVGQLAGGRIERLTVRLQGELASTKGQPIVVASIKGLLSQALRERVNYVNAAIEAKERGIRIIETHDASIRDYSDSLHLAAQGSLGEHSVTGALLSDGEIRITDVDGFPINVPPSNYMLFTVHRDMPGIIGKIGSLLGSFNVNIASMQVGRKIVRGDAVMALSLDDPLPEGLLNEITKVDGIRDAYTVKL

SEQ ID NO: 877 - protein, 465 aa, Yersinia enterocolitica (type 0:8)
MLLPVIMAGGAGSRLWPLSRTHYPKQFLALTSELSMFQETLLRLEISPHLSPLVICNAEHRFIIAEQLRQQNLLHSGIVLEPIGRNTAPAIALAALLATSNGEDPILLVLAADHVIQDKPAFISAIQLAEPLAEMGKLVTFGIVPNTPETGYGYIRQGKQIEGGAFQVDSFVEKPDLAKAEQYLSSGDYYWNSGMFVFKASRYLQELEKHRPDIFEACKSAIADNGKDLDFIRLDEAAFYSCPDESIDYAVMERTSDAVVVPMNAQWSDVGCWSALWEINDKDSHGNVVRGDVLTEDTNNSYIYSQNRLVATVGINDLIIVETKDALLVANKNKVQSVKEIVGQLKLGSRLEYLQHKEVYRPWGSHDAIAEGVRYHVQHVTIKPGQRTATQIHHHRAEHWVVVSGTARVYRDNESYLVTENESTYIAVGVAHSIENPGKLPLEIIEVRTGSYLEEDDIVRIEHKI

SEQ ID NO: 878 - protein, 645 aa, Oryza sativa
MSMACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 879 - protein, 695 aa, Haloarcula marismortui ATCC 43049
MHHPGPPRFATVGESVELAPRQPDPGMAAEWRLVERPAASTATLGDGPVCHLEPDVPGVYRAELIVPDGTHEQVIRAFPGVTETARFSVTADDFDGDELTVADRAIVIGTFNDFTMGTHWAERDGDEWVIEADLPPGTHHAIFSFDGSFESTATDEVTVEGPGRPRVELTSQAEDGDFVVSADARAAPSGSEPEVEFYLDGRDALEESAVTIDGDELRVPHEALPEMARVHAVAVAERHSVADTLVVERGGENGETGTGETVSVSRPADPPAWAGDATIYEIFVRSFAGETVDTTFEAIERRVPYIESLGVDVVWLTPVQASPTRHGYHITDFFDTAEDLGTREEFESLVDRLHDAGIRVVFDLVINHSSRDHPAFQLHRAGVPEYADYYERIPVSQDVSDVDWAGTDAPGYYFNWTRIPNLNYDSLAVRRWMLDVVDEWRDVVDGFRCDVAWGVPHGFWKEVRERVKADDPEFLLLDETVPRDAAFAENEFDVHYDTDLFDTLRDIGTGEEPASVLFEALDATAEHGYPDRAGHMRYVDNHDEDRYLDECGAASLQAAVGATFTLPGTPMVYAGQERGVEQQRGTMRWHDGDNALTDFHRRLVALRADHAALRVPGVCPVAHTVETGDADRVVAYERTDGDETLVVVLHFGDGTAKVSLDTIDEETDLLSGNPVGGDGTVEVGDIVVVPATRER

SEQ ID NO: 880 - protein, 563 aa, Yersinia enterocolitica (type 0:8)
MHHSTPLITTIVGGLVLAFLLGSLAHRLRSSPLVGYLAAGVLAGPFTPGFVADTSLAPELAEIGVILLMFGVGLHFSLKDLLAVKAIAIPGAVAQIAVATLLGMGLSHLLGWDLMTGFVFGLCLSTASTVVLLRALEERQLIDSQRGQIAIGRSIVEDLAMVLTLVLLPAFAGVMGNETTSLSQLFTELAITIGKVIAFITLMIVVGRRLVPWILAKTASTGSRELFTLAVLVLALGIAYGAVGLFDVSFALGAFFAGMVLNESELSHRAAQDTLPLRDAFAVLFFVSVGMLFDPMILLREPLAVLASLAIIIFGKSAAAFILVRMFGHSNVYSTHHFCPWRKSVNLPFILAGLGISLGLMSEHGRNLVLAGAILSIMLNPLLFTLLDRYLAKNETMEDLILEEAVEEEKQIPGRFVQSCTVSRLWSGGSLLGAKLHAEGIPLVVIENSRPRVEALREQGINAVLGNAASADIMSLARLDCALVIILTIPNGYEAGEIVASARIKRPDLEIIARAHYDDEVVYISVRGANQVVMGEREIANSMLNMLKIETLTEEDKRPLCPI

SEQ ID NO: 881 - protein, 357 aa, Spinacia oleracea
MTAYRGKYADELIANASYIATPGKVILAADESTGTIGKRFPSINVENVESNRRALRELLFTTPGALPYLSGVILFEETLYQKTADGKPFVDAMKDGGVLPGIKVDKGTVELAGTNGETTTQGLDGLAQRCAQYYTAGARFAKWRAVLKIGPTEPSPLAILENANGLARYGIICQENGLVPIVEPEILVDGTHDIDRCAEVSERVLAACYKALNDHHVLLEGTSLKPNIVTPGSESKKVTPEVIAEYTVRTLQRTVPQAVPGVMFLSGGQSEEEATLNLNAMNKLETKKPWTLSFSYGRALQQSTLKAWQGKEENVAKAQEVFLARAKGNSEATLGKYQGGAGGADASESLHVKDYKY

SEQ ID NO: 882 - protein, 263 aa, Lactobacillus plantarum WCFS1
MKIGFIGAGNMGRAIIDGWLKQQAVVPADIYIHSAHAASYQPYAQKNGLQACDTNLAVAQAADVIVLAVKPNIALAALKEVQAALTGKWVITMVSGLSLADYATVAPDLPVLRIMPNVNVAIGAGMTALVGNDALTPEQYAAGQQLFDAIGATSAIAEKDFPTFSALAGSSPAYIYFFIDAMARAGVKHGLSKDAATKIAAQATLGSAQNVLASDKIPFDLIDQVSSPGGTTVAGLLAMEEAGFMTAVVKGIDATIAKELGES

SEQ ID NO: 883 - protein, 256 aa, Botrytis tulipae
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDAKA

SEQ ID NO: 884 - protein, 474 aa, Frankia sp. CcI3
MFTKAEDVLRYIRDEDVQFIDVRFCDLPGIMQHFTIPTQVFAESVFTEGLMFDGSSIRGFQAIHESDMLLLPDPHTAFVDPFREHKTLAMTFFIHDPITKEQYSRDPRNIAKKAEAYLRGTGVADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARGRGKTVTFMPKPLFEDNGSGMHVHSSLWKDGEPLFYSPNGYGGLSDTARYYIGGLLHHAPALLAFTNPTTNSYRRLVPGYEAPVNLVYSARNRSACCRIPLSGDSPKAKRVEFRVPDPSCNPYLAFAAILMAGLDGVRNKIDPPDPIDKDLYDLPPDELAAVPQVPGSLEKVLDALEADNEFLREGDVFTADLIETWLDYKRVNEVDAIRLRPHPYEFTLYYDI

SEQ ID NO: 885 - protein, 4682 aa, Nostoc punctiforme PCC 73102
MTSLNCATFVDLLSYRSLSQPNQIAYTFLVDGDTEEVKLTYQELDQKARAIAVELQSLKAAPGERALLLYPSGLEFIVAFFGCLYAGVLAVPVYPPRRNQRMTRLQAIVKDSEARFALTTASVLTNIQQGFAQEPELTALHCIAIDKIVSDASNWQKPPLEKSTLAFLQYTSGSTGTPKGVIVTHGNLLQNSEYIKSAFELTPNSVSVTWLPSFHDMGLIDGVLQPLYTGFPSVMMSPASFVQQPIRWLKAISDYKATHCGGPNFGYELCVSKITPEQRANLDLSSWCSAYSGAEPVRRETLEKFAATFKSSGFQAKFFYPCYGMAEATLMISGGGVADEPVYCVVDPKALEKNQIIQVSEDTPKVKHLVGCGYAWLDTKIAIANPQSLTLCAPEQVGEIWVSGSSIAKGYWNRPEQTKETFHAYLADTAEGPFLRTGDLGFLKDGQLFITGRLKDVVIIRGCNHYPQDIELTVEQSHQALKAGSGAAFSVDIDGEEQLVIVQEVERTYLRHLNLDEVVEAIKTSVSQIHELQVYAVLLLKTGSIPKTSSGKIQRHACRAGFLAGTLNALNTVDVVIEPQLQNPKESKKMQFSLLYFSSNEAEFSDEKYKLFLEGAKFADRNGFTAVWTPERHFHAFGGLYPNPSVLSAALTSLTKRIRLRAGSVVLPLHNPIRVVEEWSVVDNLSHGRVDLAFARGWNPNDFVLSPDTHADSKEVMFSGIQTVQKLWRGENISLPNGVGKQTDIKVYPLPMQRELSIWITCTGGKERFIEAGASGFNILTALLFQPVEELAQKIALYRETRKQHGYDPDSGQVTLMLHTFIGEDIKVVRNQVREPFIEYMKSSVNLWRHGSDDLDKLTETEKANLLAYAFERYFHTSALFGTPSTCLEMVQRLHEIGVDEIACLIDFGIDGNTVLASLDSLNNLRQLVNGVDEPSIKETIESYNQPKTDVLKQTNNAIINNSLPAFSIETSLKIPSRQNEEVQVPQGSLLQWIGEVIVQQIANSLGKKSSQISLDKSFYSFGIDSLKAVEIMETLGEKFGFSISPTLLFEYPTPTEFALYLIQEQKTQLQKYLLVNWEPAKLWAVNLERQKAVVLSNKLFNPASTKVVEPINDRIRAEDIAVIGMSGRFPQSPDLQSFWELLSQGKNAIAQVPSLRWNLSDWYDKNPGAANKTYSCWGGFIDHIDQFDPLFFQISPREAELMDPQQRLFLEVAWEALENAGYSPESFAQSQVGVFVGCSNNGYYQRIAPALNTSDYSAGIGNQNAIIANRVSFLLNLRGPSVLIDTMCSSSLVALHMACRSLQQGECTTALAGGVNLLLSPEYYVGMSRMKMHSPNGRCATFDSQADGIVLGEGAGALLLKPLSQALKDGDRIYAVIKGSAVNHDGRTNGITAPNSRSHAEVICQALDAAGISADTISYVEAHGTGTSLGDPIEVEGLTKAFRKYTERKQFCKIGSVKTNIGHLECAAGMAQLLKVILAIQHRQIPANLHFQQPNPLIPFAETPFQVNTKLCSWESSGLRRAGISSFGIGGTNAHIVIEEAPPLEPVIPEIERPKHLLTFSAKTENALVQLVSRYETYLAANLDLPLGDICFTANTGRSHFQHRLSAIATSTSDLHQRLLNFISQQEVTGIKIGRIHENTPPKIAFLFTGQCSQYVGMGSQLYETQPTFRKILDYCNEILRPYLKEDLLKVIYPQPGETSLIDQTAYAQPALFALEYALVQLWKSWGVEPSVVMGHSVGEYVAACVAGVFSLEDGLKLIAERSRLMQSLPQTGAMVAVFACEADIWAITEIDLAEVAFAPRLEEKPSVGIAAYNGPQNTVISGEREAIERICANLKAAGIQTKKLVTSYGFHSPLMEPILAEFRQVAATVTYNAPQIDIISNVTGQLIGEAINPEYWCDHLISSVQFAKSIQTLHTADYEIFVEIGPKPILLGMGSKCLLGKGLWLASLRQGREDWQQILESLGELYVHGVQVEWSGFDRDYFRRRVQLPTYPFQRKRYWIDAPVSTSDNKFDTQKSLPSQLSTSQFDTEIAPPLKALQPKVDTTPQIKRLDLIVSKLHSYIVNLLKAEPSEVDFYAPFLEIGADSLMLIDAINYIDITYRIKITISQLFEQLTTIYAVASYIDQNLLPEPIFVDVQLPEPVYQTQPPTPQSPPLAFVESNGNGHSHTQQPTLKSTVQQTAGETAVERIMLQQLQVMSQVMSQQLDVLRATGNVLSSNGNSHLASSPPTPQNQVVKETGIAINQVQSNQTVTKNFSPIEPPPPREINQPQQQHLKTLISNYTQKTQSSKQYAQTYRSFLADSRAVAGFRPSTKEMVYPIIGERAKGARCWDIDGNEYVDITMGFGVLLFGHAAPFITAAVDEHLQQGIQIGPQANYAGEVAALISELTGMERVTFCNSGTEAVMTALRLARTKTGRSKIAIFAGSYHGHFDGILAKESLDGLSTVPIAPGITANAVEDVLVLDYGEPKSLEILQAHAAELAAVLVEPVQGRNPDLQPREFLQQLRQFTAVAGVALIFDEVLVGFRIHLGGAQAWFGIEADIVTYGKIVGGSIPIGVVAGKASYMNGIDGGLWNYGDASYPQVEKTFFAGTFNKNHLGMAVARAVLKYLKSQGPALQQHLNQRTSDLAIALNTYFEQEEVPIKIVYFGSLFRFAFSGNFDLLFYHLIYKGVYIWEGRNCFLSTAHTDEDIEYVIQAVKHSIEEMRAVGFIPKRSPKLSAGSNGNGTVKTTQNGVLTKPVVTESVPVLEAIAREGKLPLSLAQQRLWFLDQLEPNSAFYNIPAAVRLQGQLNVAILEQSFREIIRRHEALRTNFITLDGQPHQVIHPNLNWQISVVDLQHLPVSKRENESQKIAIAEAQRPFNLETESLVRATLLVLSQTEYILQVTMHHIVSDGWSMSILIEEFTALYTAFSQGQPTPLVELPIQYVDFAVWQRKWLQGTVLQSQLTYWKKQLSGAATILSLPTDRPRPTMQTVRGAHQPFALSFELTEALKALSKKEGVTLFMTVLAAYNILLYRYTGQADILVGSPNASRNRPEIQGLIGYFLNILLLRADMSGNPSLREFLKQVRKTALGAYAHQDVPVEELIEALQPVRDLSYTPLFQVMFILDSATPISEMQLPGVTWSSMTVENYTSKLDLTLTLENTAQGLVGEWEYNTDLFEAATITRMAEHFRNLLEGMVANPEQRIAELPLLAAWERQQLLVEWNNTQREYPHKCIHQLFEEQVELTPNAVAVVFGNQRLTYQELNSRANQLAHYLQELEIKPDTLIGICLERSLDIFVGILGILKTGAAYVPLDPDYPQERLDYMFSDSQVSILLTAKKLVTQIPRHSAQLVYLDADWDVIATKSQQNLASEVKPENLAYVIYTSGSTGRPKGVMVPHRSLVNAYFGWEQAYELRTKTSSHLQMANFSFDVFTGDLVRGLCSGAKLVLCPREWLLTPELLYKLMQEEKVDCAEFVPAVIRNLIAYLEKTKQNLDFMRVLAVGSDSWYVKEYEEFQRFCGLETRLINSYGVSEATIDSCYFESTNVKLPVEALVPIGKPFPNVQIYILDSDLQPVPIGVLGELYIGGAGLAHGYLNRPDLTQERFIANPLSNEPTSRLYKTGDLARFLADGNIEFLGRIDNQVKIRGFRIELAEIEAVLRQYPTVSQTVAMAREDIPGDKRLIAYVVGNQESVPVISDLRRFLKEKLPEYMIPAAFMVLQTIPLTPNGKVNYRELPAPEISRAGLEASFIAPRNPIEEILAQIWVDVLGVKQVGIHDNFFELGGHSLIATQLISRIRTALKVELPLRSLFEASTVADLAERIALQQDAPHLNAPSLQSVVRDGQLSLSFAQQRLWFLNQLEPNSALYNIAGTARLQGELNVIALEQSLGEIIRRHESLRTNFITQEDGQAVQIIRPDAAFTMPVVDLRQLSASEQEIEIQRLATVEAQQAFDLANQLLIRATLLVLSKTEHILLFCMHHIVSDGWSMGVFVQETAAIYGAFSQGQPTPLPELAIQYVDFAVWQRQLLQGEIKESQLAYWQQHLAGATALLELPTDRPRPAVQTFRGANQSFVLSFELTGSLILLSRQEGVTLFMMLLAAYDTLLYRYTGQTDILVGSAIANRNHNEIEGLIGFFVNTLVFRTDVAGNPSFRELLNRVREVALGAYSHQDLPFELLVETLQPERNLSYTPLFQVAFVLQNAPMSEIELPGLTLSSMTPDNKTAKFDLTLTLENTATGLMGVWEYNTDLFEASTIERMTGHFQTLLESVVIQPEQRIGELPLLTAKEQYQLLEEWNHTQKDYLGNICIHQFFEMQVERTPDAVALVFENQQLTYRELNQQANHLAHYLRTLGIRVDVLVGLCVERSLEMLVGLLGILKAGGAYVPIDPEYPQERISHILSDSQVSLLLTQHRLVARLPEHQATLVVIDESWEQIIQHSQENPISGVKDSDLVNVIYTSGSTGKPKGVMVKHSGLCNLAQAQIDLFDLLPSSRILQFASFSFDASIWEVVMALGSGARLYLGTKESLLPGLELIELLRDYGITHITLPPSALAVLPQAELPALQNIIVAGEACAPDLIKQWSVGRRFFNAYGPTETTVCATVAECGNGERSDKPPIGRPIPNTQAYILDSYLQPVPIGVPGELHIGGAGVAQGYLNRPELTTEKFILNPFEDSAALASPRASAEGSRLYKTGDLARYLPDGNIEY

SEQ ID NO: 886 - protein, 256 aa, Monilinia fructigena
AYMLKYDSTHGQFKGDVKVLPDGLEVNGKKVKFYTERDPANIPWAESEAYYVVESTGVFTTTEKAKAHLKGGAKKVVISAPSADAPMYVMGVNNETYTGDADVISNASCTTNCLAPLAKVINDEFTIIEGLMTTIHSYTATQKTVDGPSAKDWRGGRTAAQNIIPSSTGAAKAVGKVIPELNGKLTGMAMRVPTANVSVVDLTCRIEKGATYEEIKAVVKKAAEGPLKGILGYTEDDVVSTDLNGDNHSSIFDAKA

SEQ ID NO: 887 - protein, 256 aa, Sclerotinia sclerotiorum
AYMLKYDSTHGQFKGDIKVLSDGLEVNGKKVKFYTERDPANIPWAESEAYYVLESTGVFTTTEKAKAHLKGGAKKVVISAPSADAPMYVMGVNNETYNGEADVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKAASYDEIKEVIKKAANGPLKGILAYTEDDVVSTDMNGDNHSSIFDAKA

SEQ ID NO: 888 - protein, 475 aa, Photobacterium sp. SKA34
MFKQQAFINGQWSDAFSGKTANITNPATNEVIGHVPLMGVEETNIAIDAADKAYRLWSKTTAKHRSMILRQWYELIVSHSDELANILTAEQGKPLAEAKGEIAYAASFVEWYAEEAKRLNGEIIPSHKEDARILVSRQPVGVVAAITPWNFPAAMITRKCGPAFAAGCSVVLKPAPDTPYTAFALAELAHRAGIPAGLFNVITGDAVKIGAELMSNKRVRKVSFTGSTAIGKLLMAQSAATVKKVSLELGGNAPFIVFNDADLSRAIDGVMVSKFRNAGQTCVCTNRIYVHSDVYQQFVEKLAEKVSALTVGNGVDNGVTIGPLINRAAVEKVEKHINDAMMKGANLVIGTRKPSISCFVQPTVLSDVTDNMLVANEETFGPLSAVFKFTDEQDVITRANNTDSGLAAYVYTQSLSRVFRVSEALEYGMVGVNEGLISTELAPFGGIKESGIGREGAHQGLEEYTEMKYTLMGGL

SEQ ID NO: 889 - protein, 828 aa, Ustilago maydis 521
MASHSSSAHGATAEAARVPSLSAPSQYRPMSSFSLSSSFSSSISSYASSDIRDRPDTPPQASKSNGGLRLPRFSLWGRNTSSTLISNSNNSSAPSSNTEPDLTQLRISQRRPESPKSPSRDRSRQAASESELPSRPSSPTSVSPMPTLAVNAPLNAPPISLPKLSSVWRMSAGLFTSSSYPANSHDPRLARPHTAESTTPRDFINASPASQFAAWSDFMHSPTPPDRTATFSSNSSASCNSCSRPNMKKIRSQESIRSSTSAVPFDAENSTSSHHSTIPVPKVIKVKLRSKSKANQEPEFDNVFLAQELRCSSTSSAPGSSLNRKVSQARSPSLALEDLPANRGAESRRKRSSWAARRPTSPQTFLDRHYANHPNNAVRSSDDREDDESLYIRPPKVNRQFSTSSYLTTASSTTTSSSNAGEAVAPRSPRMPSEVDEAGRVKRTKSTMPKRKTYALQFSLDGRYLAAAGSDHLIRVYEVISSPADRADEIELAQMHRAEQAWQKKMSSACPQGPQGVCGSMRSNTKMDVRAATPELVPVFKSTPIHIFQGHAGDVLDLSWSKNNFLLSSSTDKTAKLWHPNRSECLCTFSTSATVSSVDFHPTDDRFFVSGGLDGKLRLWNIAARRVQSINDVPGVITAVAFSSSGSSVCVGTHSGSMLTFSCTDSLTFVNAVTVKSAAASKTALASKITSIQPIKLDVTATTDSAAPPSAREYMTVTSNDSRIRIYSIVSRRIVSRFKSTSYINRSSQIRATSSSDSQFLVSGSEDAWIHVWSLASNASLFAALFAGMKRNKSTLRSPAQARASDAGDNSTYRSWQAGAGSHTTPWS

SEQ ID NO: 890 - protein, 545 aa, Zea mays
  misc_feature (491)..(491): Xaa can be any naturally occurring amino acid
  unsure (1)..(545): unsure at all Xaa locations
MGDFNVALVIVAAVVSVLVLLVSVYLLVNYQHPDDVNQAYFPKLVVVLGLTVAVLSILMLPADVANRQACRKAVYNGACSLTLPMRTLWLVVYIVDAVLVFLVIPFAMFYYEGDQDKSVGKRLRTALIWVVASAVVCGLVLGILYGLVGKVDFTVRHLSSSVQTFPNSFSGFSSGQPCFSPLTRQCAASTAPANSQTTWTMRATFPEYVVALTTIVGSVLFTIFGGVGIACLPLGLIFSFVRRPKAVITRSQYIKEATELGKKARELKKAAEALHQEERSGNKGRKWRKNVKALEKELLLLEDDMKALEEMYPQGEQAEATWAFTVLGYIGKLLFGVVGLIVSIAWVAHIVIYLLIDPPLSSFLNEVFIKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKLVSQMKSRFSCSVLQVLXTLLNFDCILILYHKTCRYNVFQYGFVALAILTLFYYAIFGWRKRKPTGRFQLSN

SEQ ID NO: 891 - protein, 573 aa, Saccharomyces mikatae IFO 1815
MAFEENNKPVASEQPQAAEDLVSSFSKDSHLSAQSQKYSNDELKAGEANPEGSESVPMEIPKKPMSEYVTVSLLCLCVAFGGFMFGWDTGTISGFVAQTDFLRRFGMKHKDGTHYLSNVRTGLIVAIFNIGCAFGGIILSKAGDMYGRKKGLSIVVSVYIVGIIIQIASINKWYQYFIGRIISGLGVGGIAVLSPMLISEIAPKHLRGTLVSCYQLMITAGIFLGYCTNYGTKNYSNSVQWRVPLGLCFAWSLFMIGALTLVPESPRYLCEMNRVEDAKHSIAKSNKVSPEDPAVQAELDLIMAGVEAEKLAGNASWGELFSTKTKVFQRLLMGVLVQMFQQLTGNNYFFYYGTIVFKSVGLNDSFQTSIVIGVVNFASTFFSLWTVENLGRRKCLLLGAATMMACMVIFASVGVTRLYPHGKSQPSSKGAGNCMIVFTCFYIFCYATTWAPVAWVITAESFPLRVKSKCMAMASASNWVWGFLIAFFTPFITSAINFYYGYVFMGCLVAMFFYVFFFVPETKGLSLEEIQELWEEGVLPWKSEGWIPSSRRGNDYNLEDLQHDNKPWYKAML

SEQ ID NO: 892 - protein, 355 aa, Oryza sativa (japonica cultivar-group)
MTNGAGGGGGGGGLGGTRVPTWRERENNRRRERRRRAIAAKIYAGLRAYGNYNLPKHCDNNEVLKALCNEAGWTVEPDGTTYRKGCKPPQAERPDPIGRSASPSPCSSYQPSPRASYNPSPASSSFPSSGSSSHITIGGNSLIGGVEGSSLIPWLKTLPLSSSYASSSKFPQLHHLYFNGGSISAPVTPPSSSPTRTPRLRTDWENASVQPPWASANYTSLPNSTPPSPGHKIAPDPAWLSGFQISSAGPSSPTYNLVSPNPFGIFKEAIASTSRVCTPGQSGTCSPVMGGMPAHHDVQMVDGAPDDFAFGSSSNGNNESPGLVKAWEGERIHEECASDELELTLGSSKTRADPS

SEQ ID NO: 893 - protein, 482 aa, Azoarcus sp. EbN1
MPRHTKIVATLGPASSDPQVLERMVHAGVDVVRMNFSHGKAEDHVARAEAIREAASLAGRPVGILADLQGPKIRVGKFAEGQVELQRDAGFILDARCELGNAERVGLDYKDLPKDVKAGDVLLLDDGRLKLTVTRVIGHEIHTVVKVGGTLSNNKGINRQGGGLTAPALTAKDMDDIKTAAKIGVDFVAVSFPKSAADMYMARQLMRASGVDALLIAKIERTEAVANLDEILDASDGIMVARGDLAVEVGDAAVPALQKKMIRAARDRNKLTITATQMMESMITSPVPTRAEVSDVANAVLDGTDAVMLSAETASGRFPVEVVEAMSRVCLEAEKSSDVALDRDVLNRVFTRIDQSIAMAAIWTAWHLKVKAIASLTQTGSTALWMSRLNSGVPIYALTPEASARNQMTLYREVFPLLMSQTHQDRDVLLWEAEQILIDQGVAERGDLIVLTIGEPIGASGGTNTLKIVRVGEHPPPHVTDQ

SEQ ID NO: 894 - protein, 421 aa, Triticum aestivum
  misc_feature (304)..(304): Xaa can be any naturally occurring amino acid
  misc_feature (313)..(313): Xaa can be any naturally occurring amino acid
  misc_feature (355)..(355): Xaa can be any naturally occurring amino acid
  misc_feature (365)..(365): Xaa can be any naturally occurring amino acid
  misc_feature (375)..(375): Xaa can be any naturally occurring amino acid
  misc_feature (380)..(380): Xaa can be any naturally occurring amino acid
  misc_feature (384)..(384): Xaa can be any naturally occurring amino acid
  misc_feature (391)..(391): Xaa can be any naturally occurring amino acid
  unsure (1)..(421): unsure at all Xaa locations
MSGASGPLAVLLLVLVAAVSASSAGKGESWRAEQERDRVPRVPGQAFNASFAHYAGYVTVSEERGAALFYWFFEAAHDPASKPLVLWLNGRPGCSSIAFGVGEEVGPFHVNADGKGVHMNPYSWNQVANILFVDSPVGVGYSYSNTSADILSNGDERTAKDSLVFLTKWLERFPQYKEREFYLTGESYAGHYVPQLAQAIKRHHEATGDKTINLKGYMVGNALTDDFHDHYGIFQYMWTTGLISDQTYKLLNIFCDFESFVHSSPQCDKILDIASTEAGNIDSYSIFTPTCHSSFASSKNKVVXKRLRAGGKXGEQYDPCTEQHSIVYFNLHEVQKALHVNPVIGKSKWETCSEXINTNWKDCKXSVLHIYHELXQHGLXNVSXGDTRSLXPFTQTKITLIQTSNMIPWLGKIWRFVAGPR

SEQ ID NO: 895 - protein, 790 aa, Oryza sativa (japonica cultivar-group)
MDDLPDDQGQSDAHPSDPNWWSSHAEHKLGSISLTKQERNSGSPGSSHCGEGDHSLWAAQTLWCTGCLSSPIPNGFYSIIPDKKLKERFDTIPSPDDLYSLGIEGFKAEIILVDLEKDKKLSAIKQLCAALVKGLKSNPAAMIKKIAGLVSDFYKRPNPQLSPARTSSEEISHFMENRGVQLLGQIRHGSCRPRAILFKVLADAVGMDCKLLVGIPNEEYHEYDDSSKHMSVVVMLKSVEFLVDLMRFPGQLVPFSSKAIITSHISAAGESDSADYDSCDSPLEPNSPLCSQRQEQDDNNRSFKVPSLRNIMLKSTNSMEGKLRCSSHSEPNVANSFCGRSRRKVVEEHQRTASSSPEHPLSRTRGRSMLGDRQHGDGVAVSRSDGASTSNMRRGRRRSISFTPEIGDDIVSAVRAMSERMRENRLSRGQNDGSPGQLNDSQKNESPHDFNDNELHVRGPDEQEGSRRQVSNQKAVSLPSSPHRLRSDGSGLRGPAEFLTADLMSTWNKVLRSSPFLNKPLLPFEEWHIEFSEITVGTRVGIGFFGEVFRGIWNGTDVAIKLFLEQDLTTENMEDFCNEISILSRLRHPNVILFLGACMKPPHLSLVTEYMEMGSLYYLIHASGQKGKLSWRRRLKMLRDICRGLMCMHRLKIVHRDLKSANCLVNKHWAVKLCDFGLSRVMSNSAMNDNSSAGTPEWMAPELIRNEPFTEKCDIFSLGVIMWELCTLSRPWEGIPSVQVVYNVANEGARLEIPDGPLGSLIADCWAEPDKRPGCQEILTRLLDCEYTLC

SEQ ID NO: 896 - protein, 142 aa, Triticum aestivum
  misc_feature (87)..(87): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (112)..(112): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (134)..(134): Xaa can be any naturally occurring amino acid
  misc_feature (141)..(141): Xaa can be any naturally occurring amino acid
  unsure (1)..(142): unsure at all Xaa locations
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKFGFLFPLXNXPPGYYDGXRYWDMLXLPXFRXTGPTQVLNXVEESKKXT

SEQ ID NO: 897 - protein, 392 aa, Mycobacterium sp. MCS
MRAVTWQGRRKVSVDNVPDPIIKEPTDAVIRVTSTNICGSDLHLYETLSAFMSPGDIIGHEAMGVVEEVGTQTGDLKVGDRVVIPFNISCGTCWMCDHGLQSQCETTQNRDQGTGAALFGFSKLYGEVAGGQAEYLRVPQAQYTHIKIPEDGPDERFVYLSDVLPTAWQGVEYANVPDGGTLVVVGLGPIGSMACRIAAHRNNCRVIGIDLVEERLDRARPYCAEVIDLRTQDADAVVAELTQGRGADSVIDAVGMEAHGSPVAEAAQTASGFLPSSIGRVVMKHAGVDRLAALNSAIALVRRGGTVSLSGVYGGAADPINMMTLFDKQVTLRMGQANVKRWVPDILPLLTADDPLGVENFATHRLPLAEAPGAYETFQKKQDGMVKVVLTP

SEQ ID NO: 898 - protein, 393 aa, Anthoceros formosae
MTMLAAKADPMTLSMGPHHPSMHGVLRLIVTLDGENVTDCEPILGYLHRGMEKIAENRTIVQYLPYVTRWDYLATMFTEAITVNAPEKLTNIQVPKRASYIRIIMLELSRIASHLLWLGPFMADIGAQTPFFYILREREMIYDLFEAATGMRMMHNFFRIGGVAVDLPYGWVDKCLDFCDYFSLKVDEYERLITYNSIFLKRVEGVGTISREEAINWGLSGLMLRASGVQWDLRKVDHYECYDELDWQVQSQTEGDSLARYLVRIGEMRESVKIIQQALKVIPGGPYENLEARRLNQGKDSEWNDFEYQFISKKPSPTFKLPKQEHYIRVEAPKGELGIYLIGDDSVFPWRWKIRPPGFINLQILPQLVKGMKLADIMTILGSIDIIMGEVDC

SEQ ID NO: 899 - protein, 452 aa, Frankia sp. CcI3
MDKQQEFVLRTLEERDIRFVRLWFTDVLGYLKSVEIAPAELEGALAEGIGFDGSAIEGFARVHEADMLARPDPSTFQVLPWRGEHPLTARMFCDLVMPDGTPAAADSRWVLRSALARAADAGFTFYTHPEIEFFLLREPPKRGGPVPPPVDESGYFDLTPNDISHDFRQQAISMLERLGISVEFSHHEVAPGQQEIDLRYADALTIADNIMTFRQVVREVALRQGIYATFMPKPFGNQAGSGMHTHLSLFEGDRNAFHDPTDDYQLSKVAKAFIAGLLAHAAEITAVTNQWVNSYKRLIGDQRVGEVLEAPAYVCWGHNNRSALVRVPLYKLHKSNATRVEFRLPDSACNPYLTFALVLAAGLRGVQGGYELPPASADDVWTLTDTQRRERGITALPGSLAEAVKVMEHSALVRETLGDELFDFFLRNKRAEWLEYRRQVTPFEIDRYLPVL

SEQ ID NO: 900 - protein, 296 aa, Frankia sp. CcI3
MDASDTPTHPAPHPADPAATPYGAPTTPPRPLRSRFTVRDVAAAKNRGEKWSMLTAYDATTAAVFDEAEIPVLLVGDSAANVVYGYDTTVPITVDELLPLVRAVVRGAPHAMVVADLPFGSYQGGPAEALASATRFLKEGGAHAVKLEGGSRVVRAVDALVGAGIPVIGHLGLTPQSIHTIGGYRVQGRDEAGEILLADALALEAAGAFAVVLEVVPADLATRVTKELRIATVGIGAGSGCDAQVLVWQDMAGLSGGRTPRFVKRYADLRTILADAARAYRADVRDGRYPTIEHSY

SEQ ID NO: 901 - protein, 142 aa, Dechloromonas aromatica RCB
MAIERTLSIIKPDAVAKNVIGKIYSRFESNGLKVIAARMTWLSEQEAGQFYSVHKERPFFKDLVSFMTSGPVMIQALEGENAIAKNRELMGATDPKKADAGTIRADFAESIDANAVHGSDAPETAAVEIAFFFPGMNTYAGR

SEQ ID NO: 902 - protein, 314 aa, Cyanidium sp. 3-8 CR
NGFGRIGRLVLRAALESKLIRVTAINDPFIGSDPAYVAYLLTHDTAQGRFFGEIRVDDDCIMIDSVPIRCFAVHDPAEIPWQQAGVEYVVEASGKFVTREGAEKHLLAGARKVIVSAPAKDVPMFVVGVNHSQYHPSMDIVSNASCTTNCLAPLAKILDEHFGIEQGLMSTIHAVTGTQRTVDGPSSKDWRRGRSALGNVIPTSTGAARAVGKVYPKLEGKITGLAYRVPLAVVSIVDFTVVLQKPVTLSQLKEVMRAASEHPTYRGIVGYTEDAVVATDMAHSAFSTVFDAEASIVLSPTFVKIVAWYDNEWG

SEQ ID NO: 903 - protein, 507 aa, Mycoplasma genitalium G37
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVIFFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 904 - protein, 206 aa, Cryptococcus neoformans var. neoformans JEC21
MVNIRNIELLNNPAKFDDPYNFRIKFEAIAPLVEDLDWRLIYVGSASSEEFDQELDNCSVGPIPAGINAFDFSAPAPAHHLLPSVEPDEILGVTVIIITASYREKEFVRVGYYVNTYYEDEELKENPPSVVQWDKLHRNVLIEKPKVTRFQNNWDSAPQLNTFDGQQPAAELPPSGGNPELFNAPLPPPVQRATAAGGMDVDQPMA

SEQ ID NO: 905 - protein, 253 aa, Zea mays
METEREKQVYSAKLSEQTERYDEMVEAMKKVAQMDVELTVEERNLVSVGYKNVIGARRASWRILSSIEQKEESKGNEENVKRIQNYRKRVEEELAKVCNDILSVIDKHLIPSSTAVESTVFFYKMKGDYYRYLAEFSSGAERKEAADQSLEASKAAVAAAETGLAPTHPVRLGLALNFSVFYYEILNSPESACQLANQAFDDAIAELDSLSEESSKDSTLIMQLFRDTLTLWTSDLPEEGEEKSKGDHPKEEN

SEQ ID NO: 906 - protein, 393 aa, Spinacia oleracea
MASASLLKTSPVLDNPEFLKGQTLRIPSVAGVRFTPSGSSSLTVRASSYADELVKTAKTVASPGRGILAMDESNATCGKRLASIGLENTEANRQAYRTLLISAPGLGQYVSGAILFEETLYQSTTDGKKMVDVLIEQGIVPGIKVDKGWLPLPGSNDESWCQGLDGLACRSAAYYQQGARFAKWRTVVSIPNGPSALAVKEAAWGLARYAAITQDNGLDPILEPEIMLDGEHGIDRTFRVAQQVWAEVFFNLAENNVLLRDPLKPSMVGPGALSARKGPPEQVADYPLKLLHRRRGPVVPGIMVLSGGQSEVEATLNLNAMNQSPNPWHVSFSYARALQNTCLKTWVEGQENVKAQDFACAKSNSLAQLGKYTGEGESEERKKDMFVKATLTY

SEQ ID NO: 907 - protein, 125 aa, Brassica napus
MKFFLCILALQQLYVLSVAQDFDFFYFVVQWPGAYCDSRHSCCYPKTGKPAADFGIHGLWPNYKTGGWPQNCNPDSTFDELRVSDLMSNLQREWPTLSCPSNDGVHFWTHEWEKHGTCAESELDQ

SEQ ID NO: 908 - protein, 376 aa, Shewanella oneidensis MR-1
MTAQILKSKAAVAWAVGEPLSIEIVDVMPPQKGEVRVKMIATGVCHTDAFTLSGDDPEGIFPCILGHEGGGIVESIGEGVTSVQVGDHVIPLYTPECGECKFCKSGKTNLCQKIRETQGKGLMPDGTSRFSKDGQIIYHYMGTSTFSEYTVLPEISLAKVNPDAPLEEVCLLGCGVTTGMGAVMNTAKVEEGATVAIFGMGGIGLSAVIGATMAKASRIIVIDINESKFELAGKLGATDFINPKDYDKPIQDVIVELTDGGVDYSFECIGNVNVMRSALECCHKGWGESVVIGVAGAGQEISTRPFQLVTGRVWKGSAFGGVKGRSELPEYVERYLAGEFKLSDFITHTMSLEQVNDAFDLMHQGKSIRTVIHFDK

SEQ ID NO: 909 - protein, 425 aa, Mycoplasma genitalium G37
MQQTFFKDPILGEIIFDENTKWMYELVNTKAFQRLRNIKQLGINFHFYPSGVHTRYAHSLGVYELIRRILNSSAFLNIDQIKKQTVLVAGLLHDLGHGPHSHAFEIYFAKNPDFKKQLFIHEKVTSMLVNSEPIVSILKANKIDPNLIGALIDENQNIQPINWWMRQLISSDLDTDRMDYLLRDAYFTGTSHSLVDYQSIINGMECVDNQGTYEIVFQEKCLPFIENFLITRHHMYQSIYSDGRSIATELNLWFVFQRIKALIEEDNFNFHNFKNVESVIKPLLKNQLFKKSLLTCFVKLDDYVFHSFLVNTFETTKDAILKTLLDSYLNTLKFQVKFYESCEKRDLDFELKVKEYQTPSYFITKFNNQFKGFYEGWNKHKNELKIKTSQNKIKNLSEISMLVKRSNELFFENSFYRWANVFYQN

SEQ ID NO: 910 - protein, 153 aa, Glycine max
FGTRPRADDHHVLLEGTLLKPNMVTPGSESARVKAEVIAEHTVRALQRTVPPAVPAIVFLSGGQSEEEATVNLNAMNQLKGKKPWSLTFSYGGALQQSTLKAWGGKDENIPKAQSALLVRCKANSEATLGTYKGDATLGEGASESLHVKDYKY

SEQ ID NO: 911 - protein, 470 aa, Salmonella enterica subsp. enterica serovar Paratyphi A str.
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGSVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 912 - protein, 482 aa, Arabidopsis thaliana
MGDFNLALVIVAIVVCVIVFISSIYLLVNYQHPDDANQAYFPKFVVVFGLSIAMISILMLPADVANRHACRHAIYNGACNLTLPMKDLWLAIYIVDAILVFFVIPFAMFFYEGDQDKTLGKRIKSALIWVVTTAVVCALVLGILYGVIGKVDFSFSNTQPCIGNTARQCSAFTANPTSEKTWTMRTTFPEYVVALATIVGSVLFTIFGGVGIACLPLGLITAFIRRPKAVITRSQYIKEATELGKKARELKKAADGLHQEERSGAKGRKWRKNVKAVEKELLQLEEDVNLLEEMYPQGEQAETAWAFTVLGYLAKFILGIVGLIVSIAWVAHIIIYLLVDPPLSPFLNEVFIKLDDVWGLLGTAAFAFFCFYLLLAVIAGAMMLGLKLVFITIHPMKWGATLMNSFLFNVGLILLCSISVIQFCATAFGYYAQATAAQEIFGHTLQSLRGIKYLYKYNVFQIGFVILAGLTFLYYIAFVSPR

SEQ ID NO: 913 - protein, 460 aa, Methanosarcina acetivorans C2A
MEMKGIKSIILAGGSGTRLWPLSREMYPKQFLKFGDTSLFQETVLRCLEVSDISEIFVVTNEAQKFFVIGQIKEIGYSIPPENVLIEPEGKNTLPAIFFGMKEIEQKFGNSIVGVFSSDHVLDRAAMATIFSAEKLTSDYLVTFGVVPAFPHTGYGYIKAAESCEPGYRVSEFREKPDFETAQKYIEEGCLWNSGMFLFETRLFFEEVKKHAPSIFACFEKGGSIDEIYACVDNVSIDYGIMEKSDRVAVVKLDQKWSDLGNFAAIYDELEKDSVGNVVHECDSMLLNSDGNLVYSKCGKIVSLIDIKDMVIVDTSDALLICPKSSSQRVKEIVSDLKGRNDERAFIGQTVYRPWGSYTLLDASPGHKIKNITVLSDHRLSLQLHYHRSEHWVVVKGMACVEVNGEQFFLRPGESTFIRAGQRHRLSNPGKVPLEIIEVQLGELVDEDDIVRFDDEYGRS

SEQ ID NO: 914 - protein, 263 aa, Sulfitobacter sp. EE-36
MTSVNNGASTAGATGAKALNASWPDGYGRQVFDSVDSTLSEAARQASELTGSTWILAQEQTAARGRRGRSWATPRGNFAATLMMRRSESPSTAALRSFVASLALRRAFVATTRDEGAFTLKWPNDVLLNGGKVAGILLESIGDFLAIGIGVNLAHAPGADQVEAGALRPVSVVAETGKVVPPEVFLDALAAEYAQLETQFQTYGFAPIRTAWLSHAARLGEEIVARTMKDETRGVFEDVDAQGNLILRTPKGRVPITAADVFF

SEQ ID NO: 915 - protein, 180 aa, Guillardia theta
CSAPPAVTRLLPSSCSTGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNKMVLGK

SEQ ID NO: 916 - protein, 166 aa, Triticum aestivum
  misc_feature (28)..(28): Xaa can be any naturally occurring amino acid
  misc_feature (98)..(98): Xaa can be any naturally occurring amino acid
  unsure (1)..(166): unsure at all Xaa locations
ATSVAPFQGLKSTAALPVSRRSNGASLXSVSNGGRIRCMQVWPIEGIKKFETLSYLPPLSTEPLLKQVDYLIRSKWVPCLEFSKVGFIFREHNASPGXYDGRYWTMWKLPMFGCTDATQVINEVEEVKKEYPDAYVRIIGFDNMRQVQCVSFIAFKPPGCEESGKA

SEQ ID NO: 917 - protein, 262 aa, Xanthomonas oryzae pv. oryzae KACC10331
MNSSFSAPAKKSLGQHFLADRYYIDRIVQAVDPRAGQHLVEIGPGQGAITFPLLRKHGALTVIEFDRDLIAPLTEAAAPIGALSIIHRDVLSVDFTALADGTPIRLVGNLPYNISSPILFHALDHAAVVADMHFMLQKEVVDRMAAGPGSKVYGRLSVMLQAYCDVTALFVVPPGAFRPPPKVDSAVVRLVPRDPATVHINDRRRFADVVRAGFGQRRKTLRNALSTVCEPAHFEAAQVRPDARAEQLEVADFIRLANVEPA

SEQ ID NO: 918 - protein, 596 aa, Mycobacterium sp. MCS
MDHSSGSPAHPDHDPAEGSHIEDGVVEHPTAGDFGHARMVPEDRTWFKRAVFYEVLVRAFHDSDADGSGDLRGLTERLDYLQWLGVDCLWLPPFYDSPLRDGGYDIRDFYKVLPEFGTVEDFVTLLDAAHRRGIRVITDLVMNHTSDSHPWFQESRRDPDGPYGDFYVWSDTSDRYADARIIFVDTEESNWTFDPVRRQFYWHRFFSHQPDLNYDNPAVQEAMLDVLRFWLDLGIDGFRLDAVPYLFEREGTNCENLPETHAFLRHCRKVIDDEYPGRVLLAEANQWPADVVAYFGDPDTGGDECHMAFHFPLMPRIFMAVRRESRFPISEILAQTPEIPDMAQWGIFLRNHDELTLEMVTDEERDYMYSEYAKDPRMKANVGIRRRLAPLLENDRNQIELFTALLLSLPGSPVLYYGDEIGMGDIIWLGDRDGVRTPMQWTPDRNAGFSKATPGRLYLPPNQDAIYGYQAVNVEAQRDSSNSLLNWTKTMLGVRRRHDAFAIGAFRELGGSNPSVLAFVRETATDTVLCVNNLSRFPQPIELNLQQWNGFTPVEMTGYVDFPSIGALPYLLTLPGHGFYWFQLRAPDPEPEGVQP

SEQ ID NO: 919 - protein, 374 aa, Guillardia theta
GHTSNFTSIILSGVHAADLLHCLQELNFGVSAHVERASVAVARHSTMAVPSLSLMEIGARPSDPKPHILVVVLDPLGDVMRAQLLNVIGKLFAIAEVMAAAGAEAAGFYSSPVMQLRGGGDRRFLIAGNWKMNPETMDEAKALASSVVESAKSVKKGVDICICCPHPFLATCAQICKDSEVKIGAQDIFTEEKGAFTGGVSIKQVESIGCKYVLIGHSERRHGNIASESNAMINKKVKMTIDSGLVACLCIGETKAEFEAKKNKEVCAKQLAEGLAGVTKEQLANVVLAYEPVWAIGTGYTASPEIAQDVHNYVRQWLEQNYDKATAESVRILYGGSVTPDNVDQLMACPDIDGALVGGASLVGEKFARIMNFK

SEQ ID NO: 920 - protein, 513 aa, Vibrio angustum S14
MSAKKPLALVILDGWGYREDNADNAIANAQTPVMDGLLAQNPNTLISASGIDVGLPDGQMGNSEVGHTNIGAGRVVYQDLTRITKAISDGEFFENEALVTAIDKAVNAGKAVHILGLLSPGGVHSHEDHIAAAIEMAAKRGAEKIYLHAFLDGRDTPPRSAKNSLVRFNELFAKLGKGRTASLIGRYYAMDRDNNWDRVEKAYDLITAAKAEFTVANAVDGLAAAYERDENDEFVQATEVRAEGQEAAIVADGDSVIFMNYRADRAREITRAFEPGFTDFARAQFPQLSDFVMLTQYAADIELTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLELKSGGKLSDLAPTMLSLTDMEIPAEMSGQVLYNLK

SEQ ID NO: 921 - protein, 497 aa, Moricandia nitens
MERARRLAYRGIVRRLVNESKRHRKGEITPHHVPSVVPHAPARYISSLSPYLSNHRSVNVGARHHHNHHQTRSISVEAVKPGDTFPRRHNSATPDEQAHMAKLCGYDHIDSLVDATVPKQIRIDSMKFSKFDEGLTESQMIAHMTELASKNKVFKSFIGMGYYNTHVPTVIIRNILENPAWYTQYTPYQAEISQGRLESLLNFQTMITDLTGLPMSNASLLDEGTAAAEAMAMCNNIQKGKKKTFVIASNCHPQTIDICKARADGFDLKVVTKDLKEIDYSCGDVCGVLVQYPGTEGEVLDYGEFVKNAHANGVKVVMATDLLALTVLKPPGEFGADIVVGSAQRFGVPMGYGGPHAAFLATSQEYKRMMPGRIIGVSVDSTGKQALRMAMQTREQHIRRDKATSNICTAQALLANMAAMYAVYHGPAGLKSIAERVHGLAGIFSLGLKKLGVAEAQDLPYFDTVKIKCSDAHAIADAAVKSEMNLRVVDSNTVSLL

SEQ ID NO: 922 - protein, 341 aa, Medicago truncatula
MALEGVLLGMGNPLLDISAVVDEDFLKKFDIQLNNAILAEDKHKSMYDEMAAKYNVEYIAGGATQNSIRVAQWMLQVPGATSYIGCIGKDKFGEEMTKNSKQAGVNVHYYEDENTPTGTCAVCVVGGERSLIANLSAANCYKVDHLKQPENWALVEKAKYFYIAGFFLTVSPESIQLVAEHAAANNKVFMMNLSAPFICEFFKDPQEKALPYMDYVFGNETEARTFSKVHGWETENVEEIALKISQLPKASEARKRITVITQGADPVCVAQDGKVTLYPVILLPKEKLVDTNGAGDAFVGGFLSQLVQEKPIEECVRAGCYAANVIIQRSGCTYPEKPDFH

SEQ ID NO: 923 - protein, 581 aa, Mesembryanthemum crystallinum
MVEGGVVKVDKTEFTECFRTVGKTPYIMRLAFSAGIGGLLFGYDTGVISGALLYIKEDFKEVAQKTWLQETIVAMAVAGAIVGAGLGGFLNDKFGRKPAMIVADILFLTGAIIMSVAPAPWVIIIGRIVVGLGVGMASMTAPLYISETSPAKIRGALGATNGLLITGGQFVSYLVNLGFTRVKGTWRWMLGVAAVPAAIQVVLMLTLPESPRWLYRQNKISEAEEILGRIYPPEQVKEEMDSLKTSIENEMADRKAVGEGNAFVRAKRAWDNKVVRRGLIAGISVLVAQQFVGINTVMYYSPTIIQLAGFASNSTALALSLVTSGLNAVGSIVSMMFVDRFGRRRLMIISMFAIITCLVVLSGLFYGAAQAAPKISQLESSHFGANSTCPAFASATSPDRWNCMTCLKASDCAFCSNSASEFHPGACVAQTSTMKNACLGEKRIYFTEGCPSKFGFMAIIVLGLYIITYSPGMGTVPWILNSEIYPLRYRGICGGIGAVTLWCANLIVSETFLTLTEALGSSGTFLLYAGFSLIGLIVIFLLVPETKGLPIEDIEKMLEKGFWPSLCGGNKDKDNKEEQQA

SEQ ID NO: 924 - protein, 581 aa, Mesembryanthemum crystallinum
MVEGGIVKADKTEFTECFRTIGKTPYILRLAFSAGIGGLLFGYDTGVISGALLYIKEDFKEVERKTWLQETIVAMAVAGAIIGAGVGGYLNDKFGRKPAIIIADILFFIGAIIMSLAPAPWMIILGRIFVGLGVGMASMTSPLYISETSPTRIRSALVSTNGLLITGSQFLSYLINLGFTRVKGTWRWMLGVAAVPAFVQLLLMLSLPESPRWLYRKNKVVEAEAILARIYPPEEVEEEMRALKASIEYEMAEEGEIGGGSMLSKVRKAWGNKIVRRGLYAGITVQVAQQFVGINTVMYYSPTIVQLAGFASNSTALALSLVTSGLNAIGSIVSMMFVDRHGRRRLMIISMFGIITCLIVLAIGFFQAAAHAPKISHAESTHFGLNSTCPAYTTTRNPATWNCMTCLQAASECAFCTNKGNQLLPGGCVSRTDAMKVACHGEKRVYFTEGCPSKFGFLAVILLGAYIISYSPGMGTVPWIVNSEIYPLRYRGVGGGIAAVSNWTSNLIVSETFLTLTEALGAAGTFLLFAGFSAIGLVFIYLLVPETKGLPIEEVEHMLENGFKPSIFRGNKDKETKASGT

SEQ ID NO: 925 - protein, 262 aa, Chromobacterium violaceum ATCC 12472
MSKHIPRKRFGQNFLQDASVIAGIVHAVNPQPDDIVIEIGPGLGAITKPLLARLKHLHVVEIDRDIIERLKAEHPADKLTIHAGDALAFDFASVSEAPLKIVGNLPYNISTPLLFHLASYGNRVTDMHFMLQKEVIERMVAEPSTADYGRLTVMLQYRFYMENILFVPPEAFWPPPKVDSAVVRMIPAPGRCGTARDEALLEKLVSQAFAQRRKTLRNNLKGLADAADLEALGIDPGLRPENLPVEDFVRLANHLHDKGARG

SEQ ID NO: 926 - protein, 258 aa, Triticum aestivum
ILPIQIIRIGQLVILSVPGEFTTMAGRRLRDAVKNVLISGSNGEFNSNTHVVLAGLTNTYSHYVTTFEEYQVQRYEGASTLYGPHTLSAYIQEFQKLATAMVANKEIPATNILPPDMLDKQIGLLPGVILDSTPPGVHFGDVSSDVAANSDFRKGSTVNATFHSACPRNDLLTDGTFALVERLNGDNWIPVYDDDDWSLRFKWSRPSKLSPESFATLEWTIPEDAAPGVYRLRHFGASKPLIGSIEHFTGTSRAFAVR

SEQ ID NO: 927 - protein, 224 aa, Triticum aestivum
MDPAAPPRPARPAVRRMDAVKQALMLFLHSKLTMCPDHRFAFASLRDTVSLISKEFTSDAASSIETIRSLAPTETRYAVADLTHLFKIAYEEGKRAETQGRLLRVVLIYCRSSTKPHHLWPVKPKNFTMDIVYLHDKPTADNCPQNVYDALVDALEHVSQYEGYILESGQGLARVLFRQICIILSHPLLRCMQDDLDIPKQVVKKILAIEGVQSEDGAPASGSQ

SEQ ID NO: 928 - protein, 401 aa, Rickettsia rickettsii
MSIISTRLSSIKPSPTLAVVKKTLELKKAGVDIITLGAGEPDFDTPYNIKEAAIKAIKDGFTKYTNVEGMPLLKQAIKDKFKRENNINYELDEIIVSTGGKQVIYNLFMASLNQGDEVIIPAPYWVSYPDMVALSTGTPVFVNCGIENNFKLSAEALERSITDKTKWLIINSPSNPTGASYNFEELENIAKVLRKYSHVNVMSDDIYEHITFDDFKFYTLAQIAPDLKKRIFTVNGVSKAYSMTGWRIGYGAGSKALIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 929 - protein, 179 aa, Glycine max
  misc_feature (9)..(9): Xaa can be any naturally occurring amino acid
  unsure (1)..(179): unsure at all Xaa locations
ALIVNWRAXLKIGPNEPCELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGKDENIKKAQDALFARCNANSHATLGTYKGDATLAEGASESLHVKDYKY

SEQ ID NO: 930 - protein, 272 aa, delta proteobacterium MLMS-1
MNWKRLFSRTESLDPAEARNFMDQRSAADYQLLDVRQPKEYEAAHLPGARLIPIKELAQRQAELDPARPVLVYCAVGGRSRAAAQYLNGQGFKEVYNMAGGIKAWDGGKAAGPVEAGLELLPAEAEYDEAAALAHAMEDGLQRFYLKLATDSGDAALKKTYQHLASLEEGHKARLAREYRDKTGKNLEPTGQDELLEGGRPPTAFTAATPVQALDQAMGLEFQAQDLYLRLAAQSEMAASRDFFLAMAAEEKEHLAFLAKELEKIGEVNHAA

SEQ ID NO: 931 - protein, 325 aa, Zea mays
ARDHYLEHPIRQDLIPYPCAAHLPFPAWSSHSLAPFFPSPDLPIPEITPDTPHPRTPRPHLAMGSAAASPPPSGKLTQEELKRVAAHRAVEFVEPGMTLGLGTGSTAAHALDRLGDLLRAGALPGVAGVPTSLKTEAHAARAGIPLLPLPGARIALSIDGADEVDPDLNLVKGRGGSLLREKMIEGAGARFVVIVDESKLVPRLGCTGAIPVEVIPFGALHTLGLIRGLFDGLPGFHARLRTVPAAPAKGGEDSDSESEQPFVTDNGNYIVEMFFEDGIRGDLRDISDRLLRITGVVEHGMFLGMATTVIVANKDGTVSVMDRKK

SEQ ID NO: 932 - protein, 379 aa, Oryza sativa
MGAAGAMERELLEAFEAARKAADAVGEAAAAAGAGEGESPEAARCVDALRRLRGARVTTAALVSTQIGRRIRYLTKHPHSSIKATASDLLGHWKKVVIEEDKKNGALQNGKSSSTVVKVEKVEPMKVEKASPRATVNNNNMDTRVVNHKGGKVEKFSNAELRTQSIKVEKVQKVVHKVSSVEKPSPVQGGPPRLTSVVKCGDASRDRIRAILGDAFSRVSEETRKDDREEVRNIIEEVKACDPFRIAVMVECALFQKLGNFNGPNKQRYRSLMFNLKDDHNTDFRRRVLLGQVQPERIADLTPTEMASDTRKLENKKIEEKALFECERGGAPKATTDQFKCGRCGQRKTTYYQLQTRSADEPMTTFVTCVNCNNHWKFC

SEQ ID NO: 933 - protein, 343 aa, Zea mays
  misc_feature (30)..(30): Xaa can be any naturally occurring amino acid
  unsure (1)..(343): unsure at all Xaa locations
RVRVAQYHHHYITRFSQKACLKTFSHSDYXTCIQFNPVDDRYFISGSLDEKVRIWSIQNREIVDWKDLHEMVTAACYTPDGQSALIGSHKGSCHIYDTSDNKLLQKKQIDLQNKKKKSSQKKITGFQFLPGSTSRVLITSADSRIRVVDGLNLVHKYKGFRNTNSQISACLAANGRYVISASEDSHVYIWRNDGSLEKGRSKANVTVTNSYEHFHCQDVTVAVAPPSNGSAVVSRSNSTKHDERDSVLEHPMLHAVPEKLQDSSDLQLQSGNILSTSSNHSGDRATWPEELMTPTKQSPQSSASLLSGADQAPSWSAWGTVIVTAGRGGQIRAFQNFGFPARV

SEQ ID NO: 934 - protein, 265 aa, Azoarcus sp. EbN1
MSEHRARKRFGQNFLSDPNIIRKIIDAIHPVPGETVVEIGPGLGAMTDPLVERLGHLHVVEIDRDLIARLHERYSPERLTIHEGDALKFDFATLGAPLRVVGNLPYNISTPLLFHLAEFAARVRDMTFMLQKEVVMRMVAEPGTEDYGRLSVMLQYRFRMGRLFDVPPGAFRPAPKVTSSIVRMVPLPAEQRTAKDEALLERVVAAAFGQRRKTLRNTLREWLDEADFPALGIDPGLRGERLTVADYVAITNYIAAKSPRALANA

SEQ ID NO: 935 - protein, 256 aa, Streptococcus pyogenes MGAS10394
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPMLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 936 - protein, 334 aa, Coccidioides immitis RS
MPRAEVGSTKFISNKLKSKGLQRLRWYCQVCQRQMRDENGFKCHTQSESHVRQMLLVGEDPKKYIQGYSNDFLRDFIQLLRTSHGEKQVHINHFYQEYIANKEHIHMNATKWSSLTEFAKYLGREGICRVEEGEKGIFISWIDNSPEALRRQDAIRKRERQDRGDEEREKKLIEDQIKRAQRDKDATGTTDGDAPEAPKKLQRVEGEKITLNFASKLTPQENSAFSSASEKPDQPKMDHESETEKSEIPSSASTPAPAAQAQKVPIKLGLGSSGSKSKNVFASMSRKTAATKKADIPPRPLSAIERVMKEDMERKRARENSGFKGSTMKRQKIS

SEQ ID NO: 937 - protein, 432 aa, Arabidopsis thaliana
MGNSNSSSVDHRFISASRAFTQKKLDDLKSLFVSLASNSQSNDQYVSYPVFQPVGFRLSQEYFGLSGSLGERMFDMVTQRRKDDKMTYEDLVIAKATYEKGTDDEIAEFIYQTLDVNGNGVLSRSDLESFLVVILKSVFSTESSDAESSDYKKMVDALLNAATFSKSDDGSEKGMSFEDFRSWCSFVPTIRKFLGSLLMPPSTVRPGYQVPHLLYEDSVSSDRLLLKKEYAWHIGGALPHHELVEWKLLYHSSVHGQSFNTFLGHTSNTGMSASVLIIKDTEGYVYGGYASQPWERYSDFYGDMKSFLFQLNPKAAIYRPTGANTNIQWCATNFTSENIPNGIGFGGKINHFGLFISASFDQGQTFECTTFGSPSLSKTSRIQPEVIECWGIVQASNEQDTKHNAMKGTVLERFKEDRNMLKLVGMAGNSND

SEQ ID NO: 938 - protein, 335 aa, Zea mays
MASTGTTAAAAAVAVPEVTLRSGNGKPMPMVGMGTASFPVVHEAVRDAVLAAIEVGFRHFDTAFLYGTEKPLGDAVAEALRRGLLRSREELFVTSKLWCSQTHADLVLPSLRETLENLQMEYVDLYLIHWPVSLRPAGGPPKFPNRKEDAVPLDVAGVWRAMEECQRLGLARAIGVSNFTTRHLDKVLAVAAVPPAVNQVELNPAWQQRTLRAYCADRGVHVAAYSPLGGQNWDGRGNAVLDSEVLAEIARARGKTVAQVALRWIHEQGVTCIVKSYNRERLKQNLEIFDWELTDDDRLKISHIPQRKVVEASGLFSQEGEFTSVDPAELNIVEE

SEQ ID NO: 939 - protein, 532 aa, Adiantum capillus-veneris
MSEQGCYTDCWGAIWWIWESGIKAMAGLEGEIQTRRLRGREIPVLPPVTRSAAASAANVGYNENTRKTKVSTKRAAADDTSSRVASNVPVQHAKKRAALANLTNQSNSAITRNSSLPSKSHASAVNGKTRAAAGQVKEVQQVAQQVVEPLQEVGREPNTGRSSLANSSITFDNDENACPERATSSVGMKSRTLDVLQLVGNENKTVASLERKTQHSLYISKDTKPRARQGGLFEDCKDDNEEGGWSSKNYMDIDNHKDPQMCSAYAAEIYHHLRMAELKRRPSLNFMDTVQQDINASMRGILVDWLVEVAEEYKLVPDTLYLTISYIDRFLSGNLVTRQRLQLLGVASMLIASKYEEICAPQVDEFCYITDNTYNREEVLEMERSVLNHLHFELTGPTTKSFLRRFVRAAQAGQKSPTLQLEFLGNYLAELTLLEYGFLHFLPSMIAGAAVLVARVTLNPTWRPWNSTLQHYSGYKASELKECAKAILELQKNTKNCTLPAIREKYRQHKFKCVATLHPPASIPAEYFDDIE

SEQ ID NO: 940 - protein, 578 aa, Glycine max
MSHVVVTRSIHTSLTRPTSGSAHHRAQTLLKPPTFASKVFPQQRNNPSKVCSRSCLVNARKSAPTEVVPVSPEDDSKIEEELQHSRGMRQLGDTSVGMWSKPTFRRKTKVVCTIGPSTNTREMIWKLAEAGMNVARLNMSHGDHASHQKIIDLVKEYNAQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGRQPIWRFQSTHNIQVRTVKTK

SEQ ID NO: 941 - protein, 193 aa, Zea mays
MGSASNPLVTSSVVDDSPLPSNLNQDDLKKLAAYKAVEYVKSGMVVGLGTGSTAKHAVARISELLRQGKLRDIIGIPTSTTTHEQAVSLGIPLSDLDSHPVVDLSIDGADEVDPALNLVKGRGGSLLREKMVEGASKKFVVIVDESKLVKHLGGSGLAVPVEVVPFCCDFTRGKLEELFREAGCKAKLRVKSG

SEQ ID NO: 942 - protein, 372 aa, delta proteobacterium MLMS-1
MSKLAADPDYETFVLNMGPQHPATHGALRVKLLMDGEYIVEAEPVLGYIHRMHEKMGENRTYHQFLPNPSRLDYLSAMSCTHGHVAAVERAAGLTVPERAEYLRVITVELNRISSHLLWLGAFVLDLGGFTPLLYVMDDREQILDMLERVTGSRLTYCYFRFGGLYNDVDDDFVESARAFVKRMRDKMPMYHNLISKNVILRQRLEGVAPISAEMCRKYGATGPVARGSGIPYDVRKHEPYSVYPEFDFDIPVYEHGDSMARYLVRMDEIEQSLRIIEQGLDKLPDGPVMAEKVPKIIKPPKGDYYYAVEAARGSFGVRLVSDGTNSPYRLKLRSPCFSNVSLFGEAARGLLLADAVALFGSLDLVIPDIDR

SEQ ID NO: 943 - protein, 77 aa, Glycine max
ISSPAVATVNRAGACMVAPFTGLKSMDGFPTINTNDDVASIAIYGVTVQCIQVWTPVGRRKFDTLSYLPDLDDAAIG

SEQ ID NO: 944 - protein, 307 aa, Ustilago maydis 521
MAGYTLAIIGCGTMGVAILSGVLDSQRSQQAIASSMASSVSSLHDSTTCDDLSELPTRYIATVNRLESVRRLKKTFSQYPDIQIHAGQNVAAAREADVILLGCKPQMVQDIIAECGMKEALDGKLVISICAGLRISQIVEWVTPATKVVRAMPNTPCKIREGMTILTPLPSTLPNAELDRNILLSIFSAVGRCRFLDEKHFDACTALAGSGPAFACVFLEAMADGGVMMGLPRQEALELAAQTMQGAARMVMQSGMHPAAIKDSVTTPGGCTIAGLLNLEDGKVRSTVARTIQAAAEHASGLGQNRK

SEQ ID NO: 945 - protein, 407 aa, Sulfitobacter sp. EE-36
MDGTKGFEDALTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRASLIRVLYSEIGRILSHLLNVTTQAMDVGALTPPLWGFEEREDLMIFYERACGARLHAAYFRPGGVHQDLPPALLDDIEAWTHKFLSGFMVDVDQLLTENRIFKQRNADIGIVSEQDIQDWGFSGVMVRGSGLAWDLRRAQPYECYDEFDFQIPTGVNGDCYDRYLVRMEEMRQSTYIIQQAIEKLRAPEGQGDVLARGKITPPSRTAMKTDMESLIHHFKLYTEGFHVPAGEVYCAVEAPKGEFGVYLVADGSNKPYRAKLRAPGYLHLQAMDYVAKGHQLADVAAIIGTMDIVFGEVDR

SEQ ID NO: 946 - protein, 463 aa, Candida glabrata CBS 138
MIQTQHITTTKRRGSLHKNLFDPEVVNIPSPKSYNYAGKREYRGSSARNGLLYTINPREQFLSSLIGEEQWEYLHESFTSGLAYIQQTLSSRSKLQIPLLCLVWYVVSSISSNLCRTILKGFPHPVALTEIQFLFTAILCTSFISLINYYERPRRHHSGLSHWVRMFPEGTFPEYLDGDFHNSIVNKFLKPSALAMQCCLPLGIFQFVGHISTHKATSMIPVSLVHSMKALSPIVTVGYYRLVEQKQYTRATYTSLCAIVAGVICTCFSGKSKSNREPHYYQGLLFALLSMAIFVAQNIFAKGVLTHKSSKSAKSVRGARGANSKPDKGQLDKITILLYCSCIGFVLTLPVLLSSMLFSSAVTTTYHPFFKLVALLLLHNVAHFLQAMLAFQLIGLLSPVNYSVANIAKRIVVICVALLWESKHSPAGLLGVAVTMAGLYGYDRARSETPGLRHPPQNKYTAT

SEQ ID NO: 947 - protein, 292 aa, Kineococcus radiotolerans SRS30216
MPTPPTGPVVVLTGATSGLGCLAALDLAARGAHLILPARDPDRAQATVDAVRARNPSARTEVVEVDLTRLHQVRAAGRRIAQQHEHVDVLVNNAGVHAFTPRTTVDGLPQMVAVNYLAPWVLTQALLPALRRSAAARVVTVASEASRRHGTLSLPDDLTDLSPFTARGSSPRYGKTKLLDIMFTLELAERLRGTSVVANCLDPGFNVTGLGRDLRLARPLELLLTRLRIGDPRRGAGLIVHLATHPSYGNVSGRYVTVRGPREITPAAPADDPAARRRLWNVTEELLHERVP

SEQ ID NO: 948 - protein, 299 aa, Arabidopsis thaliana
MFRVTGTLSAASSPAVAAASFSAALRLSITPTLAIASPPHLRWFSKFSRQFLGGRISSLRPRIPSPCPIRLSGFPALKMRASFSSGSSGSSASREILVQHLLVKNNDVELFAELQKKFLDGEEMSDLAAEYSICPSKKDGGILGWVKLGQMVPEFEEAAFKAELNQVVRCRTQFGLHLLQVLSEREPVKDIQVEELHSKMQDPVFMDEAQLIDVREPNEIEIASLPGFKVFPLRQFGTWAPDITSKLNPEKDTFVLCKVGGRSMQVANWLQSQGFKSVYNITGGIQAYSLKVDPSIPTY

SEQ ID NO: 949 - protein, 381 aa, Arabidopsis thaliana
MNHVPSDQSFYIESEDEDDRKDYVEEDGGSHSDSSDDVYDENQAHIKPSSYTTAWPQSYRQSIDLYSSVPSPGIGFLGNNSMTRFGSSFLSSGLIRRHTPESLPTVTKPLLEEQADEQALPKHRLSSQGLLSPIPSRRGSMRKDEKSSMVSHEIPMSRNSSYGQAVLNGLNVLCGVGILSTPYAAKEGGWLGLMILFVYGLLSFYTGILLRYCLDSESDLETYPDIGQAAFGTTGRIFVSIVLYLELYACCVEYIILESDNLSSLYPNAALSIGGFQLDARHLFALLTTLAVLPTVWLRDLSVLSYISAGGVIASVLVVLCLFWIGLVDEVGIHSKGTTLNLSTLPVAIGLYGYCYSGHAVFPNIYTSMAKPSQYPAVLLT

SEQ ID NO: 950 - protein, 288 aa, Synechococcus sp. CC9605
MSTPTIQWYPGHIAKAEQQLKRHLDKVDLVIEVRDARIPLATGHPHLNRWLKGKQHLLVINRRDMVTAAAKEAWEAWFKAQGQKTVWCDAKAGTGVKQVQQAAIRAGDQLNERRRNRGMRPRPVRALTLGFPNVGKSALINRLVRQKVVASARRAGVTRTLRWVRLGQDLDLLDAPGVLPPRLDDQQAALRLALCDDIGQAAYDGELVAQAFLQLLLDVESQAAAGVTIPLLQERYGIPLSGETADPAFWLDAAAARHTSGETARMAQRLLDDFRKSALGSIALELPA

SEQ ID NO: 951 - protein, 304 aa, Kineococcus radiotolerans SRS30216
MNANWTARHVPDQSGRVAVVTGANTGLGLETARTLAERGATVVLAVRDVDKGARAAAGLTGNAPGNVVVQRLDLSSLESIRAAASALRDAHPRIDLLVNNAGVMYTPRQTTRDGFERQFGTNHLGHFALTGLLLERMLPVPGSRVVTVSSTGHRIRAAIRFDDLQGERSYSRAAAYGQSKLANLMFTYELQRRLAAHGTTTVAVAAHPGVANTELVRNSPAAVRAAVDRLAPLLTQPAAMGALPTLRAATDPSVLGGQYYGPGGRGEVRGYPRLVTSSPQSYDLADQRRLWAVSQELTGVEFPL

SEQ ID NO: 952 - protein, 85 aa, Arabidopsis thaliana
  misc_feature (2)..(2): Xaa can be any naturally occurring amino acid
  misc_feature (9)..(9): Xaa can be any naturally occurring amino acid
  misc_feature (37)..(37): Xaa can be any naturally occurring amino acid
  misc_feature (44)..(44): Xaa can be any naturally occurring amino acid
  misc_feature (57)..(57): Xaa can be any naturally occurring amino acid
  misc_feature (62)..(62): Xaa can be any naturally occurring amino acid
  misc_feature (68)..(69): Xaa can be any naturally occurring amino acid
  misc_feature (74)..(74): Xaa can be any naturally occurring amino acid
  misc_feature (80)..(81): Xaa can be any naturally occurring amino acid
  unsure (1)..(85): unsure at all Xaa locations
MXSSMLSSXAVVTSPAQATMVAPFTGLKSSAAFPVTXKTNKDIXSIASNGGRVSCMXVWPPXGRKKFXXLSYLXPDLSDXXIGLR

SEQ ID NO: 953 - protein, 1481 aa, Trichodesmium erythraeum IMS101
MDKKNLRQALVVGINRYPLLKKKKLGDLNLKAAVKDAEAIANILEKYGKFRIQRLPSLPSLPKNYDQEGTERFDPKGKVKINELQEAIINLFKPRKKNETPDVALLFFAGHGYVDEKGDIREGFLATSEAHLSENVYGISLNWLKRLLQDSPVQEQIVWLDCCFSGEFLNFDREANPGTEGKKISRCFITASRSFQTAEEKLDGKHGLFTDNLLAGLNPENYVDGWVTNYVLAEFINKKMSRTSQAPMFQNSGDAIILTTNTLTEYKDERWKNLAPYRGLSYFRQQENDAVFFHGRTLLTDELIDRVRTNNFVAVLGASGSGKSSLLRAGLLYQLRQGQKISGSDRWRYLNPFTPTFSPLKSLELAINREGEKQENFTDNFTDNLIRFIDLVEAERVVMIIDQFEEVFTLCQGDEEKEQERLDFFDCFLDVLERRGDKFCLVLGMRADFLDRCSEYGRLANQIKRHQLLVTPLEKDEIDEVIKKPAELVGVGVEPGLIAQIREDFLRNPGSLPLLEYTLDALWKFATQGENKSQFLTLATYTKLGGIKGTLTKRADAVFQSLNDEERSVAKRIFLELVQPGEKEISSGKITDTRRRVILEKLPNKRHSLELLSAVSDRLADPNNRLITKDNSEGGILLDIVHEDLIRSWKTLREWVEEYQEALPVERKIEADAAEWKKDGKNEGLLLRAGRLTKAEEYLKKYDEMALLDGVAYEFIEASRELKIREEEKEKERQRKVEEQAARILGMLSDSMIRQKPSLLDKGVLLGIESMKQYFDIKKRYGKVDSDLLFELDQTLRNGVSQLPKHLYTLKHQSDVYAVAFSPDGKTIATASYDKTARLWDTENGKELATLKHQSDVYAVAFSPDGKTIATASSDKTARLWDTENGKELATLNHQSSVNAVAFSPDGKTIATASSDKTARLWDTENGNVLATLNHQSSVNAVAFSPDGKTIATASSDKTARLWDTENGKELATLNHQSSVNAVAFSPDGKTIATASSDKTARLWDTENGKELATLNHQSWVNAVAFSPDGKTIATASSDKTARLWDTENGNVLATLNHQSSVNAVAFSPDGKTIATASSDKTARLWDTENGKELATLNHQSSVNAVAFSPDGKTIATASSDKTARLWDTENGKELATLNHQDTVRAVAFSPDGKTIATASSDKTARLWDTENGNVLATLNHQSSVIAVAFSPDGKTIATASSDKTARLWDTENGNVLATLNHQSSVIAVAFSPDGKTIATASSDKTARLWDTENGKVLATLNHQSRVNAVAFSPDGKTIATASDDKTARLWDTENGNVLATLNHQDWVFAVAFSPDGKTIATASSDKTARLWDTENGNVLATLNHQDWVFAVAFSPDGKTIATASSDNTARLHWATPEGLIQEGCRRLSRNLTAEEWQQYINSDLETYQKTCKNIPVHPSLIAEAKNLAKTGEKPKIKQAISIFKKALELEPEIDLDPDTKTRETDPQLVANKLAASAKLK

SEQ ID NO: 954 - protein, 151 aa, Zea mays
MASEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 955 - protein, 339 aa, Vibrio vulnificus YJ016
MLSQLFRQIRYVFRQTKKQKGQFIQMVNNSIQWFPGHMHKAQKEIAEAIPQIDVIIEVLDARIPFSSENPLISKIRGEKPVVKVLNKRDLADPELTELWIEHLEKEQNVKAMAITTSQTQEVHKILELCRKLAPHREEVGKNIRTMIMGIPNVGKSTIINTLAGRAIAQTGNQPAVTRRQQRINLQNGIVLSDTPGILWPKVENPHSGFRLAATGAVKDTAMEYDEVAFYTVEYLAKHYPEKLKERYQIEELPETDVELMEEIGQRRGALRSGGRVDLHKASEILLHELRSGTLGQITLERPEMITEELVEVELEAARRAEEKAKNKEERRKRYLRNKR

SEQ ID NO: 956 - protein, 369 aa, Pseudoalteromonas tunicata D2
MKLNSAAEIIEDIRAGKMVILMDDEDRENEGDLIMAAEHISADAINFMATYGRGLICLTLTQDRCRQLDLPLMVRNNGAQFSTNFTMSIEAAKGVTTGISAADRARTVQAAVAKGAVPTDIVQPGHIFPIMAQPGGVLTRAGHTEAGCDLARLAGCEPSSVIVEILNPDGTMARRPDLEVFAQQHGLKIGTIADLIEYRNLNEATIERVAKCKLPTEHGHFDLVTYKDTIDGQLHYALVNGAIESHTPTLVRVHLQSTFNDLLLSDRVADRSWTLPNAMQRVASEGGVVVILGKQESPAELESIVKALEAQDNGETTQLRKFQGTSRTVGVGSQILADLGIHQMRLMSLPKKYHAISGFGLEVIEYVEP

SEQ ID NO: 957 - protein, 332 aa, Candida albicans SC5314
MPFVNKSGFFDPSTAPYYDPKETRKVVFITGGNSGIGWYTVLHLYLHGYIVYVAGRTESKVLKAIDDIKAEAENRQAKETTKHPLGELNYIHIDLLDLSTVTKAVDEFAEKEKILDVLINNAGLMGVPYEVTKDDYEIQYQVNFVAHYLLTLKLLPFLQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 958 - protein, 161 aa, Triticum aestivum
  misc_feature (136)..(136): Xaa can be any naturally occurring amino acid
  misc_feature (156)..(156): Xaa can be any naturally occurring amino acid
  unsure (1)..(161): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWDNVESCLCSGCTDATQVINEVEXVKEGVPDAYSAYRFTTSQVXCVSTP

SEQ ID NO: 959 - protein, 237 aa, Triticum aestivum
MVAQAFTVDLDKPLVFQVGHLEEQYQDWVHQPIVSKEGPRFFANDVLEFLTRTKWWAVPLIWLPVVCWCLNTSIQMGHTVPEVALMVVAGIFIWTLVEYVLHRYLFHIDTKSYWTNTAHYLLHGCHHKHPMDGLRLVFPPTAAAILCYPFWNFVKLFTTTTTTPGVFGGGLLGYVIYDCTHYYLHHAHPSFDPAKYLKKYHLNHHFRIQNKGFGITSTLWDHVFGTLPSTKTAGKSS

SEQ ID NO: 960 - protein, 469 aa, Rhizobium leguminosarum
MATASEILKQIKENDVKFVDLRFTDRRASLQHVTMDVVCVDEDMFADGVMFDGFSIGGWKAINESDMVLMPDTETVHMDPFFAQSTMVIVCDILDPVSGEAYNRDRRGTAKKAEAYLKASGIGDTVFVGREAEFFVFDDVKYKADPYNTGFKLDSTELPSNDDTDYETGNLGHRPRVKGGYFPVPPVDSAQDMRSEMLTVLSEMGVVVEKHHHEVAAAQHDTLVRNADELGIKFKMQIYKYVVHQVANAYGKTATFMPKPIFGDNGSGMHVHQSIWKGGKPTFAGDEYAGLSESCLFYIGGIIKHAKAINAFTNPSTNSYKRFVPGYEAPVLLAYSARNRSASCRIPFGSNPKAKRVEVRFPDPTANPYLAFAAMLMAGLDGIKNKIHPGKAMDKDLYDLPPKELKKIPTVCGSLRQALESLDKDRKFLTAGGVFDDDQIDAFIELKMAEVMRFEMTPHPVEYDMYYSA

SEQ ID NO: 961 - protein, 226 aa, Streptococcus thermophilus CNRZ1066
MDELKKLAGVYAAGFVEDGMVVGLGTGSTAYFFVEEIGRRIKEEGLSVVGVTTSSQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 962 - protein, 100 aa, Arabidopsis thaliana
  misc_feature (76)..(76): Xaa can be any naturally occurring amino acid
  unsure (1)..(100): unsure at all Xaa locations
RPRVRASSMLSSATMVASPGQGNKVAPFNGPKSSGAFPGNRKGNNDITSNISNGRRVNCMQVWPPIGKKKFETLSXLPDLNESELAKGIDQLIRNKLNPC

SEQ ID NO: 963 - protein, 506 aa, Frankia sp. CcI3
MTTSAAGASSTATLPAGALPAGYADVRFAAIEDALAEIAAGRPLVVVDDADRENEGDLIFAAEAATPELVAFMTRYTSGVICVPMDAADTDRLELDQMVPHNTERMGTAFTITVDARDGVSTGISAADRARTIRLLADPRTTPGDLSRPGHIFPLRAKDGGVLRRPGHTEAAVDLARLAGLRPAGAICEIVNDDGTMARLPRLAEFAREHGLLLISIADLIAYRRRTEKQVVRVAEASLPTRYGAFRAVGFRNILDGVEHIALIRGELGDGADVLVRVHSECLTGDVFGSRRCDCGTQLDAALRIIATEGRGVVLYMRGHEGRGIGLMHKLRAYQLQDAGHDTVDANLALGLPADARDYGTGAQILVDLGVRGIRLLSNNPTKRAGLEGYGLRIVELIGMPVTQTPENLRYLTTKRDRMGHVIPGLPSIPGLPSIPGPPGLPGPPGLPGPPGLSDLPRAVGEDEPAGSRWIPGAPRAPRVPVTSGCTAVAGPGTSAGVDCAEGEGL

SEQ ID NO: 964 - protein, 314 aa, Debaryomyces hansenii CBS767
MSEINILTIFRSTKVLKFYNGQEIPATGLGTWQSKDEEVYNAVLAALKIGYKHIDTAACYGNEEPIGRAIRDAGVKREDIFITTKVWGTDHTRVEQALNTSLQKLGLDYVDLYLMHWPVPLNPNGNHPLFPTLPDGNRDISQDWDFTKTYNLMQKLLDLGKTKSIGVSNFSVTNLKKLLNAPTTTVKPVVNQVELHPYLPQHKLLQFAKENDIVLESYSPLGSTDSPLLSDEVVVKIAEKNKVSPATILISWALWRGTVVLPKSVSAHRIESNFNVIDLPDADGKELDDLHKLRGIRRLVLPNWAPVVVFDSDE

SEQ ID NO: 965 - protein, 120 aa, Brassica napus
RPTRPLKERFYQKRQLKETHRSMATEKFGIIIEKNPPESTLTQLGVRSWPKWELIPPSKFPWTFSTKESCYLLEGKVKVYPDGSDEAVEIEAGDLVVFPKGLSCTWDVSVTVDKHYYHSE

SEQ ID NO: 966 - protein, 264 aa, Robiginitalea biformata HTCC2501
MKIAIIGAGNLGVSIARGILHSGGATSMYLTRRNLSAIRELEAYGNVTLTSDNREAVAAADILIFAVQPGHFGPILESIKDLLHENHVVISTITGFGIERIESILGADRHIIRAMPNTAISVGRSMTCLCANEKGGKRLELASAIFNRMGHTMVIPENRMQAATVICASGIAFWMRLIRATTQGAIQLGFDAREAQELAMHTCHGAAELLIESGSHPEEEIDRVTTPMGCTIEGLNEMEHQGLSSSLIRGVVASFDKISQIRKG

SEQ ID NO: 967 - protein, 1387 aa, Oryza sativa
  misc_feature (1357)..(1357): Xaa can be any naturally occurring amino acid
  unsure (1)..(1387): unsure at all Xaa locations
MRLGKQRVFIFTASTEISGVSTREHGEGYGFLYCKSHVTAEQHLQPTQDFWIAASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQDTSKIYTLEKVYGFRLVCRSVVDLRSQKFHTRVYKRKSYFRSSASECEKIIHSARWLEFRRQRVAFQRTRRTIHLIPLASQDDSSGLSVNGSPQVDSASEMDDIRVKLVKALQSEDISTGLVQSIHDAARSIELAFLDHSKSSKNSWFPKEWLGVDNNEWIKPLSYQAAVGSLLQAVIDVSSRGNGRDRDINVFVQRSLSRLLSSLEGAIQNELSKREPTLYQWYSSDQNPLVVRTFVNSFENDPRFNSATAICHERQQMNTSESDLSLLMLGLTCLAAITKLGSTKVSCQQFFSMVPDIIGRFMDMLLEFVPLSKAYTLTKDIGLQREFLCNFGPRAADPKFSSDREVEISFWIDLVQKQLLRALDREKIWSRLTTSESIEVLEKDLAIFGFFIALGRSTQTYLSSNHLTNLDDSINDIVSSHLNKLTIIQVVCEELEWLPFYSGDVPAATIEGREDVHKGEIISRVLNVCSYWMTSFIKYSSWLENPSNVKAARFLSKGHSMLSDCMKELDLTKYDMPKDQTFPEAKEHLVARTELASFDKSLESVEEALVKLEDLLQELHLSSSNSGKEDLRAACSDLEMIRRLKKEAEFLEASFRAKTEFLEADASSRPLSPAVEEGRGKTASNANESSTPQKPANRVENKRRPIWDLFGRPSGRRVQLVQQTSDQNVSVANVDNKDTQSNDILRFEQLRRELIELEKRVQKSADNAQKEETYVANETLDSSVSSSPVSMPSGPASKKENVITKSVEKVKETTTTVVQGTQLLAIDTGAAMGLLRRALIGDELTHKEKQALQRTLTDLASVVPIGILMLLPIPSTYAPERLDLLRQLEXVKEMGVAEGSSEEMVEACFGTRQKMVSFRL

SEQ ID NO: 968 - protein, 274 aa, Campylobacter jejuni RM1221
MRKSILSFLEKKGKNEKITMVSAYDYHSAKILDNCDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSEEHSFDYLDDELLDKLY

SEQ ID NO: 969 - protein, 179 aa, Malus x domestica x Pyrus communis
MASSMISSGTVATVSAPAQARMVAPFTGLKSSSAFPVTRKSNDITSIASNGGRVQCMQVWPPLGLKKFETLSYLPPLSTESLAKEVDYLLRKNWVPCLEFELEHGFVYRENNRSPGYYDGRYWTMWKLPMFGCTDSSQVLKELEEAKKAYPQSFIRIIGFDNVRQVQCISFIAYKPPGV

SEQ ID NO: 970 - protein, 1886 aa, Arabidopsis thaliana
  misc_feature (1171)..(1171): Xaa can be any naturally occurring amino acid
  unsure (1)..(1886): unsure at all Xaa locations
MQRSRRALLVRRRVSETTSNGRNRFYKVSLSLVFLIWGLVFLSTLWISHVDGDKGRSLVDSVEKGEPDDERADETAESVDATSLESTSVHSNPGLSSDVDIAAAGESKGSETILKQLEVDNTIVIVGNVTESKDNVPMKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGSRMPGDTVLKILMQKIRSLDVSLSVLESYLEERSLKYGMIFKEMDLEASKREKEVETMRLEVEGMKEREENTKKEAMEMRKWRMRVETELEKAENEKEKVKERLEQVLERLEWMEKKGVVVFTICVGFGTIAVVAVVFGMGIVRAEKQVVKGRLQANIMFKKAVEAKSHQRLSGADRKKLRRTVRNRLPLLTDELLDAILPPKVEITLSKFQNRVIVYSIEGGCPMFFDIDGRGTEIFPTVFALWEAPEMLPSFMLKGGEVSRYIIGGADLMFPGILIPPQGYPSFSAGEIWAVKVPGNLAPIAVGCTTMSSEEARKAGLRGKALRITHYYRDFLWESAEGHYVPNAGFMEDVVMEDPSYLAPGSGEDILDTSASTGNEEDESALETASTSAADAKNDAEVHVVGSMNELYLVDDVCATETNTDKQITLSPEEVDTLLDQCLLQALHTTLKEKDLPIPGSTLWANHVLPCRPSGLTLDIKKSSHKKLSKWLQSKASGGMISVKEDKHKKEIVLISVNRSHPDYKSFKPEKKKAEVSESPGERSTAQAQSEKGLEIIEVYKSSIHNSAIFASVGEDKGNLYTASEATDVVFKYIEKENLVKPTNKSMVVLDPILCDALFKGAIKKGSAYPSEIHKKDVGSTFVGRMQPNHVVMRGGGEPVVRKGAVKPVQIMTERRQGNKKVTKVTGMETFLIDPDSFGSELQKKFACSTSVGELPGKKGYEVLIQGGVIDTLARYMVEHYGVPXRYIEVLDKTGNHCHRRFVNCLIGFVAASDLAFTAIPIAVNVVFSSKNNLCLVQLMAIFEWRHRRRPFDGGGTRRRRFFSPLYSRNFKRTILFAVIFLAIFPPLYFHFKLRRIRQIVAQKCDWLHHPPLVCAHGGDSTLAFPNTMDAYSFAIRSRVDCIEVDVSRSSDGVLFALHNRLQTLILVVSSSSNVSVFGFSSRIARNSSVQVGDLSMKQIKELDVSEIVKGTLGSSRIPTLEEALALISNSVRKVILDAKVGPPMYEKGLAQDILSIRAQCNNCIVWAKSDTLARDIIRRAPDTMVGYIVMVDPLTGARNSLLRMKGARVVGVYHPLIDEELVRVVRRRNKEVYAWTVDDADPMKRMLHLGVDAVVTSDPSMFQGLMEDLRTECLEEERYDKVIEACSLSKDLEILSFGDQTVIGERGINLSGGQKQRIHIARALYQDADIYLFDDPFSAVDAHTGSHLFKEALRGLLCSKSVIYVTHQVEFLPSADLTLVMKDGRISQAGKYNDILISGTDFRELIGAHQESLAVVGSADASSVSENSALDEENGVVRDDIGFDGKQESQDLKNDKLDSGEPQRQFVQEEERAKGSVALDVYWKYITLAYGGALVPFILLGQILFQLLQIGSNYWMAWATPISEDVQAPVKLSTLMVVYVALAFGSSLCILVRATLLVTAGYKTATELLMFAHRRRYNDVCHKTLRLFAHHYQGIGPWP

SEQ ID NO: 971 - protein, 397 aa, Clostridium perfringens SM101
MILSRKAQNIGASLTLALTAKAGELKKEGIDVVSFGVGEPDFNTPKNIIEAATRAMEEGKTKYTATSGIVELKEAIARKLHDDNGLNYGTKNIIISTGAKQSLANVFMAILNPGDEVIIPVPYWVSYPELVKLSDGVPVFIETKKENDFKVTYDELKSVLSENTKAIVINSPNNPTGTVYSKKDLEVIAKFAKENDLIIISDEIYEKLIYGKEEHISIASSSEDAFKRTVVINGFSKAYTMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 972 - protein, 642 aa, Arabidopsis thaliana
MMYVSARSGSAKRSISSLPHLSQRFKQTENEIVQMFSVPNHEESEKPQEKWKLSRKDPSVRMLDERFIRIVKIFKWGPDAEKALEVLKLKVDHRLVRSILEIDVEINVKIQFFKWAGKRRNFQHDCSTYMTLIRCLEEARLYGEMYRTIQEVVRNTYVSVSPAVLSELVKALGRAKMVSKALSVFYQAKGRKCKPTSSTYNSVILMLMQEGQHEKVHEVYTEMCNEGDCFPDTITYSALISSYEKLGRNDSAIRLFDEMKDNCMQPTEKIYTTLLGIYFKVGKVEKALDLFEEMKRAGCSPTVYTYTELIKGLGKAGRVDEAYGFYKDMLRDGLTPDVVFLNNLMNILGKVGRVEELTNVFSEMGMWRCTPTVVSYNTVIKALFESKAHVSEVSSWFDKMKADSVSPSEFTYSILIDGYCKTNRVEKALLLLEEMDEKGFPPCPAAYCSLINALGKAKRYEAADELFKELKENFGNVSSRVYAVMIKHFGKCGKLSEAVDLFNEMKNQGSGPDVYAYNALMSGMVKAGMINEANSLLRKMEENGCRADINSHNIILNGFARTGVPRRAIEMFETIKHSGIKPDGVTYNTLLGCFAHAGMFEEAARMMREMKDKGFEYDAITYSSILDAVGNVDHEKDDVSSF

SEQ ID NO: 973 - protein, 257 aa, Solanum tuberosum
MARKFFVGGNWKCNGTVEEVKKIVTTLSEAEVPSEDVVEVVISPPFVFLPLVKTLLRRDFSIAAQNCWVRKGGAFTGEVSAEMLVNLGIPWVILGHSERRLLLNESNDFVADKVAYALSQGLKVIACVGETLEQRESGSTMAVVAAQTKAIAEQVMHWSNVVLAYEPVWAIGTGKVATPAQAQEVHFELRKWLHVNVGAEVAASTRIIYGGSVNGANCKELAAQPDVDGFLVGGASLKPEFIDIIKSATVKTTAKSE

SEQ ID NO: 974 - protein, 811 aa, Clostridium perfringens SM101
MLSINKESFKRDYKKKFLELHGIELEEGKNFHKYEALGCLVRDYIAEDWVNTKKKYEDSKQKQVYYFSMEFLLGRLLGDALLNLGIRETCREALKELNIDLEELEEFESDQGLGNGGLGRLAACFLDSMASLNIAGHGCGIRYKYGFFNQKIIDGSQVETPDSWLKNGNVWEVKKPDKSEIVKFGGNIKCENINGRLTFTHVNYEPILAVPYDTPIVGYENNVVNNLRLWSADPVDNEFDFCYFNRGQYLKAIEYRNSIEAISQVLYPDDSMYEGKLLRLKQQYFFVSAGLQSIVRHYKKNGGKIEEFDEYIAIHINDTHPTLAIPELMRILLDEEGLSWESAMRITTNTISYTNHTILSEALEKWPINMFKELLPRIYMIVEEMNERYCAELWHKYIGQWDKISKMAIIGDGFVRMANLAIVGSHSVNGVAKLHTEILKKKEMSDFYYLYPSKFNNKTNGIAHRRWLLKSNPELTNLLKETIGDSFIKHPTDMENFEKYIDDEYVLKRLGEIKRKNKENLAKVIFDNQGIKVDPNSIFDVQVKRIHAYKRQTLNCLRIMELYNRLLENPNLDIAPRTFIFAGKAAPAYYLAKNTIELINAVANKVNNDKRINDKIKVVFLENYRVSLAERIIPATDLSEQISTTTKEASGTSNMKFMMNGAITIATLDGANIEIRDEVGDDNIVIFGLTENEVLDYYSRGGYSAWDVRNNDNRLIRVTDDLINGVYSKDKDKFRSVYDNLLTYNDEFFVLKDFDSYLKAQDKVDLLYRNNKEWQRKCGVNIAHSGIFSSDRTIAEYATGIWGSKVIYKNL

SEQ ID NO: 975 - protein, 103 aa, Triticum aestivum
MAGAAKASWMVAMSVGAVEALKDQAGLCRWNYALRSIHRAANIRAGVSQGKKQLPASAAAVAERRRAEKAEEGLRTVMCLSCWGVQNTCCAMNWLQVQVLPVG

SEQ ID NO: 976 - protein, 314 aa, Zea mays
MASAAASAAAALARHVLLPPRYHASPPSAARRARAAPALTSASPRCVLRRVGRTPRYGTTGKKRTRRFGAPRAGMDMDLASGAVEVINDLGFDTLTFLGVTVLVVPAFRVVNASPILGFFCAGVVLNQFGLIRNLTDVKLLSEWGILFLLFEMGLELSLSRLKALARYAFGMGLPQVLLSTLAFTAFELPPNDAIGTKILQFLFDSRPDLVNIRSIDEAIVIGAALSLSSSAFVLQLLAEKGELPTRFGSATLGILLLQDIAVVPLLVILPVLESQNIIEQSVWPILLAESLKALGGLGLLSLGGKYFIRRVFE

SEQ ID NO: 977 - protein, 436 aa, Caulobacter crescentus CB15
MAAIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 978 - protein, 202 aa, Spiroplasma citri
MQALIFQGKKKIEWAETNERIIKKATDIIVKIEGFTFSHADYRPYLGYDNSVVPNTIMGHEGVEIVTAIGDDVTKLKIGDRVAIGCVTHCNICQWCEQKAFANCTNGGFILGTKINGTHAEYVRVPYGENSVIKIPKKMNLTDALMLRDVLPTGYENVIKKINLKQINNVAIIGDEPIGLGILLLLNKYNKKLIFMVIIVKN

SEQ ID NO: 979 - protein, 397 aa, Oryza sativa (japonica cultivar-group)
MPVGTARTCMNGLNALSGVGLLTVPYALSEGGWVSLALLAAVAAACWYTGILLCRCMDADDAIRTYPDIGERAFGRTGRLLVSAFTYVELYLVATGFLILEGDNLDKLFPGARVTLGTVSLAGKRLFVVLVALVVAPTTWLRSLGVLAYVSATGVFASVVIVLSVLWAAAVDGVGFSGRGTTTPLRIAGLPTALGLYIFCYGGHPMFPTLYTSMKRKSQFPKVYPYTHAHNTIDMLPAMAVLGYLMYGDGVLSQVTLNLPSARLSSKVAIYTTLLNPVTKYALVVTPIAAAVEERIRGAAGKGARAVSVAVRTLLVLSTVAVALALPFFADLMALVGSMLNVAVCMLLPCACYVRIFGAPSMSSVEAVAIGGILVLGSLVAVTGTYYSLMKIIRELV

SEQ ID NO: 980 - protein, 396 aa, Exiguobacterium sibiricum 255-15
MKHLSERVERLAPSGIRRFFDLAGSMEDVISLGVGEPDFVTPWNVREASFAALEQGYTAYSANAGLVELRQEIKLYMQEKFSIDYRVADEIIVTTGASEGLDLAFRTLINPGDEVIVVEPAFVSYAPLIELAGGIPVAAACRAEDGFTIQPETIEAVMTERTKAIIFCFPSNPTGSVMTRDQLADLALLAKKHDLYVISDEIYAELSYEDEPTCFATLPDMRERTIVINGFSKAFAMTGWRLGFTCAPPAISQAMLKVHQYGMMCAPTLVQFAGIEALRSRHKTVPDMVRSYRQRRNYFVKALNDAGLPTHSPGGAFYAFPYIGGTGLTSEEFAEQLLLAERVAVVPGSVFGASGEGYVRASYASSIEQLQQAIHRINRFMQHLNQKQVELSNPSR

SEQ ID NO: 981 - protein, 493 aa, Ricinus communis
MAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 982 - protein, 508 aa, Arabidopsis thaliana
MASVSLLDVAIAIICLFFFYYMYFKKPHGQVFRNWPVIGMLPGFLMVLHRIYNFGVEALEMSHLTFLFKGPWFAEMDMLFTVDPANIHYILSSNFSNYTKGADFKEVFDVFGEMIFSSDSELWKNQRKAAQFMLNHQGFQKLSLSATRSKLYDGLVPLFNQCCEEEKVVDLQQVFQRFTFDTTFFIVTGFDPKSLSIEMPEVEYAKALDDLGEGIFYRHIKPKFFWKLQNRFGLGQEKRMTEADATFDRVSAKYILAKREEIRSQGIDHHANGESEDLLTSHIKLDTTKYELLNPSDDKFLRDTILAFNLAGRDTTSSALSWFFWLLSENPQVVTKIRKEIIDKNISKDGRNGQENLDKLVYLHAALYESMRLYPPVAFQRKSPIKPDVLPSGHKVEANSVIIIFLFALGRMRAVWGEDATEFKPERWVSESGGLRHAPSFKFLSFNAGPRTCPGKQLAMTLMKTVVVEILQNYDIDVIKGQKIEPEPGLMLHMKHGLRVTITKRCSA

SEQ ID NO: 983 - protein, 263 aa, Medicago truncatula
MASSTNVRENFVYVAKLAEQAERYDEMVEAMKKLAKMDVELSVEERNLFSVGYKNVVGSRRASWRILSSIEQKEESKGNELNVKRIKEYRQKVEVELSSICNDIMIIIDEHLIPSTNIAESTVFYYKMKGDYYRYLAEFKAGDEKKEVADLSLKAYQTASATAENELQPTHPIRLGLALNFSVFYYEIMNSPERACHLAKQAFDDGVSELDTLNEDSYKDSTLIMQLLRDNLTLWTSDIPEDGEDQKMESATKSGQDEDELGR

SEQ ID NO: 984 - protein, 322 aa, Pseudoalteromonas tunicata D2
MRRLPPVLLEDGCSRELLSLIRTILAACKEISFRVGQGALSGVLGSTLDENIQGETQKKLDVLSNQLLKDILLETGYVKAIASEEEDYTVAGNPDAKFIVAFDPLDGSSNIDINSLVGTIFSIMEAPEGSDANDPSIFMQPGDKQVAAGYVLYGPSTMLALTVGKGTRIFTLDKTHGSFLLTHDFAQIPAKTNEFALNMSNQRHWQPAMQNYVADLLAGEDGPRKENFNMRWIAAMVGDVHRVLTRGGFFSYPADTKDPKKPYKLRLLYEANPMAMLIEQAGGIASTGTERIMSIQPDAIHQRVAVILGSKDEVETCLSYHN

SEQ ID NO: 985 - protein, 148 aa, Brassica napus
STQASTLRFSVTFPALLSLLLLSLWVVEAYTSRKLISNNEQEGQNISHLFKDGEFEDPTMYMFFKISDLKLGTKLPIYFNKNDLRKVPPLLTRQEADLIPFTIEGEYKFCGTSLESMLDLAKKTIASNADLKVMTTKVMVPDHNRISY

SEQ ID NO: 986 - protein, 188 aa, Oryza sativa (japonica cultivar-group)
MSAVNITNVAVLDNPTAFLNPFQFEISYECLIPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKLLIDRVQRNILADKPRVTKFPINFHPEPSTSAGQQQQEPQTASPENHTGGEGSKPAADQ

SEQ ID NO: 987 - protein, 333 aa, Thermus thermophilus HB27
WGLGSRTGPGSKRLQGLLDDRQRLMYDGATALAEGVLLALRETGRMGVLVSQGVHPEYRAVLRAYLEAVGAKLLTLPLEGGRTPLPEVGEEVGAVVVQNPNFLGALEDLGPFAEAAHGAGALFVAVADPLSLGVLKPPGAYGVDIAVGDGQSLGLPMGFGGPHFGFLATKKAFVRQLPGRLVSETVDVEGRRGFILTLQAREQYIRRAKAKSNITTNAQLTALMGAMYLAALGPEGLREVALKSVEMAHKLHALLLEVPGVRPFTPKPFFNEFALALPKDPEAVRRALAERGFHGATPVPREYGENLALFAATELHEEEDLLALREALKEVLA

SEQ ID NO: 988 - protein, 607 aa, Pseudomonas syringae pv. tomato str. DC3000
MDTHSLIEMLIYLGSAALIVPIAVRLGLGPVLGYLLAGCLIGPWGLKLITDVESILHFAEIGVVLMLFIIGLELDPKRLWAMRRMVFGGGALQMLACGAAIAAFCAALGLNWTAALLVGLTLSLSSTAIAMQAMNERNMTSTAVGRSSFAVLLFQDIAAIPLVAMIPLLAANGGTPSGAELALSIAKIVGAVVAVVLLGRYVSRPVLRFVARSGLREIFSAVALFLVFGFGLLLEEAGLSMAMGAFLAGVLLASSEYRHALESDIEPFKGLLLGLFFIGVGMSIDFGTLIDEPLRVLTLTLGFIVIKLVMIKLLGRFLNVPSDQRSWQAVFLGQGSEFAFVVFGAATVAGILIEPWGKSLTLAVALSMCVTPLLILLLNYLESSKKQDSKEADTIDQSNPRVIIAGFGRFGQIAGRLLMSCGFEVVVLDHDPDHIETLRKFGVKVFYGDATRLDLLHAAGAAQAVVLINAIDNQDDNLLLTKLAQEHFPSLKLVVRARDMGHIITLRQMGIEAVERETFESALSLGRRALEHLGVGRYEARERADTFRRLNLEMLEEMAAQPVDDTEFRYDAYKRANVLLTELFNEDRTHPIDGEAKKNDPTTLRDR

SEQ ID NO: 989 - protein, 931 aa, Arabidopsis thaliana
MVESEKTKHTCLHLEISGADPIFVKGTWYHSRFDISVTDGSFTWTCNATEEELAEQYLGFQQPNSVYGFSDAIEGSKRLSWTFEKEGTKLEWRWKCKPSDDSKKITVRILDFLMEANIRLSEEVVNKTRSFEKMKSEAERCLAQEITEESPLSIGQTLSSSNGVYELGFFSFNNSQNQYLGIWFKSIIPRVVVWVANREKPVTDSAANLGISSNGSLLLSNGKHGVVWSTGDIFASNGSRAELTDSGNLVFIDKVSGRTLWQSFEHLGDTLLPTSTIMYNLVAGEKRGLTAWKSYTDPSPGEFVVLITPQVPSQGFLMRGSTPYFRSGPWAKTKFTGLPQMDESYTSPFSLTQDVNGSGYYSYFDRDNKRSRIRLTPDGSMKALRYNGMDWDTTYEGPANSCDIYGVCGPFGFCVISVPPKCKCFKGFIPKSIEEWKTGNWTSGCVRRSELHCQGNSTGKDANVFHTVPNIKPPDFYEYADSVDAEECQQNCLNNCSCLAFAYIPGIGCLMWSKDLMDTVQFAAGGELLSIRLARSELDVNKRKKTIIAITVSLTLFVILGFTAFGFWRRRVEQNEDAWRNDLQTQDVPGLEYFEMNTIQTATNNFSLSNKLGHGGFGSVYKARNGKLQDGREIAVKRLSSSSEQGKQEFMNEIVLISKLQHRNLVRVLGCCVEGTEKLLIYEFMKNKSLDTFVFVFTRCFCLDSKKRLEIDWPKRFDIIQGIARGLLYLHRDSRLRIIHRDLKVSNILLDEKMNPKISDFGLARMFHGTEYQDKTRRVVGTLGYMSPEYAWAGVFSEKSDIYSFGVLLLEIISGEKISRFSYGEEGKTLLAYAWECWCGARGVNLLDQALGDSCHPYEVGRCVQIGLLCVQYQPADRPNTLELLSMLTTTSDLPLPKQPTFVVHTRDGKSPSNDSMITVNEMTESVIHGR

SEQ ID NO: 990 - protein, 841 aa, Bifidobacterium longum NCC2705
MLTFVRRYLSRGIINTGTYPGRKVRMTEITAPKSPVTAEQFADEIREQLKYTQNVTTEQATPADVYVAASKAVRNHLADSWFKTQADTVNGNTKAVGYLSAEFLMGKQLRNALLNAGLTEQFDKAVEALGFKVQDVVDAEYEPGLGNGGLGRLAACFIDSLASLGVPAFGYGIQYKYGIFKQEFDKDGKQVETPDYWLANEEPWGHIDYNRDQKVSFGGKVVENADGTKTWQPAWSVRAVPVDYLVPGYKSGRVNTLRLWSAKSYDEFDLLAFNRSEYMEAVTPQVKAENISKILYPEDSTKVGKELRLEQQYFFVSASLHDAIRVFYPGQDKPDLTTFPNKIVFQLNDTHPVIGIPELMRILIDEYGYDWDTAWSITTKTFNYTCHTLLPEALEVWPASLIGELLPRHLEIIEKINAQFEDELKSKGVDKNTIKDMAIYTGDAVRMAYLATYGGSHVNGVAELHSQLLKDVTLKNFSDVYPDKFTNVTNGVTPRRFVKLANPRLSDLITEGLGTDKWLSDLEMLKGLEPLAKDDEFVKKFAAVKKANKVDFAAYAKREYGFELDPNTMFNTMVKRLHEYKRQSLKILSVISTYADIKSGKVKAEDVTPRTVFFGAKAAPGYYLAKMTIQLINNVSRVVNNDPDVKGKLAVYFPWNYNVRLAQHLIPATDLDEQISQAGKEASGTGNMKFALNGAMTVGTLDGANVEIRERVGAENFFLFGMTVDEVEKKYAEGYNPASYYEADPRLKHAIDMVADGTFSNGDRNAYSPLVADWLTKDWFMTLADFSAYMDIQSEIEALYADELEWNRKALLNVANSGYFSSDRSMEDYLERIWHTAPLAD

SEQ ID NO: 991 - protein, 394 aa, Anabaena variabilis ATCC 29413
MARIETRTEPMVLNMGPHHPSMHGVLRLIVTLDGEDVVDCEPVIGYLHRGMEKIAENRTTVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYFLPVVDEYEKLVTNNPIFRRRIEGIGTISREEAINWGLSGPMLRASGVKWDLRKVDHYESYDDFDWDVQWETAGDCLARYTVRMREMRESVKIIKQAIKGLPGGPYENLEAKRLIAGKKSEWDAFDYQYIGKKVSPTFKMPKGEIYARVESGKGELGIYLIGDDNVFPWRWKIRPADFNNLQILPHLLRGMKVADIVVILGSIDVIMGSVDR

SEQ ID NO: 992 - protein, 503 aa, Oryza sativa
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFIPYGGGTRLCAGSELAKLEMTVFLHHLVLHFRWELAEADQAFVFPFVDFPEGLPIRVHRIAQDDELEL

SEQ ID NO: 993 - protein, 262 aa, Legionella pneumophila str. Lens
MNISFIGYGNMAKAIACHLQKQNKYSLSAASPSLSAGISKENIRTHYDNKEVAKDANVIILAVKPAQMREVINEINPFISSGCLLVSVAAGLSLTWFAKYCKKGQAVVRTMPNTPAIVGFAATSMIANEFVNEKQKKWAEQLFSSIGITDWVKDEEDMDTLTALSGSGPAYVFLFLEAMINAGIQLGLEETVAKHFAIQTFSGSLQLAQHSQLSLTELRKKVTSPGGTTAAALEILHGDLDELIFSAMKAAKQKAHQLGKVE

SEQ ID NO: 994 - protein, 668 aa, Burkholderia sp. 383
MISPLEMTLLLLLASVVGVVVFRSLNLPPMLGYLTVGILVGPHAFGIAADLERAEHLAEFGVVFLMFSIGLEFSLAKLRAMQRLVFGLGLLQVVATLVLALVLGMLFEHWVHITWQGSIALGGALAMSSTAIVSKMLAERLEIETEHGRNIFGVLLFQDLAVVPLLIVIAAFGAESSKDLAITLGFAAVKIVIALTLLLVIGQRFMTRWLNVVARRRSQELFVLNLLLVTLGAAFITDRFGLSLALGAFIAGMLISETPFRHQVEEDIKPFRDVLLGLFFVTTGMLLDPRVIWEHPFLVLGFFVGQILFKGTMIAGLARLFGATPGVAMRTGIGLAQAGEFGFVLLNLILDRHLVDSTLLQAILASMLLSMLAAPFLIQNADRIVMRLSSTEWMQQSLQMTRIATQSLKQRGHVIICGYGRAGQNLARMLEQEGIPYVALDLDPDRVSAAGAAGESVVFGDAARRESLLAAGIHRAAAVAITYANTPSALRVLHHVHELEPTLPAIVRTVDDADLEKLLAAGATEVIPEIVEGSLMLASHTLVLVGVPMRKVVRRVEEMRDERYSLLRGYFRGADDADDDDHEQVRLQSVPVDARADAVGRSLEELGLYALGLEVTAIRRHGIRGVEPDPQTKLRASDIVVLRGLPEALALAEERLSRHRRDPPAAAA

SEQ ID NO: 995 - protein, 227 aa, Neisseria meningitidis MC58
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 996 - protein, 414 aa, Dechloromonas aromatica RCB
MKHVKKSAKLANVCYDIRGPVLQKAKQMEEEGHKIIKLNIGNLAAFGFDSPEEIQQDMIRNLPNAAGYTDSKGIFAARKAIMHYTQQKGIKGVTLEDIYVGNGVSELIVMAMNALLDAGDEVLVPAPDYPLWTAAISLSGGTPKHYLCDESKGWLPDLDDIRSKINAHTKAIVLINPNNPTGALYPDDLLYEIIDIARQHHLTIYADEVYDKVLYDDVKHTSIASLAEDVLMITFNGLSKNYRSCGYRAGWMVVSGDKRHAKDYIEGLDMLASMRLCANAPGQHGIQTALGGYQSINDLIKDGGRLRRQRDIAHELITAIPGVTCVKPKAALYMFPRLDPKIYPIKNDQQFISELLQEEKVLLVQGTGFNWPHPDHFRLVFLPHEDDLREAVARIARFLENYRKRHNTNQLIKD

SEQ ID NO: 997 - protein, 458 aa, Silene diclinis
KKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVENAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTVVSVSGDCSSSAGGGTLQIWRIIDLLYRPEEEVLAELDKFRSHVAACSPTPTK

SEQ ID NO: 998 - protein, 479 aa, Dechloromonas aromatica RCB
MTQVIPVVLSGGSGTRLWPLSREKYPKQLLPLVGDKSMLQETVARLDGLAGLSEPLLVCNEEHRFVVAEQLRVLGKHGQILLEPFGRNTAPALTLAALLARQNGDDPVLVVMPADHVILEGDVFREAVANAVKLAEQGYAVTFGITPDCPETGYGYIHRGAAIACEEEAFLLRRFVEKPDRGTAQAYLDSGDYLWNSGIFVLRVSTWLSALEICRPDILAACGKALNCVSQDGDFVRLDRAEFERCPSDSIDYAVMERLSGGEANLPKSAVIPLSAGWSDVGAWDALWKVLPKCEAGNAIRGDVMLESCSNTLAFSESRLVTCIGLKDLVVVETNDAVLVAHQNATQDVKKIVDRLKADKRSVAQWHRKIHRPWGWYDGVDSGQRFQVKRICVKPGASLSLQMHHHRAEHWIVVTGTAKVTKGDEAFLVSENQSTYIPLGTKHRLENPGIVPLEMIEVQSGSYLGEDDIVRFEDTYGRN

SEQ ID NO: 999 - protein, 748 aa, Gibberella zeae PH-1
MHTVTSSKFVHILLVYLTLGTFLVQLATCLAFNHLPKDTHNLLSKRADGDVHYLGVGKADITGPVVELNLMGYAELSQTGTGLRQRIYSRAFIVGNPDKPKERIVYVVLDAQSGDTAVRRGILEGIAALGSDYAVYTSDNVAITGTHSHSGPAGWNNYLMPQISALGLNQQSYQAIVDGAVLSIKRAHESLSKGRLSVGKTRIDDVNINRSLYAYQQNPASERQKYKDEVDKELTMLMFTREEDNKVTGVLTWHSVHGTSLHMNNTLVAGDNKGVSAYLLEKAVRGTDGAADDFVAGFSQAAVADTTPNVEGAWCEDGSGKQCDFKDSTCGGKTETCHGRGPFWGLDDGGTKSCWEIGRRVFDQAFKLYDQMKDGSGDAVSGTSVVGYHSFHDMSDYSFILPNGKTAKTCSAAFGYSFAAGTTDGPGYFDFKQGDSGSPDASPLWAIVSKFLRNPTKEQVACQSPKPILIDAGEITLPYAWAPNIVDIQMLRVGNFFIIVSASELTTMSSRRWRESISNEIQGRGSLGVDIKPIVVAGGPGNTYAHYVTTPEEYDAQRYEGASTVHGRHSLDAYINLTSTYVGYLLGEYGAKKPPTGPAAPDNRKNSLSLVTGVVYDNPKAGTKFGNIVKDVSKSKFKIGETITATFVGANPRNNLHLESTYAAVEKKDGSKWTQVRSDEDWDLVFEWKRLDGLLGSSEVQISWETGWQDAKDIKAGTYRLSYNGDSKAPLTGKITGFTGKSGEFEIA

SEQ ID NO: 1000 - protein, 442 aa, Polaromonas sp. JS666
MEPQNIKPHTPELSRNTALFERAKKLIPGGVNSPVRAFKAVGGTPRFVQRAQGAYFWDADDQRYIDYIGSWGPMILGHGHPAVLASVQKALLDGFSYGAPTEREVELAEELVRLVPSLEMVRLVSSGTEAAMSAIRLARGATGRSKIIKFEGCYHGHADALLVKAGSGLATFGNPTSAGVPPEVVQHTLVLEYNHLAQLEEAFALHGSAIACLMIEPIAGNMNFVRASIPFMQRCRELCTQYGALLVFDEVMTGFRVALGGAQSVYAKSIPGFKPDMTVLGKVIGGGMPLAAFGGTRAVMEQLAPLGPVYQAGTLSGNPVATACGLATLREIQKPGFYEALGERTRGLVAGLTQAANKAGVPFCGDSEGGMFGFFLLGQLPQNYATVMTTDGPAFNRFFHAMLASGVYYAPALYEAGFVSSAHSAADIEATVDAAAKFFAGA

SEQ ID NO: 1001 - protein, 92 aa, Colwellia psychrerythraea 34H
MSQASARHLLVDTEEKCLALKAEIEAGKDFAEVAKEHSNCPSNAQGGDLGSFGPGQMVPEFDKVVFSAPLNTVQGPVQTQFGYHLLEVTARN

SEQ ID NO: 1002 - protein, 327 aa, Aspergillus nidulans FGSC A4
MPSALLIGDITHARKEWEDLSSILTLKEFPSGNREDFIRNLKDGKYDDLVAIYRSNTSTKFTGPFDAELISLLPKSLKYICHNGAGYDNIDIPACSEKGISVSSTPVAVNNATADVGIFLMIGALRQAYVPLTAIREGKWHGQTTLGHDPKGKVLGILGMGGIGREMANRARAFGMTIQYHNRSRLSPELEQGAKYVSFDDLLATSDVLSLNLALNPSTRHIIGEKEFQKMKDGVVIVNTARGALIDEKALVAALESKKVMSAGLDVYENEPIVELGLLNNPRVMLLPHIGTMTYETQKEMEILVLDNLRSAVEKGELITQVPEQKK

SEQ ID NO: 1003 - protein, 334 aa, Idiomarina baltica OS145
MKTIDVIGIGNALVDQEFEVSEDFLAKHHLEKGMMALIEEEDQNKLIAELSTMGDLKKQCGGGSAANSLVAFAQFGGSAFYCCKVANDEAGDFYQRDLEHVGIQTNLTSQNNDGTTGRCLVMVTPDAERTMRTHLGITADLSTHELHPEAIAAAKYLYIEGYLITSEIAREAIAEAKRVARENDTKIVMTCSDPAMVKYFRDGIDEILDGGVDLMFCNREEAELLTGETDPHAAAQRLLNCASTVAITLGKEGALIADSERQIHIPGVPVQAVDTNGAGDMFAGAMLYGITQDMELEQAGRLASLAAAELVTEFGARLSKERQQQLLEKLLSYA

SEQ ID NO: 1004 - protein, 507 aa, Karenia mikimotoi
MCSRLLALTCAFCVCHARKMQTPSYQQQVKYVAEQMSAKDDKLDLNSLATLLLASIPRSAFAASGAGAHLPTPNRHDGIKMSTNPDAPIKLGVNGFGRIGRQVVRIAMDREAFVLKHINSPMSPEYMKYLLNHDTVHGRFDGTVEISDDGLIINGLPVSLSATRDPTEIPWKSAGVEYVCESTGAFTTTEGCLKHIESGAKKVIISAPAKDADTPTIVVGVNTDDYDPSMKVVSCASCTTNGLAPLVKVINEKFGIKQGLMTTVHAATASQLTVDGSMKGKDWRAGRAASANIIPSSTGAAKAVAKAYPVMKGKLTGMAFRVPTVDVSVVDLTCELEKETTYDDIKAEVKLASETYAKGVVGYTEDQVVSSDFIGETCSTVFDAEAGIMLTPTFVKLVSWYDNEWGYSTRLVDLVGLMAAADGVTTKEKALAYFTARAVEDTRQSKRSGDVRMEDWAQAMEEADEKLKKVIAAVLDVSESKIVPDATFESLGVQQDEIDPDEMFNPK

SEQ ID NO: 1005 - protein, 333 aa, Oryza sativa
MVKVGVNGFGRIGRLVTRAAVLSGKVQVVAINDPFIDLNYMVYMFKYDSTHGHFKGTVKAENGKLVINGHAITIFQERDPSNIKWADAGAEYVVESTGVFTTMEKAGAHLKGGAKRVIISAPSADAPMFVMGVNHEKYDKSLKIVSNASCTTNCLAPLAKVIHDNFGIVEGLMTTVHAITATQKTVDGPSGKLWRDGRGAAQNIIPASTGAAKAVGKVIPELNGKLTGMAFRVPTPNVSVVDLTCRLEKPAKYDDIKRVVKAAADGPLKGILGYTEDQVVSCDFNGDSHSSTFDAGAGIALNDHFVKLVSWYDNEFGYSNRVVDLMVHMASKE

SEQ ID NO: 1006 - protein, 307 aa, Karenia mikimotoi
RIGRLVFRAAMSNPDVKVVGINEPFMDLTYIVYQLKYDSVHKRFAGTIAMKQDGDKDFLIVNGMEIAVFHEKDPTAIPWGACGACYICESTGIFTAKEKAELHIKGGAKKVIISAPPKDSVPIYVVGVNHTEYKTSDTVVSSASCTTNCLAPLAKVVHENYGIKEGLMTTVHAMTATQLTVDGPSRGGKDWRGGRCASQNIIPSSTGAAKAVGKCLPALNGKLTGMAFRVPTPDVSVVDLTCALEKGAKYDDIVAKVKEAAAGPMKGVLDWTDEEVVSTDFVTCPASSVFDVKAGISLNENFVKLVT

SEQ ID NO: 1007 - protein, 331 aa, Zea mays
MATSTSQHALSSIKLLSTGCLHPDKRNCRVLSVSVGRRCPSARNLGLLCASNSQSSVIEPVQLPRSPKSGVTPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVISLELSTGIPMLYIFKEGKFIRRGSPAGPSEAGVYAYTKNLAQYRQKLDGIVQ

SEQ ID NO: 1008 - protein, 375 aa, Glycine max
APPPFSRFGTVSMAEIIRDQKTGDSLCYAFIEFEDKRSCEQAYFKMDNALIDDRRIHVDFSQSVAKLWSQYRQKDQKGKGGGCFKCGSTDHIAKDCTGEATMKQPQAKYILKDDNVQRGGDSARYEMVFDEDNSQHPRQDVKHQRHDRDDPVERKDHRSRRDQDMIDSNNRDRYGDRSRGHGGNGENKARSERGVIDLDSNADKKDRDRHMGRHGDDDYKRKDEHDSRKRDEDYVYKWKDKRDSRKRDEDDEYREIQTSRYDRRNTDSSHLERRNSRDYRKKPEDSGTQDMKIDSGQRKGSPGDEDYKNGRDHEDYERKMKDEDYRNRKEERVHKSQDIEADDGYKRRREDADYKRRRDDGDYRHRREERGHDRR

SEQ ID NO: 1009 - protein, 422 aa, Karenia mikimotoi
MAVRLGINGFGRIGRLVFRAAMENQSVTMAAINEPFMDLDYMKYLLAYDTVHNKFKGTVETKKDNSGEYLVVNGMSVRAFHEKDPGSIGWGAVGAAYICESTGVFTTQEKAALHLKGGAKKVIISAPPKDAVPMFVMGVNHEKYTADLTVVSNASCTTNCLAPLTKVIHDNYGLVEGLMTTVHAMTATQLTVDGPSRGGKDWRGGRAASENIIPSSTGAAKAVGKVIPEMNGKLTGMAFRVPTPDVSVVDLTCRIAKPAKMADICAKIKEASETTMRGIMGYTDKEVVSCDFTTDPRSSIFDASACIALNDTFIKLISWCDNEWGYSNRLVELASHMAMVDGVVPRPAKVVSVKAREIFDSRGNPTVEVDLLTDMHLFRAAVPSGASTGIYEALELRDGDKKRLLGKGVLKAVENVNTIIGP

SEQ ID NO: 1010 - protein, 302 aa, Karenia brevis
RIGRQVVRIAMDREAFVLKHINSPMSPEYMKYLLNHDTVHGRFDGTVEISDDGLIINGLPVSLSATRDPTEIPWKSAGVEYVCESTGAFTTTEGCLKHIESGAKKVIISAPAKDADTPTIVVGVNTDDYESSMQVVSCASCTTNGLAPLVKVINEKFGIKQGLMTAVHAATASQLTVDGSMKGKDWRAGRAASANIIPSSTGAAKAVAKAYPVMKGKLTGMAFRVPTVDVSVVDLTCELEKETTYEDIKAEVKLASETYAKGVVGYTEDQVVSSDFIGETCSTVFDAEAGIMLTPTFVKLVS

SEQ ID NO: 1011 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 1012 - protein, 162 aa, Triticum aestivum
  misc_feature (87)..(87): Xaa can be any naturally occurring amino acid
  unsure (1)..(162): unsure at all Xaa locations
MPRTRRLRGGFRLGRKLLTAWRWALCGRNRRRGGGGYLRLDTPCPMEGREAKKLAPVLRWGKSLARLLSLGRADRGQQTLEAVKTPXGQVAVYVGGGGPGEPLRYVVPVVYFNHPMFGELLREAEEAFGFQHPGGITIPCAAAKFERAAAVAAAGKKGFARW

SEQ ID NO: 1013 - protein, 397 aa, Thermococcus litoralis
MVKASKRAMSIEYAIRDVVLPARELEKQGIKIIKLNIGDPVKFDFQPPEHMKKAYCEAIMEGHNYYGDSEGDRELREAIVEREKKKNGVDITPEDVQVTAAVTEALQFIFGALIDGGEEILIPGPSYPPYVGLVKFYGGVPKAYRTVEEEGWQPDIDDMRKKITEKTKAIAVINPNNPTGALYEKKTLQEIIDLAGEYDLPIISDEIYDLMTYEGKHVSPGSLTKDVPVIVMNGLSKVYFATGWRLGYMYFVDPENKLAEVREAIGKLARIRLCPNTPAQKAAIAGLRGPMDYLEEYMAKLKERRDYIYKRLNEMPGISTQKPQGAFYIFPKIEEGPWKSDKEFVLDVLHNAHVLFVHGSGFGEGGEMHFRSIFLAPVPVLEEAMDNLEKFMKERLG

SEQ ID NO: 1014 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHENTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 1015 - protein, 248 aa, Synechococcus sp. CC9605
MGKQGVRRPVIAGNWKMHMTCAQSREFMEAFLPLIADTPDDRDLVLAPPFTALSTMAELSRNSRVCLSSQNVHWEGQGAFTGEISPAMLKEHGVTHTIVGHSEPRKYFSESDEQINHRARSSQSNGLIPIVCVGESDEQRERGEAERVIRRQIEQGLEGLDAEKLVVAYEPIWAIGTGKTCAAEEANRICGLIRSWVGSPDLVIQYGGSVKPSNIDELMGMSDIDGVLVGGASLEPESFGRIANYQAA

SEQ ID NO: 1016 - protein, 173 aa, Vitis pseudoreticulata
MEGNPATTSSMKMHSSDSGNSFGGKGGYKFWALAAILLLAFWSMFTGSVTLKWSASNLSRFPDDIDSPTHDDLDVLEVEEREKLVRYMWDLYTHTTTSRLPRFWEEAFEAAYMELASDVPSVRNAAVLEIAKMSLRSIHLHPLPLHSTGRRETRKNVKQAELGKEVSGVNSSQ

SEQ ID NO: 1017 - protein, 690 aa, Zea mays
MWSLLPLLLFLSSSLLAATTIAYDLWYTECASNTNYTRGGAFQANLDALLSSLPAAAAASYGFADNFTGAAPDQAYGLAQCRGDVNASTCLACLDGAARHMAATCPGQKDAMLIYDECLLRHSNASFLGAADASVRFCAWNPQNATQPEEFRTRLGALMGNLTARAAFASPRMFAAGKAAVSPFANVYGMAQCTRDLADDDCNRCLDGVVAFIPNCCDGKQGGRVIARSCSIRFEVYSFYDALGAQEAMSPAAAPVPGGGPTNGSGHSVDGNTGSSSHTVRTALLVAIPVAVALLLLVAVFLFLCRRNRQPHKHVQVASSVHEDEEDMRSSESLLYDLSTLRAATDNFSEENKLGEGGFGPVYKGTLQGGQDIAVKRLSATSQQGQVEMKNEVVLLAKLQHRNLTSSSTLESQITYTDKTELADPARRHELGWGLRQRIIEGIGRGLLYLHEDSRLTIIHRDLKASNILLDADMNPKISDFGLAKLFSIDSSVGNTSHIAGTYGYMAPEYAMHGLFSAKSDVFSYGVLVLEIVTGRRNSYTHASGPSEDLLTFVLYWSHLLTHQLELTFFGILIVMVWTHWSRGSVQPLLEGCPDEGLRAQEVLRCIHVALLCVQEDPHDRPSMASVVVMLNSRSITLPAPAAPAYAVPGRAVTASENPPRRMSLGRQGPMAAAREPSINEASVSELHPR

SEQ ID NO: 1018 - protein, 225 aa, Zea mays
  misc_feature (20)..(20): Xaa can be any naturally occurring amino acid
  unsure (1)..(225): unsure at all Xaa locations
TQRLNLHRSLPPPPPDPVPXIAPPPPQRTASTQSHSSLLLPSPRVLSFSRRRGRKSSAGGWGLLGSPVMAKLYVQAFPPADLNKNTEWFMYPGVWTTYIIIVFFSWLLVLSVFGCTPGTAWTVVNLFHFAITYHFFHWKKGTPFADDQGMYNTLTWWEQMDNGKQLTRNRKFLIVVPVVLYLIALHTTDYQQPMLFLNTLAVSVLVVAKLPNMHKVRIFGINAES

SEQ ID NO: 1019 - protein, 262 aa, Legionella pneumophila subsp. pneumophila str. Philadelphia 1
MKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 1020 - protein, 200 aa, Triticum aestivum
  misc_feature (58)..(58): Xaa can be any naturally occurring amino acid
  misc_feature (76)..(76): Xaa can be any naturally occurring amino acid
  unsure (1)..(200): unsure at all Xaa locations
MDWGFPDTLPKFGGQVPRTFGVRGCFPGPWIPSNPKWAPPVPGSSLDRLWQGIFMWTXLVNTCLHRYPFHIDTTSXWTNTAHYLLHGCHHKHPMEGLRLVFPPTAAAILCYPFWNFVKLFTTTTTTPGVFGGGLLGYVIYDCTHYYLHHAQPSSDPAKYLKKYHLNHHFRIQNKGFGITSTLWDHVFGTLPSTKTADKSS

SEQ ID NO: 1021 - protein, 418 aa, Brucella suis 1330
MTAHTNSPRILVIGTGDTKSDELLFMADVIERAGGSPVMIDVSILGNPPYEPAYSKHDVAEAAGTTVQAIIDSGDEHSAMALMAEGATALVRGLSQRGQVDGMIALGGSLGTDLALDIAAILPLGVPKFIVSTIAYSHLLPPERIAPDLMMILWAGGLYGLNPICRSVLSQACGAVVGAAKLVEKPSAEKPLIGMTSLGSSCLKYMRFLKPELEKRGYDVAIFHATGMGGRAYEAVAAQKGFVAVFDFCIQEVTNAESGSVVTSGPDRMENAERAGIPQIIAPGAVDMVDMPAWQNVPEQFRDRPYHAHNRLIASITVSPEQRRAVARVVAAKLERAAAPVAFILPTGGVQERDRNGEPLHEPEALGAFLDEMRGAVSGTITFEEVDAHINAPEFASRALAVFDRWVAEGIVVKGNVA

SEQ ID NO: 1022 - protein, 428 aa, Arabidopsis thaliana
MSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 1023 - protein, 489 aa, Burkholderia pseudomallei K96243
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLVEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 1024 - protein, 137 aa, Campylobacter jejuni RM1221
MEKTLSIIKPDAVKKGVIGKILDRFESNGLRIAAMKKVQLSKEQAENFYAVHKERPFFKDLVEFMISGPVVVSVLEGEGAVLKNRDLMGATNPKEAKAGTIRADFAESIDANAVHGSDSLENAKIEIDFFFKPNEIC

SEQ ID NO: 1025 - protein, 307 aa, Karenia brevis
RIGRLVFRAASANPAVKVVGINEPFMDLEYMVYQLKYDSVHNRFAGTIATKQEGGKDFLIVNGKEICIFHEKDPTQIPWGACGASYICESTGVFTAKEKAELHIRGGAKKVIISAPPKDAVPIYVVGVNHTEYKTSDTVVSNASCTTNCLAPLAKVVHENYGIKEGLMTTVHAMTATQLTVDGPSRGGKDWRGGRCASQNIIPSSTGAAKAVGKCLPALNGKLTGMAFRVPTPDVSVVDLTCALDKGASYDAIVAKVKEAAAGPMKGVLDWTDEEVVSTDFVTCPASSVFDIKAGISLNDNFVKLVT

SEQ ID NO: 1026 - protein, 314 aa, Oryza sativa (japonica cultivar-group)
MEESVGSRGGGGGGLDAQIEQLMECRPLSEPEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIDNLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 1027 - protein, 445 aa, Oryza sativa
MERKQAEYSNLDERYAIQGEKYQGQQYSHIYFTRLHHMRNLLHALVPSWKPHLPVTTVLGLEEGKDCIIVGTLYKHMKLKPSILDEYSKERSAIPLVKPHNFMHPDDHLILEDESGRVTLAGAIPPAAYVTGVVIALHGKETSAGNFLVEDILEAGIPPQITLPSINEDKYVVFVSGLSIGSEKFNPLQFQLLIDHITGHLGDENEQSIASNIVRVVVAGNSVHISPRFFNGQAVASKDQSRIAEPIKELDIMLTQVSLVASLPVDMMPGSNDPANFSLPQQPLHRCLFAGAATYNTFSSCSNPHQFELDSVRFIGTSGQNIDDLYKYSDAKDKLEFVERTLRWRHLAPTAPNSLGCYPYTDKDPFLVESCPHVYFVGNQDKYETQLLQGLEKQKVRLICIPRFCDSGVAVMVNTSSCMLTIGKAALFYLCNLESYKEAKSSSGD

SEQ ID NO: 1028 - protein, 307 aa, Karenia brevis
RIGRLVFRAAMENQSVTMAAINEPFMDLDYMQYLLSYDTVHSRFKGTVSTKKAGGAEFLVVNGMSVRVFHEKDPASIGWDKAGAAFICESTGVFTTQEKAALHIKGGAKKVIISAPPKDAVPMFVMGVNHEKYTADLTVVSNASCTTNCLAPLTKIVHDNFGLVEGLMTTVHAMTATQLTVDGPSRGGKDWRGGRAASENIIPSSTGAAKAVGKVIPEMNGKLTGMAFRVPTPDVSVVDLTCRIAKPASMKDICAKVKEASETTMKGIMGYTDKEVVSCDFTTDPRSSIFDASACIALNETFIKLVS

SEQ ID NO: 1029 - protein, 472 aa, Rhodococcus sp. RHA1
MNRRTKIVCTLGPATATGDRIRELVESGMDVARLNFSHGEHADHEENYKRVRAASDATGKAVGVLADLQGPKIRLGRFAEGRTTWANGEEVRITVDEVEGTHDRVSTTYKQLAEDAKAGDRLLVDDGKVGLVVSGVDGNDVICRVTEGGPVSNNKGVSLPGMNVSVPALSEKDIADLEFALGLGVDFIALSFVRSPADVELVHAVMDRVGRRIPVIAKLEKPEAIDNLEAIVLAFDAVMVARGDLGVELPLEQVPLVQKRAIQIARENAKPVIVATQMLESMIENSRPTRAEASDVANAVLDGADAVMLSGETSVGKYVMETVRTMARIVEAVENESTQVPPLTHVPRTKRGVISYAARDIGERLDAKALVAFTQSGDTVRRLARLHTPLPLLAFTPLPEVRSQLSLTWGTETFIVDPVESTDAMVRQVDHALLGLGRYQKGELVVIVAGSPPGTVGSTNLIHVHRIGEEDH

SEQ ID NO: 1030 - protein, 458 aa, Bradyrhizobium sp. BTAi1
MSMQHVVSDPIRLTAPRRNSLTHIPGDEGWPIIGKTFEVLADPKGHVERNARKYGPVYRSHMFGEVNVVLLGPEANELVLFDQAKLFSSAHGWGHILNLLFPRGLMLLDFEEHRMHRKALSVAFKAGPMKSYLTGLDRGIAARIAQWKQTPGEMLFYPAIKQLTLDLAATSFLGTEIGPEVDAINRAFVDMVAASVAPIRKPLPGTQMARGVKGRQRIVAYFSEQIPLRRAKGDGDDLFSHLCRATDDHGALLSTQDIVDHMSFLMMAAHDTLTSSITSFIAQLAAHPEWQQKLRDEVASLGLVAGAPMASEHLEKMKLTEMAFQETLRLMPPVPSLPRRPIRDFTFKGYAIPAGTGVGVNPMFTHHMPEIWPEPERFDPLRFTDEAQRGRHRFAWVPFGGGAHMCLGLHFAYMQVKCFARHFLSNIEVSFAPGYRPNWQVWPIPKPRDGLRVMLKAV

SEQ ID NO: 1031 - protein, 325 aa, Eurotium herbariorum
MSSGQTFKLNNGVTIPGVGFGTFASEGSKGESYNATLHALRTGYRHLDCAWFYQNEEEIGEAIRDFLKENSSVKREDIFVCTKVWNHLHRYEDVIWSVENSLKRLQLDYIDLFLVHWPIAAEKETQEQPKIGADGKYVILHDLTENPEPTWRAMEKIYEDGKARAIGVSNWNISDFEKLFKFAKVKPTVNQIEIHPFLPNEELVQYCFKHDVLPAAYSPLGSQNQVPTTGERVSENKTLNDIAQKGGNTLAQVLIAWGLRRGYVVLPKSGNPARIESNFKSINLSDEDYEAVNAVAKGRHFRFVNMKDTFGYDVWPEETAKQLSA

SEQ ID NO: 1032 - protein, 424 aa, Arabidopsis thaliana
MGNSNSSSVDHRFISASRAFTQKKLDDLKSLFVSLASNSQSNDQYVSYPVFQEYFGLSGSLGERMFDMVTQRRKDDKMTYEDLVIAKATYEKGTDDEIAEFIYQTLDVNGNGVLSRSDLESFLVVILKSVFSTESSDAESSDYKKMVDALLNAATFSKSDDGSEKGMSFEDFRSWCSFVPTIRKFLGSLLMPPSTVRPGYQVPHLLYEDSVSSDRLLLKKEYAWHIGGALPHHELVEWKLLYHSSVHGQSFNTFLGHTSNTGMSASVLIIKDTEGYVYGGYASQPWERYSDFYGDMKSFLFQLNPKAAIYRPTGANTNIQWCATNFTSENIPNGIGFGGKINHFGLFISASFDQGQTFECTTFGSPSLSKTSRIQPEVIECWGIVQASNEQDTKHNAMKGTVLERFKEDRNMLKLVGMAGNSND

SEQ ID NO: 1033 - protein, 308 aa, Karlodinium micrum
RIGRLVFRAALGNPEAKVVAINEPFMDLAYMVYQLKYDSVHKRFPGTVASKQDGGKDILIVNGEEIRVFREKDPASIPWGEAGAAYVCESTGIFTEKAKAELHIKGGAKRVIISAPPKDAVPIYVVGVNHTEFNPAADTVVSNASCTTNCLAPLAKVVHENFGIKEGLMTTVHAMTATQLTVDGPSRGGKDWRGGRCASQNIIPSATGAAKAVGKCLPALNGKLTGMAFRVPTPDVSVVDLTCKLEKPAKMDEIVAKVKEAAAGSMKGVLDFTDEEVVSTDFVTYPASSIVDISAGIALNDTFVKLVS

SEQ ID NO: 1034 - protein, 312 aa, Streptococcus thermophilus CNRZ1066
MKTYERVYEILAKSPDFVTGESLAKELGISRTAIWKAIQSLQDQGVVITSVRKKGYHLEKGDILLSQEISKQLNFPVYFNPDSTSTQLDAKHGMERQDPAPSLYLASNQGSAKGRFERHFHTSPHGGIYMSIHLKPNCHFSELPPYTMMVAASIVKAIQRLTGIDTDIKWVNDIYLNNKKIAGILTEVISSIESGCITDVIIGVGLNFSISDFPEEIATKATSLFQNERPTITRNQLISEIWKLFLTIPTTDLVKVYKEKSLVLDKQVTFEQSGKAYSGIAKEIGDKGQLLVLTDDGQEKWLSAGEVSLTSW

SEQ ID NO: 1035 - protein, 524 aa, Bordetella bronchiseptica RB50
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 1036 - protein, 454 aa, Agrobacterium tumefaciens str. C58
MTSYTFDALKMDVAEGRIDTVLACLVDMQGRLMGKRFQAEFFVESAFEETHSCNYVLATDMEMETVPGYKSSSWEKGYGDYTLKPDLSTLRKVPWLEGTALVLCDVLDHHTHEEVPHSPRALLKKQVARLEAMGLKAYMATELEFFLFDQTFDAARASGYKDLNLASGYNEDYHIFQTTKEEDVMRALRKGLQGAGIPVENSKGEASPGQAEINVRYAEALTMADRHAIIKNATKEIAWSKGKAVTFLAKWNYNAAGSSSHIHQSLWSLDGKPAFLDKDGEHGMSDVMRHYVAGLLAHASDITYFLAPYINSYKRFMAGTFAPTKAIWSLDNRTAGYRLCGAETKGIRIECRVGGSDLNPYLAMAALLAAGIDGIENKLELEPAFVGDAYGGKDVREIPKTLRDATAFLDGSKMLRQAFGDDVVDHYVHAARWEQEEYDRRVTDWEVARGFERA

SEQ ID NO: 1037 - protein, 393 aa, Helianthus annuus
MTVPSTRKDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNFFRIGGVAADLPHGWIDKCLDFCDYFLTGIAEYQKLITRNPIFLERVEGVGIIGGEEAINWGLSGPMLRASGIEWDLRKVDHYECYDEFDWEVQWQKEGDSLARYLVRISEMTESIKIIQQALEGIPGGPYENLEIRRFDRVKDTVWNEFDYRFISKKPSPTFELSKQELYARVEAPKGELGIFLIGDKGVFPWRYKIRPPGFINLQILPQLVKRMKLADIMTILGSIDIIMGEVDR

SEQ ID NO: 1038 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 1039 - protein, 151 aa, Synechococcus sp. CC9605
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAAETAQFEIGLWFQASELNDWSPSDQGWRVEG

SEQ ID NO: 1040 - protein, 237 aa, Trichodesmium erythraeum IMS101
MVTEQDPTTLMKQQVGKAAAEEVKSGMIVGLGTGSTTAYMIQFLGELLQRGELKDIKGIPTSFQSTVLAKKYGVPLTTLDEVDYMDIAIDGADEVDPQKNLIKGGGAAHTREKIVDCLAEKFVVVVDSSKLVDKLGSTFLLPVEVIPMAMNPVIRAIEKLGGQPEVRMGVKKAGPIVTDQGNLVIDVKFDSIDNPGELEKSLNNIPGVLENGLFVGVADVILVGEIDNGKPIVRTIS

SEQ ID NO: 1041 - protein, 351 aa, Oryza sativa (japonica cultivar-group)
MQGGSSGIVYGGLKYQARCIADVRAAAGSTTFLAGTLSLKEENEVHLIRFSPAESELVCDGLFYHPNEIWDLKSCPFDHRVFSTVYTSGEGYGASVWKIPELHGQSNSPPLEQLFTLDEHTGKIRCVLWWPLGKHDKLISIDDRNIFLWNIDASNKSAKVMQKGSADMLPNLRGGSWDPHDHNSIAAITDSSLHCWDLRSMKKSNAIEHAHFRDVDYNPKKQHLITTAEDEFGIRLWDLRMLKYPLKNLPGHSHWTWAVRHNPEHDQLILSAGTDSTVNLWFAKVGTDDSGPESPPGSPTREEEPLLNSYTDYEDSIYGIAWSSHDPSLFASLSYDGRVVLESVKPYLQRK

SEQ ID NO: 1042 - protein, 402 aa, Sulfolobus solfataricus P2
MVSLLDFNGNMSQVTGETTLLYKEIARNVEKTKKIKIIDFGIGQPDLPTFKRIRDAAKEALDQGFTFYTSAFGIDELREKIAQYLNTRYGTDVKKEEVIVTPGAKPALFLVFILYINPSDEVILPDPSFYSYAEVVKLLGGKPIYANLKWSREEGFSIDVDDLQSKISKRTKMIVFNNPHNPTGTLFSPNDVKKIVDISRDNKIILLSDEIYDNFVYEGKMRSTLEDSDWRDFLIYVNGFSKTFSMTGWRLGYIVAKREIIQKMGILAANVYTAPTSFVQKAAVKAFDTFDEVNQMVSLFKKRRDVMYDELTKVKGVEVSKPNGAFYMFPNVSKILKTSGFDVKSLAIKLIEEKGVVTIPGEVFPLNIGKEFLRLSFAVNEEVIKEGIQKIREFAEQMMNSR

SEQ ID NO: 1043 - protein, 270 aa, Exiguobacterium sibiricum 255-15
MQYAKLSNGVTIPQIGFGVWQVDEETEAPAAVAEALRVGYRHIDTAAVYKNERGVAKGIKESGVNREDLFLTSKVWNDDIRAGRTKEAFAESLERLETDYLDLYLIHWPVEGYIEAWKAMVELYEAGKIKAIGVSNFKEHHLDTLAEEGLMTPMINQVELHPQLPQHELHEYLQDHSIQVEAWSPLMQGKFLEINDFKEIAEKHGKSPSQVVLRWHLDNGIVALPKSVTPERIAENFDVFDFQLDADDLEKIDRLATDVRLGPDPDEIDF

SEQ ID NO: 1044 - protein, 460 aa, Exiguobacterium sibiricum 255-15
MKEHPTELRRDLKTRQLTMIAMGCAIGTGLFLGSGLAISLAGPSVLVSYAIGAFIVLLLMGCLAEMTVAHPTSGSFGTIAEKYIGPYAGFLVRYSYWVANVLAIGVEVSAIAIYMKYWFPDVPGYIWIFVFAAALIYINATTVNTFATFEYWFSVIKISAILMFMILGAYLVFGSSSPEIGPQNFTNDGGFMPFGFSGLWIAVFISLFSFLGTELIAVTAGEAKDPDVAVPKALKATVFRLSTFYVITIALMLMIVPWQQAGGVDESPFVKVMEMLSIPGAAGIMNFIVLTAALSAMNSQLYASTRMMYSLSKATYAPRMFSRLNAKGVPLFALAVSTLGIFLAAVISSQSSVSYPFMMGISMFGAIFTWFMIFISHLYFRKAWERDGGRKLPVRMMGYPYLTALGALLLFALVITTWFTDFQIVLKFGIPWLIFLTIAYVFWKRNHPPQADQTNRSQSL

SEQ ID NO: 1045 - protein, 169 aa, Triticum aestivum
  misc_feature (155)..(155): Xaa can be any naturally occurring amino acid
  unsure (1)..(169): unsure at all Xaa locations
GLGPTSHAPRHGRGISVVAAEVLNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLXKGASESLHVKDYKY

SEQ ID NO: 1046 - protein, 185 aa, Triticum aestivum
MSAVNLTNVAVLNNPTSFVNPFQFEISYECLVALEDDLEWKLIYVGSAEDENYDQQLESVLVGPVNVGTYRFVLEADPPDPSKIREEDIIGVTVLLLTCSYMGQEFIRVGYYVNNDYDDEQLREEPPAKLLIDRVQRNILTDKPRVTKFPINFHPETSGGQQQDQPQSAVPENHTSEGSKASTDL

SEQ ID NO: 1047 - protein, 333 aa, Acidovorax sp. JS42
MTIKIGINGFGRIGRNVLRSAVQNFSDIEVVGINDLLEPDYLAYMLRYDSVHGRFKGEVSVEGNTLIVNGKKIRLTQERDPANLKWNEVGADIVIESTGLFLDKASAEKHIAAGAKKVLMSAPSKDDTPMFVFGVNHATYAGQAIISNASCTTNCLAPVAKVLHDKWGIKRGLMTTVHAATATQKTVDGPSNKDWRGGRGILENIIPSSTGAAKAVGVVIPSLNKKLTGMSFRVPTSDVSVVDLTVELEKEASYDEIKAEMKAQSEGALKGVLAYTEDKVVATDFVGETHTSVFDADAGIALDKTFVKVVAWYDNEWGYSNKCLEMVRVMAGK

SEQ ID NO: 1048 - protein, 492 aa, Debaryomyces hansenii CBS767
MSSSGNNASVYGGDEINAIVLDSSSFHTRIGYAGDDFPKIITPSSYASPNEDAMELDNKKKNGKSKSSKIFGESINIPRSNHNVSPILKDSVIIDWEAAIEQYHYYFDDVLTLNYKEQPILITEPVWCTPQYRQTLLETFYENFDFPALFLAKSPTCISFQQGRPNCLVVDIGHDSVSVTPVIDGISLLKNSMKTNYGGQYLNDQIEDMLTHKFSGVNFENRYRIKSKTPTVYPEESKYTVRDLSENITQSFDDYQRQNIWHEFKETMLEVPEKKFNTSNTSQANSLKEIYSQDSNKRLFELPTGQSLELCLERFQLADSLFDPQSYKFNNPDLATKYPPSNGELSLTNSYDDYKPLKRARKAESNQSTPPPSDAKKPSSKTSQIRGLTHLITHTLSTIDIDLRSSVAHNIIVTGGVSLIPQLTERLYSELSNSNPGLKIRLHAVGNSSERFNQAWIGGSVLASLGTFHQMWVSKQEYEEAGAERILNQRFR

SEQ ID NO: 1049 - protein, 175 aa, Triticum aestivum
MAATVMASSATSVAPFQGLKSTAGLPVSRRSNGASLGSVSNGGRIRCMQVWPIEGIKKFEILSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIGFKPPGCEESGKA

SEQ ID NO: 1050 - protein, 750 aa, Candidatus Kuenenia stuttgartiensis
MINFQMHTIKLKRASVILLIFLFYFYGIWLPQVKAEKVSITKDSEQVPANNKKETLETQSAPIEQCEIQSPALDEKPFQAIVVEKTPPSGTVTAEGETLKENTSIREDGQEIATEEEIYDVTSPIILSNPSPDGEVSSIEEEKGDQTSVVDNEQQENTPDEGKASSHEEEKSPISHQVNTDEGEFQDIKEMGVSSYLPEPSPATAREEGPFPEFDVANNESSEETSPTNEDKEDIVIDKDMLSDVKEEETLSIAPTSTPSTPSPGEEMVLVKEEKGTQSSVVPDEESISLLQEEKLPIEYQSVRNEEISLQKPVGDIAESEGSGHVWEIWHKDPTHAVILAIAIILIAAKIAEWLARRLRLPGVVGKLIIGMILGNVITFTGWDFFDFLRTMPFVKMISYFGTLILLFTAGLNTDLRALLRVGTSSLLVCLGGIIAPAGLGLMVGHFLLPDISSGTKLLLAIVLCNSSTGLLLAVLSELKAINTLEGRVIAGATILTDIIVILTFGVVSGFVVKGGGSLVGMSLSFGIAITSLIISLIVIVKYGDKFGNFLTKRLTEGLNIPIVVILSLLLAFMFGSVGLHTVIGAFVAGLFLRNVKLWNSDDGEHRNVESFIRPFYMLLVPILFVRVGAQVELGSFFNLNALLLGLAITGAAVIGKMFCSVCPIEKGINRLAIGIGMATKMEGTLILAGLGRDMGTLSDTVFSSVIMAIVFTSIICPSLLRNILLKKGCSPEILPVTKRKKELEGAVLN

SEQ ID NO: 1051 - protein, 255 aa, Oryza sativa
  misc_feature (220)..(220): Xaa can be any naturally occurring amino acid
  unsure (1)..(255): unsure at all Xaa locations
MGRKFFVGGNWKCNGTTDQVDKIVKILNEGQARGTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCRXLAAKPDVDGFLVGGASLKPEFIDIIKLPPTREVPP

SEQ ID NO: 1052 - protein, 312 aa, Oryza sativa
MDFLACVCLLHLLFLATSRVAAQASSPARALDAMLQDHAYRAFVHPHTGIVYNATVPANLTGVALSAVRLRSGSLRRKGFSDYFDFTVPTGIVVQPYVERVVLVYHNLGNWSDHYYPLPGYTYLSPVLGLLLYDAANLSAVGLQELSFVASGSPISINFSDVRSVPAGGPAPRCVWFDLDGVPQFRDLEASNVCSTYRRGHFSIVVNSSAIPPGPVPSGNITPPIPTPTGRSKGSSKGWKIAVGVVGGVIALVLLASLVVCLARYKRDKKLELMEQNAETGETLRMAQVGRSQAPVALGTRTQPVIESEYVA

SEQ ID NO: 1053 - protein, 480 aa, Salmonella enterica subsp. enterica serovar Typhi
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGNLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 1054 - protein, 501 aa, Ehrlichia canis str. Jake
MTNHSVILCILDGWGNGENNQFNAIAQAYKPCWDNITLQYPKSHLITHGSSVGLPDGQIGNSEVGHVNLGSGRIVLQDLCKINNEIKYIKDNVYLLEFINKIKKNNGICHIAGLLSDGGVHSSYTHILDIINTLSDFQIQVAVHIFLDGRDTPPISATKYISILCEHIKHLNNINIATLSGRYYAMDRDNRLDRTTKAYNAIAFANAKRYEDPLTAVQDSYNLGITDEFILPCIIGNYQGMKPQDGFIMTNFRSDRVIQIIKMIIGDIKTDNHITLDNTIGMVKYSDKINIPCLFPNNNITNTLGEVIANNQLHQLRIAETEKYAHVTFFFNGGKEDMFENEDRIIIPSPSVATYNLTPEMSAEKVTDTIIEKIKLQKYSLIIVNYANADMVGHTGNIDATKQAITTIDQCLSKILNCIQNTNYVLVITSDHGNAEEMFDVKNNMPYTAHTLNPVPFIICNYNKKIRLKNGRLCDVAPTILEILNLAKPKEMTGVSLIEQV

SEQ ID NO: 1055 - protein, 362 aa, Bradyrhizobium sp. BTAi1
MKAAVLMEVNKPLVIEDISVPKPGPREVLIRTAVAGLCHSDLHFIEGLYPHPLPAVLGHESAGIVEQVGSDVTYVKPGDHVVTCLSVFCGTCDNCTTGRPVLCTDTTVKMPPGASNRLSWGRSEKLHQFLNLSSFAEQMLVHENAIVKIRPDMPLDLAALIGCGVITGYGAVVNTARVTAGETVAVIGCGGVGMAAINGAEIAGAGRIIAIDTNPAKLQLATKLGATDIINPADGDVVAQVRELTKGGVHHAFEVLGRKETAEQAFAMLAPGGTATIVGMIPFGQKIELHGFDFLRERRIQGSSMGSNHFRVDMPRLVEFYLRGRLHLEDWISAKLKLSEINEGFANMKAGKTLRSVIVFDA

SEQ ID NO: 1056 - protein, 326 aa, Sulfolobus solfataricus P2
MISMETIQGVNSIGKLDFKVLITDPVDQYMIRTLQNNGLIVDYKPEITREELLKIIDQYQVLIVRSRTKVDKEIIRYGVNLKIIARAGIGLDNIDTEEASKRNIKIVYAPGASTDSAAELTIGLLIAAARKLYDSMNMAKGGIFKKIEGIELAGKTIGIVGFGRIGTKVAKVCKALDMNVIAYDVINIKEKANIVGVRVAESLEELLKNSDVITFHVTVGKDAKPILNKDTFNYIKDNAIIINTSRAVVIDGKALLEYIDKKHLTYATDVLWNEPPKEDWEIKLLRHERVIVTTHIGAQTKEAQHRVAVVTTDNLITALKEIGVLK

SEQ ID NO: 1057 - protein, 330 aa, Idiomarina baltica OS145
MKIEQRLEQLIKLLNDGEFHSGESLGQAMSVSRAAINQYIERLDALGIDVFSVSGKGYRLASSIDLLNAEQIVAASELPKSMLNVSSIVGSTNDDLKQLSDTQQLPQGYAILAEAQTQGRGRRGKQWISPFGTNLYISLYWRLEEGLGRAMGLSLAVGLAIARVLREQLNIKNVSVKWPNDVYIENKKVAGILIDIDSLEDGSARCVIGVGINLTLPDTAAQSIDQAWTDVNSHLALPLQRNRFAGRLHQYLVRTLTDYENSGFGQFATLWREYDKFDTKPVRLLLGERKVDGLCRGVDETGALLVEVDGSVKRFFGGEISVRPGDATSH

SEQ ID NO: 1058 - protein, 478 aa, Acidovorax sp. JS42
MQIRRATKIVATLGPASSDPQLLEQMIAAGVNVVRLNFSHGKAQDHVERAAMVREAAQRAGREVAIMADLQGPKIRVGKFAEGRVMLEPGQPFVLDASRSEPGDLQGVGLDYKELPRDVKPGDVLLLNDGLIVLQVDAVRGEAVYTTVKIGGELSNNKGINKQGGGLTAPALTAKDMEDIKTAMSFQADYVAVSFPKNATDMEMARQLCNVAAAEFRHKPGLIAKIERAEAVPLLEEILRVSDGIMVARGDLAVEVGNAAVPALQKKMIRMARDMNKVVITATQMMESMIANPVPTRAEVSDVANAVLDGTDAVMLSAETAAGKYPLDTVREMAAICAAAEAAEDLERDSDFIGQTLGRIDQSIAMGALFTAHHLGAKAIVAMTDSGSTALWMSRHRIHIPIYALTPKVATQRRMAMFRNVCPLLMDTSADRDTALDQAESHLKMRNIVQQGDLYVITCGEPMGAPGGTNMLKICRAR

SEQ ID NO: 1059 - protein, 174 aa, Zea mays
  misc_feature (122)..(122): Xaa can be any naturally occurring amino acid
  unsure (1)..(174): unsure at all Xaa locations
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETXYQSTTEGKKMVDVLVEQNIVPGIKVDKGLVPLVGSNNESWCQGLDGLSERAH

SEQ ID NO: 1060 - protein, 346 aa, Legionella pneumophila str. Lens
MKAFIYQGPGKKAIEERPTPIITNPTDAIIKVTKTTICGTDLHILKGDVVTCVPGRILGHEGIGVVDKVGQGVTEFQKGDLVLISCITSCSKCEYCRKGMYSHCAKGGWILGNTIDGTQAEYVRIPYADTSLYKIPEGIDEDVLVMLSDILPTGFECGVQNGKVQPGNTVAIVGAGPIGLSTLLTAQFYSPAEIIVIDLDDNRLEVAKRFGATATVNSSDGKAVDKIMQMTNGRGVDTAIEAVGIPATFVMCEDIVAPGGTIANIGVHGVKADLHLERLWSQNISITTRLVDTVTTPMLLKTVSAKKINPMLLISHRFKFAKILDAYETFAHAADTHALKVIINVS

SEQ ID NO: 1061 - protein, 754 aa, Streptococcus suis 89/1591
MTKFTTFAETNTSKKLADLTNEEIYLQLLNYVKDAAASKPKNTGKRKVYYISAEFLIGKLLSNNLINLGVYKDVQAELAAAGKSLAQVEDVEPEPSLGNGGLGRLASCFVDSMSTLAINGEGVGLNYHCGLFRQVFKKNEQEAEPNFWIENDSWLIPTTISYDVPFKNFTLKSKLDRLDILGYKKETKNYLNLFDIESVNYDLITDGISFDKTDIKENLTLFLYPDDSDKNGELLRIYQQYFMVSNAAQLLIDEAVERGSNLHDLADYAYVQINDTHPSMVIPELIRLLTEKHGIEFAEAVAIVKNMTGYTNHTILAEALEKWPLEFLEEVVPHLVDIIKELDALIRAEIKDPAVQIIDESGRVHMAHMDIHFSNSVNGVAALHTEILKNSELKAFYELYPEKFNNKTNGITFRRWLEFANQDLADYIKELIGDEYLTDATKLEKLLAFADDKEVHAKLAEIKFNNKLALKRYLKDNKGIELDENSIIDTQIKRFHEYKRQQMNALYVIHKYLEIKNGNLPKRKITVIFGGKAAPAYIIAQDIIHLILCLSELINNDPEVSKYLNVHLVENYNVTVAEKLIPATDISEQISLASKEASGTGNMKFMLNGALTLGTMDGANVEIAELAGMDNIYTFGKDSDTIIDLYDKAGYVSADYYNGDANIKRAVDFIVSDEVKALGNEERLGRLHHELISKDWFMTLIDLAEYIEVKEQVFADYEDQDSWNKKVVHNIAKAGFFSSDRTIEQYNQDIWHSN

SEQ ID NO: 1062 - protein, 370 aa, Kineococcus radiotolerans SRS30216
MLAAVLSPDSAEFVLERVPVPAPRAGEALIRVAACGVCHSDLHVLKGEIAFPRPAVLGHEISGTIVQLGDGVENLRVGDAVVGGFIMPCTRCDECQRGRDDLCPQFFAQNRLKGALFDGETRLRRTDGSPLAMYSMAGLAEYSVCPVSALAVLPSEVSMTSAAVLGCAGMTAYGAVHRAGSVQPGATVAVVAVGGLGMSMVQLAAAAGASTVVAVDVNDEKLAMARRLGATHTVNSAKEDAHAAVRAATGGRGVDVAIEALGRPATLRLAVDVLADGGRAVAVGLAAGNAEVGIEITPFVRRSRSLMGSFGARTRTDLPAVVDLAARGSFDPDALVTDVFSLEDVNEAYSRLDGGDILGRAVVSMGSSLS

SEQ ID NO: 1063 - protein, 273 aa, Ralstonia eutropha JMP134
MSYLLDPSRKTVTITRLQAMRDAGEKIAMLTAYDSSFAALLDYCGVEVILVGDSLGNVMQGQQTTLPVTLEHMAYHTECVARANQTALLVTDLPFGTYGTPEMAFASAVTLMRAGAHMVKLEGGDWLAPTVKFLVERSIPVCAHIGLTPQSVHAFGGFKVQGKTDEGAAQLRRDAQAMEAAGAQIVLMEAVPATLAGEITQMLKVPTIGIGAGADCSGQVLVLQDMINVYPGRKAKFVRNFMDGQTTIEGAIRAYVAAVKDGSFPAAEHTFSA

SEQ ID NO: 1064 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFKHETIKSIADKHGKSPAQVLLRWATQRNIAVIPKSNNPERLAQNLSVVDFDLTKDDLDNIAKLDIGLRFNDPWDWDNIPIFV

SEQ ID NO: 1065 - protein, 1030 aa, Candidatus Kuenenia stuttgartiensis
MSSYKSSLVFLIVFISLYCTDMLGAPVLEAKHLEPSNDSQPIHADTQKERVSLAVEENGTQTIAGDNQPIQTPVIEHPSPTTVDMRDVGIQTPNSNSDVITTEKEEPYTSEHAENKYSQKIAHTNKDDRPIVHAEEALSDTTGRDNIVATPTPIPSVTPTGYGQSLVEEEKEIHTPSPEGELSQAIPIARRDPHATEEHPGEESSIKEVPPQHAITTESRSDTDILAKEALSDTTAQDNTIATPMPILPVTPTGHEQSLIEEEREIHTPSPEGELSQAIPIENETPHGTEEHPEEESSIKEVPPQHAITTGSRSDTDILAKEALSDTTAQDNTLVTPMPILPVTPTVHGQSLIEEEREIHTPSPEGELSQAIPIENETPHGTEEHPEEESSIKEVPPQHAITTGSRSDTDILAKEALSDTTAQDNTLVTPMPILPVTPTVHGQSLIEEEREIHTPSPEGELSQAIPIENETPHGTEEHTRDESSIGEVPPQHSILTENHRDTEEKSVLSDTPAPAPTPTYSAASVDVEESLITGEKEEPSPYGGSKSSPNASVERLPSTPLEGFLQGKEDRDTEPPRKDAGESTTVIASGERRIAAVKKGKDSGNGWEIWHKDPTHAVILAVAIILIAAKIAEWLARRLRLPAVVGKLIVGMILGNVITFTGWDFFDFLRTMPFVKMISYFGTLILLFTAGLNTDLRALLRVGTSSLLVCLGGIIAPAGLGLMVGHFLLPDISSGTKLLLAIVLCNSSTGLLLAVLSELKAINTLEGRVMAGATILTDIIVILTFGIVSGFVVKGGGSLVGMSLSFGVAITSLIISLIVIVKYGDKFGNFLTKRLTEGLNIPIVVILSLLLVFMFGSVGLHTVIGAFVAGLFLRNVKLRNSDDKEHRNVESFIRPFYMLLVPILFVRVGAQVELGSFFNLNALLLGLAITGAAVIGKMFCSVCPIEKGINRLAIGIGMATKMEGTLILAGLGRDMGMLSDTVFSSVIMAIVFTSIICPSLLRNILLKKGCSPEILPVTKRKKELEGAVLN

SEQ ID NO: 1066 - protein, 832 aa, Candidatus Kuenenia stuttgartiensis
MSSYKSSLAFLIVFISLFCVIMLGTPELEAKHLEPSNDSQSIHIDTQKERDSLTVEENGTQTTAGGNKPIQTPDSNSNNIITEKEEPYIISEHEENKYPQKIAHPNEDDRPIVPTEEALSDTTEQDNIMATPTPILSVIPTGYGHSLVEKEKEIHTPTPSPEGELSQAIPIEISAPHATEEHLEEESSIKEVPPQHAITTESRSDTDILAEEALSDTTAQDNTLVTPMPILPVTPTVHGQSLIEEEREIHTPSPEVELSQAIPIENETPHGTEEHPGDESSIEEIEPQHAIITATPGDAEEKGAISAMPVPTPEYPAASAHTEESLVPIEKDKPSHDVERGAPTIPLELLPFTHIEGSSQVNEERDAGLPTKDTDESTTGIASEEHRLDTVKEEGVSRPAWDILHKDPSHSVILAIAIILIAAKIGELLAKNVQLPSVVGNLLAGLVLGNIYIFTGGDFFEFLKTMPFLKMISYFGTLILLFTAGLHTDIRMLLRAGASSLLVCMGGIIVPAGLGLVAGHFFLPDASNGTKMLLAIILASTGMGLLTAILGELKAMNTLEGRILIGAGVLTEIMVILSFGLVSGFVAREGNSFLHILVSVCIAISFLTIALVIILRYSEKFGSFLTKRAKEGLNIPIVIVLCLLLAFMTGTIGLHTVIGAFVAGLFLRNVKLSDSDEFDEEEYRTIESFIRPFYKIIVPILFVKVGAQVDLMSFLHVNTAILGLAITGAAIAGKMFCSVCPIERGVNRLTIGIGMAIKMEGTLILAGIGRDMEIFNSAVFSSAIMVIVLTSIICPYFLRAFLQKKGDAQDIVSVAKAEEGIKKGCVKLNTQG

SEQ ID NO: 1067 - protein, 510 aa, Oryza sativa
MGPLWTFILLYPEIFLAIICFFWFSLFRPIRQRQKSNLPVNWPVFGMLPFLVQNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTITRKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDERFLRDTAVGFIFAGKDLIAVTLTWFFYMMCKHPHVEARILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 1068 - protein, 158 aa, Triticum aestivum
  misc_feature (84)..(84): Xaa can be any naturally occurring amino acid
  misc_feature (94)..(94): Xaa can be any naturally occurring amino acid
  misc_feature (105)..(105): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(129): Xaa can be any naturally occurring amino acid
  unsure (1)..(158): unsure at all Xaa locations
MAPAVMASSATTVAPFQGLKSTAGLPVSRRSSGSLGSVSNGGRIRCMQVWPIEGIKKFETLSYLPPLSTEALLKQVDYLIRSKXWVPCLEFSKXVASVFREHNSXPGYYDGRYWTMWNCYXRXNDAXXXNEVRVRRVPDAMSRMVHNCAVSRIMQRFK

SEQ ID NO: 1069 - protein, 780 aa, Mycobacterium sp. KMS
MTNRGSAARSAAPPVARSGAPNRTAVRWPGWVCANRAGDMTEAGLSEREPNLSHLRLTARLNTAALDSRRGVVRLHPEVIAALGIREWDAVSLTGARTTAAVVGIAPPGTPTGTALLDDVTLSNAGLPENSSVIVAPVTVYGARSVTVSGSRLATNSISPATLRQALLGKVMTVGDTVSLLPRDLGPGTSTSSATTALASSVGITWTSELLTVTSVDPPGTVSIQPNSSVTWGDGPAPKAASAGPTDGAAVGEATVTTPSVDRPAVSFDDLKGSHAQAGRLTEWLKLSLDEPSLLETLGATAHLGVLVSGPAGVGKATLVRTVCAQRRLVELDGPEVGALHAEDRLNRVSSAVSTVRDGGGVLLISDIDALLPATPEPVGTLILTELRTAVATPGVAFVATSARPDGVDARLRDPDLCDRELGLSLPDAATRKELLEVLLRSVPAQELHLDEIAGRTPGFVIADLCALVREAALRAAARASADGAPPQLTQADLTGALTVIRPLSRSATEEVSVGSVTLADVGDMTETKQALTEAVLWPLQHPDTFERLGIEPPRGVLLYGPPGCGKTFVVRALASSGRLSVHAVKGAELMDKWVGASEKAVRELFRRARDSAPSLVFLDEIDALAPRRGQSFDSGVTDRVVASLLTELDGIEPMCNVVVLGATNRPDLIDPALLRPGRLERLVFVEPPDAEARREILRTAGKSVPLADDVDLDTLAAGLDGYSAADCVALLREAAMTAMRRSIDAADVTAADVEAARQTVRPSLDPLQVDTLRAFAENR

SEQ ID NO: 1070 - protein, 335 aa, Pseudomonas syringae pv. syringae B728a
MPLRGYDACLIARRFQMLTLLKLLADGAFHSGQVLGDALGISRSAVWKQLQQLEADLGIDVHKVRGRGYRLATPISLLSPADIMQSGFPAGWSVRTYDSIDSTNAEAARLIAQGVPMPLLVVAEQQTSGRGRRGRKWISPFAENLYYSLVLRIDGGMRQLEGLSLLVGLAVMNVLRDMGVQDAGLKWPNDVLVGRQKIAGILLELIGDPADVCHVIIGIGVNVNMRSSSEVDQLWTSVRLETGGLVDRNQVAARISTQLEALMAVHRKEGFAAFQKEWERGHVWQGAAVKLLSGVEVVEGLVLGVDSLGALRLEVNGVEKSFSGGELSLRLRDDS

SEQ ID NO: 1071 - protein, 371 aa, Brucella suis 1330
MSYNQKQVVDAIRAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVKRGPDVAAFAEEHKLHRVTVADLIAYRQRKETLVRRIGDAPVETCAGKAHAYSYELPWEPMRHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 1072 - protein, 58 aa, Zea mays
  misc_feature (15)..(15): Xaa can be any naturally occurring amino acid
  misc_feature (46)..(46): Xaa can be any naturally occurring amino acid
  unsure (1)..(58): unsure at all Xaa locations
CKCEFLTPKAIANRXIKAKVLQKLRRHCQMCHKQCRDENGFKCHCXMSESHQRKMQVI

SEQ ID NO: 1073 - protein, 303 aa, Anabaena sp.
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGATVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETS

SEQ ID NO: 1074 - protein, 394 aa, Ustilago maydis 521
MAATSSSSSSKMQLFSVDDVAKHNTATDCWLIHRGNVYNVTDFVEDHPGGDDLIIKYAGKDMGEIMDDPQEHSHSDSAYELLDEYIIGRLPATDAEKHALQQRTAQGGYSGKDDSIVITEDFHPEETDFSSDYKAHKFLDLNKPLMPQMLRANFSKQFYLEQVHSPRHLKHPARFFDQDYLEVFTRTPWYVVPMVWLPIASIIFFRSITQFASNLASTPLNATNWYEAATKPTQFDASVWSIAVTQTAICWAIGVVIWTLLEYTIHRFLFHIDNILPDKPAFLTLHFLLHGVHHFLPMDRLRLVMPPLLFLVLSYPFTQLAHTLFPHAIANGIISGSFSMYVVYDCMHYALHHTKLPEYMREMKKYHLEHHYKNFELGFGVTSKVWDYVFGTQL

SEQ ID NO: 1075 - protein, 256 aa, Streptococcus pyogenes MGAS315
MKIGIIGVGKMASAIIKGLKQTPHELIISGSSLERSKEIAEQLTLPYAMSHQDLIDQVDLVILGIKPQLFETVLKSLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 1076 - protein, 288 aa, Legionella pneumophila subsp. pneumophila str. Philadelphia 1
MIHETGTCITIILIYSRRILLFRENGMKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 1077 - protein, 312 aa, Bradyrhizobium japonicum USDA 110
MTTSDSLRDTRIPTHESVTIPAVGFGTLIPDPLVTRQAIRAALEAGFRHLDCAERYRNEAAVGDAMQDAFKAGKLRREELFVTTKLWNTNHRPERVKPAFDASRRRLQLDEIDCYIIHTPFAFQPGDEQDPRDASGRVIYDSGVTLVETWHALERLVDEGHCKSIGLSDITLEKLREIVAVARIRPAMVQVESHPYLPEWDLLDFCREHGIVLQAFAALGHAMEPRVLEDPVITAIARRVQKTPAQVCLAWAVQRGTAFLTTSTNPARIRENFDISALPEDAMREIRDGITTNVRFNAVVETGVPGFIPRAR

SEQ ID NO: 1078 - protein, 508 aa, Sulfolobus solfataricus P2
MWRQAKWNEPLIFELNKSGAARQGFLINKDEEIRSQIKEMKIPKNLLRENEPDLPSLSELEVVRHFVRLSQMNFGVDIGIMPLGSCTMKYNPKIEEKATAITEFHHPLEDEDYIQGILEMIYELQNWFSEITGMDECSLQVPAGSAGEFAGVLMIKKYHEEHNRNYKDTILVADTAHGTNPASAAMAGYKVMYVKSNAEGLVDMDILREIVNDKTAGFMLTNPNTLGLFEENILEISKIIHSTNAVLYYDGANLNGVLGIARPGDMGFDIVHLNLHKTFAVPHGGGGPGAGAICAKGELVNYLPYPMVEKVNGKYKLSKIPKNSIGKIATFYGNVGNLARSFAYILGLGPQGIQMIGKMSTLATNYLIAKLRDVKELELIAPNRHRKHEVVFSVKQLMENYGVSANDVAKALLDNGFYAPTIYFPPIVEEALMIEPTETETKETLDMFAETLKKIVNDAKINPEQVMKSPNNTSIARLDQAYANHPSTITPTYRVLRLRRLGKIDYLK

SEQ ID NO: 1079 - protein, 337 aa, Omphalotus olearius
MVVKVGINGFGRIGRLVIRNALEAQGVEVVAVNDPFIPLDYMVYMFKFDSVHGRYKGTVEAKDGKLIIAGKPIAVFGERDPASIPWGASGADYVVESTGVFTTIDKASAHLKGGAKKVIISAPSADAPMYVCGVNLDAYDPRRPSISNASCTTNCLAPLAKVIHDKFGIVEGLMSTIHATTATQKTVDGPSNKDWRGGRSVNNNIIPSSTGAAKAVGKVIPSLNGKLTGLSFRVPTLDVSVVDLVVRLEKEATYDEIKAAVKEAVAGPLKGILDYTEDALVSTDFTGNTHSSIFDASAGIALNKNFVKLIAWYDNEWGYSRRVVDLITFVAQKDGNA

SEQ ID NO: 1080 - protein, 252 aa, Streptococcus thermophilus CNRZ1066
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAAEFVGAQVSAALAGLTPEQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 1081 - protein, 419 aa, Corynebacterium glutamicum ATCC 13032
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 1082 - protein, 399 aa, Sulfolobus tokodaii str. 7
MKIIRDPIHGYIEVPDDILPVISSPFFQRLRFISQTGLAYMVYPGMRHTRFEHSLGAMHLAKEFLHYISSNSKIDFLTEDYAKLISLSALLHDIGHVAFSHTFESALQVTRDVYKEKIEYYGKETHVKYGLRLISKYSYLIDKIGKNSNISDPVKFMINVIGSNPTNEEEKFALQIISNFVDADRGDYLLRDSYYAGVGYGSYDIERLKRVLVYVDGKIAILKKAIPIVEQFLLARMYMFKNVYFHSVVGMYNAILSHAISKLIRQNKIDLNKIEEITDYKILNMIEETEFKQPILYRSGYKRIKKDLTQECSNVIDKEELMELMRETEGKIIYYEFFDVPYKEENEAIYIYDEGKLSPLSQFSNLITAIRDLKKAIIVYHHSMEDKMRKYYEKLKEAC

SEQ ID NO: 1083 - protein, 212 aa, Shewanella sp. MR-4
ESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSSEFLSLCTIAMSA

SEQ ID NO: 1084 - protein, 272 aa, Xylella fastidiosa Temecula1
MSIYTNSKPWTVPALAEAKRNGSKIVMLTAYDAGFARILDANGVDLILVGDSLGMVVQGHDSTLPVSVHDMVYHTACVARGVRHAMLVVDLPFQADASPERALEAATALLRVGAQMIKIEGAGHKLEVISYLVEREIPVCSHLGLTPQSVLRFGGYKVQGRGEEAGGRLRAEARAAVEAGATLLLLECVPSQLAAQITTDASVPTIGIGAGAGCDGQVLVLHDLLGLDSGHPRPKFVKDFLAHGGSVAGAVRAYANAVRDGSFPDVEHTYTS

SEQ ID NO: 1085 - protein, 430 aa, Magnetospirillum magnetotacticum
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVSQIAGSIGTALLLRHGLGWNLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHPFRELVSRLYGDEARTARRARTLVRRGSWRDDHNAGPGTGI

SEQ ID NO: 1086 - protein, 976 aa, Ralstonia eutropha JMP134
MNAPLPMTATQGNRPTLAELEARDAFAARHIGPDTPEQQHMLKVLGYDSRAALIDAVIPEAIRRRDGMPMGEFTEPLPEEAALAKLRKLAGKNKVLKSFIGQGYYNTLTPAVVLRNIFENPAWYTAYTPYQPEISQGRLEAMLNFQQMVTDLTGLDIANASMLDEGTAAAEAMTLLQRVNKHASNTFYVADDVLPQTLEVVRTRAKPLGIEVKVGPAADAAAAHAFGVLLQYPGVNGDVTDYRAIADAVHAAGGLVVAAADLLALTLITAPGEWGADVAVGNSQRFGVPLGFGGPHAGYMAVKDAFKRSMPGRLVGVTVDAQGNKAYRLALQTREQHIRREKATSNICTAQVLLAVMASMYAVYHGPQGLKRIAQRVHRLTATLAAGLQTLGFTRTNATFFDTLTFETGFNTDAIHAAATARGINLRHAGATRIGVSLDETATRDDVVALWEIFSHGKPLPASLTFDAIEAAAEDAFPANLARTSAYLTHPVFNTHHAEHEMLRYLRMLADKDLALDRTMIPLGSCTMKLNATSEMIPVTWPEFSQIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLEDLAKKAELHSKNLAAIMITYPSTHGVFEQGVQQICEIVHQHGGQVYVDGANMNAMVGTAAPGHFGGDVSHLNLHKTFCIPHGGGGPGVGPVAVGAHLADFLPNQDSVGYRRDDNGIGGVSAAPFGSASILPISWMYIAMMGSAGLTAATENAILTANYVAKRLSPHYPVLYTGQHGLVAHECILDLRPLQKETGISNEDVAKRLMDYGFHAPTMSFPVPGTLMIEPTESEALHELDRFIDAMIAIRKEIGRVEDGSFDRDDNPLKHAPHTAAVVTANEWTRKYTREEAAYPVASLRTQKYWPPVGRADNVYGDRNLFCSCVPMSEYAQD

SEQ ID NO: 1087 - protein, 183 aa, uncultured archaeon GZfos33H6
MTLLENEAKLVRRLCARILEAEGEEEKRKILDLGCGSGKLAIYLSEETGYDVTGVDPSRERIEKAREKSSSVTFEVQPAEETAFADSTFDVVVSLKSWHEMVDAKAALRESMRLLTDGGKIYIIDWVGGVGHTKKYFTMETRAHAKKYFTMERLRQMLSEAGFTDIRIELNIEGELMLAEGQK

SEQ ID NO: 1088 - protein, 957 aa, Shigella flexneri 2a str. 301
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASNVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFSVLLGDNHGLEIDTLDKDVAHDSRSIQPAMLRDDEILTHPVFNRYHSETEMMRYMHSLERKDLALNQAMIPLGSCTMKLNAAAEMIPITWTEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 1089 - protein, 428 aa, Bacillus clausii KSM-K16
MFTTLHEEKVFKDPVHRYIHVRDGLIWELIGTKEFQRLRRIRQLGTTSFTFHGAEHSRFNHSLGVYEITRRMTEIFSGKADWNEDDRLLALAVALLHDIGHGPFSHSFEKVFHTDHEEWTRRIILGDTEVNRILRKMDRCFPQAVADIIEKTSTNKLVSSMISSQIDADRMDYLLRDAYYTGVSYGQFDLERILRVMRPKNDEVVIKASGMHAVEDYIMSRYQMYWQVYFHPVTRSSEVILSKILMRVKDLQERGYDFKQKPLHFLSLFAGEITLEDYLRLDESIVHYYFQSWQEEDDPILKDLCNRFLNRRLFQYIEFHPNERMKDWPKLEALFAKAGVDPSYYLVMDSSSDLPYDVYRPGEEERLPIHLLMPDGSLKELSTHSDVVEAISGKKRTDHKLYYPADVLTDTRVDQEIRDSIQSLLTTI

SEQ ID NO: 1090 - protein, 239 aa, Methanococcus maripaludis S2
MARTKKANDEVATDSDSLKLKVAKQAAKLVKDEMVVGLGSGSTANLFIQELGKRVVEEELYIYGVPTSFDSRMMASNSGIPLISLDQCGEIDIAIDGADEVCKKTLSLIKGGGGCHTMEKIVDYHAKEFVVLADEGKLVESLGDKTAVPLEVIPFAYSTVLNKLLDMNTAPAIRSGSGKMGPVITDNGNMIIDVFINIEDAEETETMLNNIPGVLENGIFSKCDKVLVGTSKKVEILKK

SEQ ID NO: 1091 - protein, 279 aa, Gibberella zeae PH-1
MSSLQILSLLTAATSVVALAGTPNVYANSRRGSCYGEASSDDACCYLSPARLLQTQVWDTRPVSGPLDSWTIHGLWPIHNDGSIPHNCDTNRTYTNITQILYHAGAEDIVEEMNKLWESADGDNEGLWQDQWVAHGTCFSSLNRECYGRNYEEAEEAVPYFQKTVSLFKRLPTYEWLRDAGIIPSYSMLYQLSDIQEALERQHGSRVSLRCAGQRLHEIGYHFNVTGTLQDGYFTDSGAIGHWNDCPDLILYEPKGESKKAIFKFETFHPHTSTDVEDL

SEQ ID NO: 1092 - protein, 363 aa, Chorispora bungeana
GTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMESAYTSSSVDKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 1093 - protein, 394 aa, Rhodobacter sphaeroides 2.4.1
MRALTWHGKHDVRVETHPDPEIVNPRDAIIEVTATAICGSDLHLYDGVIPGLMSGDILGHEFMGRVVETGPKSTLKKGQRVVVPFTISCGQCFFCEHQLFSACDNSNPAEKQDLSEPLYGHAVSGLFGYSHLTGGYPGGQAEYVRVPYSDVGPIVIPDGLEDEQVLFLSDILPTGWMAAENAGIEEGDTVAVWGCGPVGLFAIQSALLMGAGKVIAIDEYPKRLALARRLGAEVIDFRRTKVLEALMEMSGGLGPDAVIDAVGMEAHGFMPDTLMDNMKQRVGIGADSGHALREAILAVRKGGRVSVPGVYGGFLDKFPLGALMEKGLTVKTGQTHVQRYTEELLRRIGEGEIDTTFLISHRLPLEEAARGYENFRFNQNEWTKVVLKPGLTGA

SEQ ID NO: 1094 - protein, 224 aa, Zea mays
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEVILTHPHIKIPNKGKIYSVNEGNARNWDA

SEQ ID NO: 1095 - protein, 131 aa, Glycine max
MALNTSCSKAIVDMLGTHVPKCAIDVSNTPRFSLSQNDKKGCNLGFPKLVQNKGLFPLHAVPSKTMVDLDNLVLQSQEKPKESKTINVKFQLQCNCNYGEQFLVVGNDPMFGSWNPEKAIPMTWSEGHVWT

SEQ ID NO: 1096 - protein, 1548 aa, Aspergillus nidulans FGSC A4
MSNQKRSQESQDFSDTDHEDTSSDRSSLSLQTRKRPRVSDFAEFHRSDHSLAFSDIGGDTARATTSSTVDLEQDEEELELLATQIIQEKYSFGSDEPNAPSEHGILERVECYNFMCHDHFQVELGPLINFIVGKNGSGKSAVLTAITLCLGGKASTTNRGQSLKSFIKEGKESATIIVRIKNQGDGAYLPDDLGKSIIVERHFSKSGASSFKIKADNGRIFSTKRTELDAIIDHFTLQFENPMNVLSQDMARQFLSSSSPAEKYKFFVKGVQLEQLDQDYRLIEEYGDQIEEKIKSKQQDVSVLKNRRDAAERKLEMSDQQENLRERQRKLRRQAAWAQVEEQERIRDSLIAEISSLDSKISEVEAEVARCDAAIREVEAEAITAAQYCREASAKVDNAQNERNDIEARWNEALNERHELQAEQRRIREHVREANARIQQLQHQVDEETRRLADLHGGGYSRKLDELERAKQDAMEVRKQIDELEQNASQLSDDIRAAESQEKAAYQPVAQARRDLEEANSLLHNLNREGSGRNSGFPERMSALLKAIQQNRSFTETPVGPIGNFVTLLKPEWSSILESSFGATLNGFIVTSKRDQSILSEIMHRVNCTSQINNSIRFYEFFRNKFDNELVRRQLVINHGIEQNLLIENLEEASSVLFDGERPRNAKRCFCINKSDRRRGILLSYSRNGEPSQAPVSVYSGSPRMKSDRDSQIRVQREAVANLRQVLNAREEELRSAQSHLTRCRQAFERNERKKNFLVIESQRKDDRIEELEESLQKEGSQDGDLEILQASLREAQEEKLTHEGSLDDAANAMTEMMQNLKRIKKELATKDAEIARLKDELRVAESEQYLIADKRRKRIGEKNAAVELVDDTNRRRARMKQKRDSADADVLEYISKASVISERVEIDEGETPATLDRKLERVTRDMVTYSRELGGSREEIRAEADTAIKAHQQALKQVLKASLNHRISIRQALNQHVLTSQVEPDITKDSSEGRGARTLSGGEKSFSQVCLLLALWEAMGSPIRCLDELKMAIDMLMYAARRSVGRQFILITPGSRAEISLAPDVMVKEYGLTDFIQDKADWRIGHCTLKNLGDWTTADFVYLVDNPKWKEQLKLPAKDGRPQTEDVTATKGLEFEDFYIKRELMMGIFEAGFEKPSPIQEETIPVALTGRDILARAKNGTGKTAAFVIPTLERINPKSTKTQALILVPTRELALQTSHVCKTLGKHLGINVMVTTGGTGLMDDIIRLNDAVHILVGTPGRVLDLASKGVADLSECPTFVMDEADKLLSPEFTPVIEQLLSFHPKDRQVMLFSATFPMIVKSFKINQSIIFCNSTNRVELLAKKITELGYSCFYSHARMLQQHRNRVFHDFRNGVCRNLVCSDLLTRGIDIQAVNVVINFDFPKNAETYLHRIGRSGRFGHLGLAINLINWDDRFNLYKIEQELGTEIQPIPQNIDKKLYVYDSPDTIPRPISNPPQQSQGATAASNPSDRRHNHHTNGGHYQSKGRGPYRGGRGQGQRRNMQNDGTKFNAAQGQTGGKAQPPAQVS

SEQ ID NO: 1097 - protein, 505 aa, Debaryomyces hansenii CBS767
MNWYIIIFIAYFVRRLIILCKNYWLARQWGCEPMQEFGGRFGIISLINVIKARREGFLVDYQKQTYIETDTDTIKSRLFHKQLIHTKNAENVKAVVATQYDDFSIGKRHKFFKPLLGNGIFASEGERWQHSRTMLRPQFARERVAHVQALEPHLQVFAKHVRKSEGGVFNIQILFHKLTIDAATEFLFGESVDSLRDASIGYESLPTDIDGKAGFDDAFNISQNYMMLRALAQDLYFLFDSKEFREANRKIHKFTGHYVHKALETTQEELDAKSRDGYIFLYELVKQTRDPIILQDELLSIMLAGRNTTASLLSFLFFELARNPEIWSKLKREVYEHFGNGDDVKLEKITFESMKKCTYLKWVINETLRMYPSVPQNFRVAKKDTTLPRGGGKDQQSPIFVPKGQFVLYTTYSMHRLEAYYGKDADVYRPERWENLRNIGWAYMPFSSGPRVCLGQQFALTEASYITIRLAQMFPNLESHDSKYPPPKLTNSTMRHLDGVFISLH

SEQ ID NO: 1098 - protein, 478 aa, Escherichia coli
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDMVAFEVAQFVEKPNLETAQAYVASGEYYWNSGMFLFRAGRYLEELKKYRPDILDACEKAMSAVDPDLNFIRVDEEAFLACPEESVDYAVMERTADAVVVPMDAGWSDVGSWSSLWEISAHTAEGNVCHGDVINHKTENSYVYAESGLVTTVGLKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 1099 - protein, 1186 aa, Aspergillus fumigatus
MPFLSTVPRRRRRSEDEDDDEASTNSSRDTTPASRDSINGKRRRLDPVHDGVDEDEDDGEIGDEGSDEGTEQNTPGLTQADSRRTQSSISQTTSLANGEVDDDGYKPGAIVRIKVTDFVTYTSAEFFPGPKLNMVIGPNGTGKSTLVCAICLGLGWGPQHLGRAKDPGEFVKHGCREASIEIELAKGPGLRKNPVISRTIKREGNKSSFTINGKQASLAQVKKFAQSFAIQIDNLCQFLPQDRVSEFAALTPVELLHSTQRAAAGPEMIEWHESLKKLRAEQKKLQLDNQSDKDLLANLENRQEMQRVDVERMRQRAQIKRKIEMLEHLRPVIQYREARNELNQKKTEQRRLRKELEDLEAELAPALRAVNVKQDYCSKLDEVVKYKKRCFEQADRDAMEIVKKIEQFDDALKDLNNQIEAEKKTGQSYRQQATKIQQTINRLNRELNEQPAEFDIGWYNERIVGARFECDQNAKATEIQQARLPLVEELKSKNDQIRRAEQQLQSLASQSGQQEAKLRKASRDSYQAYKWLQDNQDKFEKEVFGPPIVTCSVNDPKYADAVESLLQRTDFTAFTTQTRNDFRTLQRALIIDLRLHDISIRTSTTPLESFRPPVSDEELRTLDFDGWAKDFLSGPEPVLAVLCSENRLHQTPINLQGISDETFATLENGSISSWVAGKQNYQIVRRREYGPGAVSTRVRQVRPAQIWTSQAVDVLGKQEIEREILALKDELSRVKEKMESERSRLHRMGEEKKELDRERATLEKEKAEKQTALINYRAIPEKIHIERLFGEMRVRVLEIRGRQDQISIQKAKANLEYADAQDAVENLRRLQEEATQLSIRLIEGLSDCTTLRERSQHHKMRLDQKSSEVKAAHEDVKTRSEAVRKMVDQANRAIRLVNEQEDLREFMPTLVEYTLEQLEADIDSERAHLELVQGGNANVIKEFEEREKQIDKLRDKVSEFQNQLAEYDHAINEIRGKWEPKLEELVKSISDAFSDSFARIGCAGQVTLDKAEDEEGPNGEPGGSNFDQWSIQIQVKFRENENLSILDSHRQSGGERAVSTIFYLMALQSLSASPFRVVDEINQGMDPRNERMVHGRLVDIACAPARNGGGGQYFLITPKLLSGLVYKPGMRVLCIYSGEHMPEDYNLLNFGGAIKRMRALNAKKKGKARAIEGDAHRNNGDVDVYG

SEQ ID NO: 1100 - protein, 349 aa, Trichodesmium erythraeum IMS101
MIPVILAGGKGERFWPLSRKHRPKQFLSLDGSGKSLLQTTAQRLLPLSNDWGGLWVVTSAMLAAGVAQQLPQIPQENILAEPEGRDTAPAVAWTTIEAAHRYGEDIVVGFFPADHWIGEPEIFHKTLEAAAELATNQEAIVTLGVKPSFPSTGYGYIEQGKKAGNFGGFDVYQVARFTEKPNREKAEEFLATGRFSWNGGIFVFRVGVMLAELRKYVPTMMTVLETMGPGGYSQLEKKSIDYAVMEKTDKAFVLPVAFGWDDLGDWNGLERLVKGDSVNVELANHLGLDTKRSIFFATDDDDTIVTIGLEDVVVVRDGNVTLIVKKERSQDIKKVLKSLANHPKFKDLL

SEQ ID NO: 1101 - protein, 345 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASS

SEQ ID NO: 1102 - protein, 509 aa, Arabidopsis thaliana
MSVLIVTSLGDIVIDLHSDKCPLTCKNFLKLCKIKYYNGCLFHTVQKDFTAQTGDPTGTGAGGDSIYKFLYGEQARFYKDEIHLDLKHSKTGTVAMASGGENLNASQFYFTLRDDLDYLDGKHTVFGQIAEGFDTLTRINEAYVDPKNRPYKNIRIKHTHILDDPFDDPPQLAEMMPDASPEGKPKEEVKDDVRLEDDWVPMDEELGAQELEEVIREKAAHSSAVVLESIGDIPEAEVKPPDNVLFVCKLNPVTEDEDLHTIFSRFGTVVSADVIRDFKTVVVLTESFVSVLEFENKESCEQAYFKMDNALIDDRRIHVDFSQSVSKLWSQFRQKDSQKGKGNGCFKCGSTDHIAKDCVGGPSSKFIVKDQNRQHGGGEGYEMVFEGDVHETPKHNSHERERSEKIQRRSPHGNGEGKRQHRDERDDGRRQHDREDARELERKHRERKERESREDEDRRRRRRREESRDKESRRERDEDDHRSHRDYKERRRERDDRHGREARHERRDR

SEQ ID NO: 1103 - protein, 289 aa, Salmonella enterica subsp. enterica serovar Typhi
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 1104 - protein, 318 aa, Oryza sativa (japonica cultivar-group)
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQVCLRWVYEQGDCLIVKSFDEARMRENLDIVGWELTEEERQRIAGIPQRKINRALRFVSDHGPYKSLDDLWDGEI

SEQ ID NO: 1105 - protein, 353 aa, Aspergillus oryzae
MSTMQAVVFQGPLKVTLEQRPVPQIEEPTDVIVKVRYTALCGSELHVFRGHQPSGTGFIMGHEFTGEIVEVGSAVRGFKVGDLVVSPFTVNCGECFYCARKCSSRCAKGKLYGSVMLDGGQADYARVPSADATLVAAPAAVDEKKLVLMADILPTGFFAARNAFKGMDRATIEESTVLLFGCGPVGLCALISALDYRPKHLIAVDSVPSRLELAKSLGAEPWNFQTDAEGLKQRVKDLTEGRGADVAIEVVGHSDALRMAFDNLRPWGRISSIGVHNGEIPWTGNEAYGKNLQIQMGRCPVRSIFEDALEFLIRKQDSLGFMVGDIRPLSQAIQAYDDFNQMKSQKIIFEAGK

SEQ ID NO: 1106 - protein, 339 aa, Oryza sativa (japonica cultivar-group)
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQARVPEVGVRARGLPDREELRRGADAGEPGHRRMGADGGGEAEDRRHPAAEDQPCPPLRLRPRALQVARRPLGRRDMSTRRRPLRVSRRRPTCVLL

SEQ ID NO: 1107 - protein, 815 aa, Yersinia pestis CO92
MTSPFSYTSPVVSVDALKHSIAYKLMFIIGKDPTIATQHDWLNATLFAVRDRMVERWLRSNRAQLSQDVRQVYYLSMEFLLGRTLSNALLSMGIYDEIEQALDEMGLSLSELLKEENDPGLGNGGLGRLAACFLDSLATLALPGRGYGIRYEYGMFSQKIVNGQQMESPDNWLEYGNAWEFPRHNTRYKVRFGGRIQQEGSKIRWLETEEILACAYDQIIPGFDTDATNTLRLWSAQASNEINLGKFNQGDYFAAVEDKNHSENVSRVLYPDDSTYSGRELRLRQEYFLVSATVQDILNRHWAMHHTFNNLADKIAIHLNDTHPVLSIPEMMRLLIDEHKFTWMDAWDVVQQVFSYTNHTLMSEALETWPVDMIGKILPRHLQIIFDINDHFLKLVEEQYPDDKELLSRVSVIDENNGRRIRMAWLAVIASHKVNGVSALHSELMVQSLFADFARIFPNRFCNKTNGVTPRRWLGLANRPLAAVLDDSIGQTWRTDLSQLSELEKNLDYPSFLLALQKAKLENKKRLAVYIAEKLNIVVNPAALFDVQIKRIHEYKRQLLNVLHVITRYNRIIDAPDNNWVPRVVIFAGKAASAYYNAKQIIHLINDVAKVINNDPRINNLLKVVFIPNYSVSLAQLIIPAADLSEQISLAGTEASGTSNMKFALNGALTIGTLDGANVEIREHVGEENIFIFGNTTEQVEALRKSGYNPRKYYDEDPELHQVLTQIATGTFSPEEPHRYTNLFDSLVNLGDHYQLLADYRSYVDTQEQVDALYRNRDEWSRKTLLNIANMGYFSSDRTIKEYADEIWHIKPIRL

SEQ ID NO: 1108 - protein, 156 aa, Candidatus Kuenenia stuttgartiensis
MEKTLIILKPDAIQRRLLGKIISRFEEKGLQITGMKMMMIPGSLARAHYVSHKGKDFFEPLVSYTTSSPVVVIVVKGKNAIEIARKMMGVTFGSKAEPGTIRGDYAVSNRFNLIHGSDSPSSAEKEIAAFFTKEEIVDYQPIDLSWVYDISEGGMV

SEQ ID NO: 1109 - protein, 271 aa, Zea mays
MEVATATEASAPAASGGAAGQGHPFPWLDAAISEPYYFLHLLAFFSYFAARSAALSADDGGELHDRLLRREIQAVLVFLVLFVVKIVKEETWEAVIADSLLYAKGLLLAVTLVIDWWLAFAYFLGFLVIYAVAQQPPYDGLGHSNHLTPLQLESLLTEEPTSRFWLVEFRTSFSAKCVQASSILPELSIVYSNKNISFGTIDLGHFPNAAAKFGISMWDHLPTYILFDKVTEVSRFPEITSESKVFVPKVTKKLLCQHFDLDRRLIGYLST

SEQ ID NO: 1110 - protein, 337 aa, Chaetomium globosum
MAIKVGINGFGRIGRIVFRNAVEHADVEIVAVNDPFIEPKYAEYMLKYDSTHGVFNGTIAVEGSDLVVNGKKVKFYTERDPAAIPWKDTGAEYIVESTGVFTTTEKAGAHLKGGAKRVIISAPSADAPMYVMGVNEKTYDGSAQVISNASCTTNCLAPLAKVVNDKFGIVEGLMTTVHSYTATQKTVDGPSAKDWRGGRGAAQNIIPSSTGAAKAVGKVIPELNGKLTGMSFRVPTSNVSVVDLTCRLQKEASYDEIKAALKEASEGDLKGILGYTEDEIVSSDLNGNPNSSIFDAKAGISLNKNFVKLVSWYDNEWGYSRRVLDLLAYVAKVDASK

SEQ ID NO: 1111 - protein, 429 aa, Zea mays
  misc_feature (212)..(212): Xaa can be any naturally occurring amino acid
  unsure (1)..(429): unsure at all Xaa locations
MGMFFSKAEPPPPMVLVPPLFDYPPIAARTRMAVPAYELMFGKVSLHNLFEDYFDQAGNMTSRIMLKPLEDPHVDLIATVSAAADRNSGTEVKGDALFRWQRELDDPHTFVDLLVSTSNPLLQLRLCAYHPKYRIGAFGTLPLLMGNRVRSEDYGVMGVRYGSENLSVGASFVPISLSSEVPFGAWLVGRKGSLSAGVQYKPLSECYQAKWXSKYPMPFTELENWNYAISYGVGSTSPLSPSFIFSLELARSTQLTASFYQHLVVQRRVKNPFEDDQVVGITNYIDFGLELAARVDKDKVSGDGNSFQLAGSWQANKNFLLKGKLGPSTSSVALAFKSWWRPSFTFSVTAVNDHSKGTTSYGFGLRVEDLRRASYQRADPNYVMLTPSKEHLAPGVLREYGKRPMFQTQIDSGNYDHLPTELKPLGRIF

SEQ ID NO: 1112 - protein, 802 aa, Bacillus cereus G9241
MFTHVESFKSAFLEKLETMYGKSFKDSTTRDQYNTLGYMVREYMNSQWIATNESYRSGERKQMYYLSIEFLLGRLLGSNILNLGIRDVCEQGLSELGISLQELEEVEADAGLGNGGLGRLAACFLDSLASLDLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAARIHHTIGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEEVLYYYQNGGYRASDYYHHNGHIKKVVDQLTNGFFAQSGAEFEAIYDSLVIQNDEYFVLRDFSPYAEKQEAVGRAYENRTKWLEMSILNIAQSGHFASDRTILQYSNEIWGIGNAVTQI

SEQ ID NO: 1113 - protein, 219 aa, Rubrivivax gelatinosus PM1
MNQDELKTLVGRAALEYVPEGSIVGVGTGSTVNCFIDALAGIKERIAGAVSSSVKSTERLREKGIRVFEAAAVESLPVYIDGADEIDPHGCMIKGGGAALTREKIVADLAERFVCIADASKLVDVLGRFPLPVEVLPMAVSQIQRRFAKLGATATVREGVITDNGQLILDVQGLRIGDPLAFETEVNQWPGVVTVGVFARHKASVCLLGTPEGVKTLRF

SEQ ID NO: 1114 - protein, 531 aa, Thermosynechococcus elongatus BP-1
MASSPVAPVVLVILDGWGYREETYGNAIASAYTPVIDSLWQAYPHTLIHTSGKAVGLPKGQMGNSEVGHLNIGAGRIVPQELVRISDAVEEGSLFSNPVLVRLCQTVKERNGKLHFIGLCSAGGVHSHIDHLYGLVELAKRHGLPACIHVITDGRDTPPRDAAGVLEELEQRLKTSGCGRIVTVSGRYYAMDRDRRWERTEAAYRVMTSNEHIQPLRAVDVARQSYAQDIGDEFIVPTRIAAGAVEPGDGVVFFNFRPDRARQLTQAFIDPNFSGFERALITPLDFVTFTQYDASFNCGVAFPPQNLSHILGEVIAEHGLKQLRAAETEKYAHVTYFFNGGLEEPFPGEDRILIPSPMVTTYDQAPAMSALAVTQAVKKAIEKQEYALVVVNFANSDMVGHTGKLAATIQAIETVDRCVGVLVEAATKVGGTLLITADHGNAEYMIDEDGNPWTAHTTNPVPFILVEGEKRKVPGHGGHVILRKDGCLADIAPTILEILELPQPLEMTGRSLIVSAPYEMRLNRTPVSLKI

SEQ ID NO: 1115 - protein, 228 aa, Malus x domestica
MGITGMIYMVTMVFSLIVLMLSSSAVKFDYFQFTQQYQPAVCNSNPTPCKDPPDKLFTVHGLWPSNVNGSDPKKCKATILNPQTITNLKAQLEIIWPNVLNRRAHVRFWRKQWRKHGACGYPTIADDMHYFSTVIEMYITKKQNVSEILSKAKIKPEGRFRTRDDIVNAISQSIDYKKPKLKCKINNQTTELVEVGLCSDNNLTQFINCPNPFPQGSPYFCPTNNIRY

SEQ ID NO: 1116 - protein, 227 aa, Malus x domestica
MGITGMISMITMVFSLLVLILSSSTVGFDYFQFTQQYQPAVCNFNPTPCKDPTDKLFTVHGLWPSNNVGGDPESCKIRNHRTRAKALEPQLEIIWPNVLDRTNHTAFWRRQWIKHGTCGYPTIQNENDYFETVVKMYITEKQNVSKILSNAKIEPDGIKRTLADLEIAIRSGTDNKKPKFKCQKKRRVTELVEVTLCSDKNRAHFIDCPNPFQPGSPYLCPTNNILY

SEQ ID NO: 1117 - protein, 377 aa, Rhodospirillum rubrum ATCC 11170
MTDGTSPVPYRDYLASPEDIIEDARQGKMFILVDDENRENEGDLVIPAQMATAEVVNFMAKHGRGLICLAMTRERCEQLDLPLMAQQNSSRHSTAFTISIEAKDGVTTGISAADRALTIQVAIDPAKGRGDIATPGHVFPLVARDGGVLVRAGHTEAAVDVARMAGLVPAGVICEVMNDDGTMARMPDLVRFAQEHGLKVGTIADLIAYRRTKERLVRRELETDFRSVHGGDWRMMLYVSTVSYGEHIALVKGDPRGSDPVLVRMHALNVLDDVLGDSDGNAHGQLHRAMDVIGRAGRGVLVLIREGRPTALSERLRARIEQGPSAQRLVDYGVGAQILLDLGVTDMTLLTNTPKHIIGLEGYGLRVAGHQPLSDKE

SEQ ID NO: 1118 - protein, 480 aa, Bordetella bronchiseptica RB50
MPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 1119 - protein, 227 aa, Malus x domestica
MGITRMIYMVTMLFSLLVSILSSSTVGFDYFQFTQQYQPAACNSNPTPCKDPTDKLFTVHGLWPSNKIGRDPEYCKTRNRRKRAKTLEPQLEIIWPNVLDRTNHTGFWRRQWKKHGTCGYPTIQNENDYFETVIKMYITEKQNVSRILSNAKIEPDGQSRPLVDIENAIRNGTHNKKPKFKCQKNNGVTELVEITLCSDKNRAHFIDCPNPFLPGSPYLCPNISIRY

SEQ ID NO: 1120 - protein, 265 aa, Bordetella bronchiseptica RB50
MSAHQARKRFGQHFLTDESVVESIVRAIGPARDDRVVEIGPGLSALTRPLLDRIDHLTAVEIDRDLAARLRRQYPAERLTVVEADALTVDFAQFGQGLRVVGNLPYNISSPLLFHLMGAAEQVRDQHFMLQREVIDRMVAEPGSGDYSRLSVMLQARYRMEKLFDVAPEAFDPPPRVVSAVVRMAPLPADRLRPASDAAFETVVARAFSQRRKMLRRVLGDWAALTPWDELGIAPTARAEEVGVAQFIGLADALLAAGAPGLARP

SEQ ID NO: 1121 - protein, 662 aa, Trichophyton rubrum
MVSFCGVAACLLTVAGHLAQAQFPPKPEGVTVLESKFGSGARITYKEPGLCETTEGVKSYAGYVHLPPGTLRDFGVEQDYPINTFFWFFEARKDPENAPLGIWMNGGPGSSSMFGMMTENGPCFVNADSNSTRLNPHSWNNEVNMLYIDQPVQVGLSYDTLANFTRNLVTDEITKLKPGEPIPEQNATFLVGTYASRNMNTTAHGTRHAAMALWHFAQVWFQEFPGYHPRNNKISIATESYGGRYGPAFTAFFEEQNQKIKNGTWKGHEGTMHVLHLDTLMIVNGCIDRLVQWPAYPQMAYNNTYSIEAVNASIHAGMLDALYRDGGCRDKINHCRSLSSVFDPENLGINSTVNDVCKDAETFCSNDVRDPYLKFSGRNYYDIGQLDPSPFPAPFYMAWLNQPHVQAALGVPLNWTQSNDVVSTAFRAIGDYPRPGWLENLAYLLENGIKVSLVYGDRDYACNWFGGELSSLGINYTDTHEFHNAGYAGIQINSSYIGGQVRQYGNLSFARVYEAGHEVPSYQPETALQIFHRSLFNKDIATGTKDTSSRMDGGKFYGTSGPADSFGFKNKPPPQHVHFCHILDTSTCTKEQIQSVENGTAAVRSWIIVDSNSTSLFPEVVGSGEPTPTPMPGGATTLSAHGFLYGVTLWAVIVVAVIELAM

SEQ ID NO: 1122 - protein, 212 aa, Zea mays
  misc_feature (86)..(86): Xaa can be any naturally occurring amino acid
  misc_feature (180)..(180): Xaa can be any naturally occurring amino acid
  unsure (1)..(212): unsure at all Xaa locations
MAPSIAPPSSPSCLRGKLFPRFTGTNSQPMNSVLRCDISVSPTLASNSLRRTSSVHLANNNRIKSFHVCHAGVDPSERIVVNGQVXSSKTVQADAAALGTISADMAPVVDGFSADDDELDLDLPTEGFSSIPEAIEDIRQGKYVIVVDDEDRENEGDLIMAASTVTPEAMAFIVRHGTGXIVCVSMKEDDLERLQLSLMVVGKENEEKLPTA

SEQ ID NO: 1123 - protein, 227 aa, Pyrus x bretschneideri
MGITRMIYMVTMVFSLLVLILSSSTVGFDYFQFTQQYQPAACNSNPTPCKDPPDKLFTVHGLWPSNKIGRDPEYCRTRNRRKRAKKLEPQLEIIWPNVLDRTNHTGFWRRQWKKHGTCGYPTIQNENDYFETVIKMYITEKQNVSRILSNAKIEPDGQSRPLVDIENAIRNGTHNKKPKFKCQKNNGVTELVEITLCSDKNRAHFIDCPNPFLPGSPYLCPNISVQY

SEQ ID NO: 1124 - protein, 652 aa, Trichophyton rubrum
MRFAASIAVALPVIHAASAQGFPPPVKGVTVVKSKFDENVKITYKENDICETTQGVRSFTGHVHLPPDNDDFGVYRNYSINTFFWFFEAREDPKNAPLSIWLNGGPGSSSMIGLFQENGPCWVNEDSKSTTNNSFSWNNKVNMLYIDQPNQVGFSYDVPTNITYSTINDTISVADFSNGVPAQNLSTLVGTGSSQNPWATANNTVNAARSIWHFAQVWFQEFPEHKPNNNKISIWTESYGGRYGPSFASYFQEQNEKIKNHTITEEGEMHILNLDTLGIINGCIDLMFQAESYAEFPYNNTYGIKAYTKEKRDAILHDIHRPDGCFDKVTKCREAAKEGDPHFYSNNATVNTICADANSACDKYLMDPFQETNLGYYDIAHPLQDPFPPPFYKGFLSQSSVLSDMGSPVNFSQYAQAVGKSFHGVGDYARPDVRGFTGDIAYLLESGVKVALVYGDRDYICNWFGGEQVSLGLNYTGTQDFHRAKYADVKVNSSYVGGVVRQHGNFSFTRVFEAGHEVPGYQPETALKIFERIMFNKDISTGEIDIAQKPDYGTTGTESTFHIKNDIPPSPEPTCYLLSADGTCTPEQLNAIKDGTAVVENYIIKSPAASKGNPPPTTTSSPTAAPTAGSAMLKAPVAMLAISALTVLAFFL

SEQ ID NO: 1125 - protein, 658 aa, Pseudoalteromonas tunicata D2
MVLQGIFTEIFSLLAIAVVLVWLFKRLNLPPVLAYLAVGVLVGPHALGWISEYQEIHLVAEFGIVFLLFSLGLEFSIPKLMAMRHIVFGLGSAQVVATSCIIIAIVMVYNPHFATAFSIGTLLALSSTAIVVKQLSESGELHTRRGQLAIGILLFQDIAVVPLLIILPLLSGEGEHHLVWALSIALTKGAFVCMLLWAVGKWVLPRLFNEVAQLRTDELFVLTTLLVTLFASGLTHFFGLSMALGAFLAGIMLGESQYRHQLEADIRPFRDILMGLFFVTVGMQLDMSFVWFNAYWILLAVCGLILIKALLIKQLAHFMGETAKDAWATGLMLCQMGEFGFVLIALALQHQLIESSYASLLISIGVISMAMTPYLIDKNQQLAKKLSRGEKSEQDKTAAPNFSTNLTNHVVICGFGRVGQTVARFLKAEAIPYIALDIDPIRVREAQAAGENVQFGHVRQKDILKAAKVDKSRLVIISFADYAKAMSVVSVVRQLSDSVKILVRMRDDQHLIELKNAGVTEVVPESLEASLMLVSHVLFMSGVPVKRILRRVQQERKNRYGILHGYFPGENTDLSAESIGRLEYMHAIAITDDAFAVNKTLGELKLSKRRVEVMGLRRNDNEIDHPTEETLIQAQDILIIRGKPRQVERTERYLLEGD

SEQ ID NO: 1126 - protein, 458 aa, Zea mays
MALTTASTVSSPSRIIRRFSSSQDSRPPSSLLHLAPRRGPGNSPRACSWHRLVVRRMGWAARALLGGLSDAGASESDEEEEHVLRVGQREGEIDDAVELSAAAVGPERWDVLGLGQAMVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 1127 - protein, 326 aa, Candida albicans SC5314
MAKAPKKKFSTASNPTANKVAAEKHLNSVFKFNTNLGQHILKNPLVAQGIVDKAQIKPSDIVLEVGPGTGNLTVRILEKARKVIAVEMDPRMAAELTKRVHGTPQEKKLEILLGDFMKTDLPYFDICISNTPYQISSPLVFKLLNQPRPPRVSILMFQREFAQRLVARPGEELYCRLSANVQMWANVTHIMKVGKNNFRPPPQVESSVVRIEIKNPRPNIDFNEWDGLLRIVFVRKNKTIAAGFKSSNVIEILEKNYKTFLATQESNNNDSMMVDDKSISLKDVVKNKITTVLTETGFSDKRAGKLDQTDFLKLLYAFHQVGIHFA

SEQ ID NO: 1128 - protein, 483 aa, Bacillus cereus ATCC 10987
MCKKNHFYSGKSGFFLYIRAINIVFHFFLFPISFIIYSKNAVKKGGCRKVVYLNDKLSETKVFKDPVHKYVHVRDRVIWDLIGTKEFQRLRRIKQLGTTFFTFHGAEHSRFTHSLGVYEIIRRMIDDVFDGRPNWNAEDRLLCLCAALLHDVGHGPFSHSFEKVFSLDHEKFTQKIIVGDTEINRVLSRVDKDFPQKVADVIAKTSTNKLAISMISSQIDADRMDYLLRDAYFTGVKYGNFDMERILRVMRPYGNQVVIKNSGMHAVEHYIMSRYQMYWQVYFHPVTRSAEVILTKILHRAKSLHEKYYTFKNHPVHFYSLFEEEVTVEDYLKLDENVMYYYFQVWQDEEDPILSDLCRRFMNRNLFKYVEFTDKHGLDNWMELSSLFKKIGLDPEYYLVVDSTSDLPYDFYRAGEEEERLPILLLMPNGELRELSRESDIVEAITGKKRRDQKLFYPHDLIYEDGRKGKYKERIIELLEGKK

SEQ ID NO: 1129 - protein, 400 aa, Agrobacterium tumefaciens str. C58
MAFLADILSRVKPSATIAVTQKARELKAKGRDVISLGAGEPDFDTPDNIKEAAIDAIKRGETKYTPVSGIPELRKAIADKFKRENGLDYKPEQTIVGTGGKQILFNAFMATLNPGDEVVIPAPYWVSYPEMVAICGGTPVFVNATLEDNFKLKPEALEKAITPKTKWFVFNSPSNPSGAAYSHDELKALTDVLVKHPHVWVLTDDMYEHLTYGDFKFVTPVEVEPSLYDRTLTMNGVSKAYAMTGWRIGYAAGPLPLIKAMDMIQGQQTSGASSIAQWAAVEALNGTQDFIPENKKIFEGRRDLVVSMLNQAKGISCPSPEGAFYVYPSCAGLIGKTAPSGKVIETDTDFVSELLEAEGVAVVQGSAFGLGPNFRISYATSETLLEEACKRIQRFCADCR

SEQ ID NO: 1130 - protein, 124 aa, Brassica napus
MKKVTSAAAKTLVKDEWVAAAMTDDEMVVELLIRLKHAGTVVSEDPSTNLPPLRWGVRQRRSRSSRFGVNGGVVSLKKDVDSARGSPKTPLSWSGGGSASPSADGFEDTSLQASCSTSTGSGSK

SEQ ID NO: 1131 - protein, 325 aa, Zea mays
MMLTRASMGVMDAAAVDEVVRRLVEGGRGGRQVQMSEAEIRQLCVEAKQVLLSQPNLLRIHAPVKICGDIHGQFVDLLRLFDLGGYPPTSTYIFLGDYVDRGKQSLETICLLLAYKLKYPDNIYLLRGNHEDAKINRVYGFYDECKRRFNVRLWKIFCDCFNCLPMAALIDDKILCMHGGLSPELTSLDQIKDIERPTEIPDYGLLCDLLWSDPSHDTEGWGESDRGVSCTFGADKLVEFLEKNDLDLVCRAHQVVEDGYEFFAERRLVTIFSAPNYCGEFDNAGALLSIDESLMCSFQILKPNETGAPHSRKPLPSKAPKGENV

SEQ ID NO: 1132 - protein, 338 aa, Aspergillus oryzae
MATPKVGINGFGRIGRIVCSYSIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 1133 - protein, 555 aa, Arabidopsis thaliana
MAGLVLSNDTEAKISGDCKRGGCITFPFMIATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHYMANVAVFYGEFPESMRNTATSVTSVAFGISFYLSTALINLIQRTTAWLPDDINHGRVDNVYWVLVIGGVLNLGYFFVCSWYFTYRKIQDDNRQDPKDVTN

SEQ ID NO: 1134 - protein, 446 aa, Methanococcus maripaludis S2
MNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 1135 - protein, 270 aa, Streptomyces violaceusniger
MTSPSAVPPGDTVSDYYSSLGPLLQMAWDDNFHFGYWDGPSDTSSVQEATDRFTDLLIERLRVGPGDRVLDVGCGIGKPAMRVATSTGADVLGITISELQVKQAAESARLAGLSDRVAFQYADAMAMPFEGAAFDAVLAFESINHMDRPTALREMARVLRPGGRLVLTDVTPPSDGSYRPDGDPGVVTSLTRLEDWPRLVDEAGLVLDELTDVTENTKDTANRMIDGILRCRREFEARHGVSVQEVLDAAKSALPTVPSAGCAIVVAHKS

SEQ ID NO: 1136 - protein, 513 aa, Francisella tularensis subsp. holarctica
MKTIMIKTTSSSGEDYYKNIFSAICDKDGFMTKTDILDILVESGISNDDPRITKLIAKLNKFCDIDKIDFDTFQEITFENIGLIEKAINKGFIIPNFKDFKKEIEAIYNETKKNETGRNANYIPQLARVDPNLFAVAFCSVDGQIITLGDYLQPYCVQSTAKTITYCIATEENGEDKVHQHVGREPSGITFNAIALNKYDLPHNPMINSGAIMMCSLIKPEWNIADRFEYITNVWQDLAGGEPIGFDNAVYHSEKETADRNYALAHFMKEVGAFPEGTNIHTALDFYFQTCSIQVNAKKMAKIMASIANGGVCPFTSKKIFSPTTIRNCLSMMYSCGMYDFSGEYAFSVGLPAKSGVSGALAIAIPNVGGFAIFSPRLDPNHNSVRGVEFSKRLIEKFSFHNYDHITHCDKINPVENRMVVESNLTFELIWAASAGDLSEIKRAVALGVDINKGDYDKRTALHLAAAEGHEDIVKYLIRKGADINAIDRWGKKPLDDAIMNNNISIIELLDRT

SEQ ID NO: 1137 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 1138 - protein, 974 aa, Ralstonia metallidurans CH34
MNAPLPMNAAAQGARPTLAELEARDAFAARHIGPDSAEQQHMLKVLGFESRAALIDAVVPAAIRRRDGMSLGEFTAPLTEEAALGRLRALAGKNRVLKSFIGQGYYNTLTPGVILRNIFENPAWYTAYTPYQPEISQGRLEAMLNFQQMITDLTGLDIANASMLDEGTAAAEAMTLLQRVNKHASNTFYVAEDVLPQTLEVVRTRALPLGIEVKVGPAADAAQAHAFGVLLQYPGVNGDVADYRAIAEAVHASGGRVVAAADLLALTLIAAPGEWGADVTVGNSQRFGVPLGFGGPHAGYMAVKDEFKRSMPGRLVGVTIDAQGNKAYRLALQTREQHIRREKATSNICTAQVLLAVMASMYAVYHGPQGLKRIAQRVHRLTATLAAGLKTLGHTPLNATFFDTLTLETGFNTDAFHASATARGINLRHVDATRIGISFDETASRDDVIALWEIFAHGKAVPDFDTIEASVQDGFPATLARQSAYLTHPVFNTHHAEHEMLRYLRALADKDLALDRTMIPLGSCTMKLNATSEMIPVTWPEFSNIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLADLAKKAEQHSKNLAAIMITYPSTHGVFEQGVQQICDIVHKHGGQVYVDGANMNAMVGVAAPGQFGGDVSHLNLHKTFCIPHGGGGPGVGPVAVGAHLADFLPNQDSVGYRRDENGIGGVSAAPFGSASILPISWMYIAMMGSAGLTAATENAILTANYVARRLSPHFPVLYTGQHGLVAHECILDLRPLQKATGISNEDVAKRLMDYGFHAPTMSFPVPGTLMIEPTESEALHELDRFIDAMIAIRGEIARVEDGSFDREDNPLKHAPHTAAVVVSDKWNHKYTREEAAYPVASLRTQKYWPPVGRADNVYGDRNLFCSCVPLSEYAED

SEQ ID NO: 1139 - protein, 357 aa, Euglena gracilis
MDYYTVAHIDEPCSQPWYKSRVAAFFGGCLLATCMSLRFKGTVQENYAVGTKPAVHSLPLAALGTWGRSQVPQNPPQNGFNNFGRRSSALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 1140 - protein, 430 aa, Desulfitobacterium hafniense DCB-2
MKTFRDPVHNIVSIDKQSEKVLLDLIDTREFQRLRHTRQLGLSSFTYPGAEHTRFIHSLGVVHLTKRFIDKISTLKNIDQKYIDELHDNRMLALVTALLHDIGHGPFSHALEKTTKIKHESWTIEIITGDTEVKKILEYHRSGFSHEVAEVIRRTHKSKAIVKLLSSQLDTDRIDYLIRDSKFTGAGYGAFDLEWLINCLRIGEVNGDTEFGLDLNKGLSIAEDFVMARYYMYVNVYFHRATRSAELIMDKIFQRAIELNNLGKIDLPEDLAEIIIKSSTSKTLTNYLNLSENTIWHYIVLWSKHEDNIMSDLCTRLLNRKLFKEIQIEGNLIDFTEKVINSLKEHGLPREYYLLTDEATSSSYKDHYITQKPKSEGSENEKEASEQIFLFDKSGNGIELSNKSKIINQIRNEGIKIDRMFIPEQIRRLF

SEQ ID NO: 1141 - protein, 465 aa, Caulobacter crescentus CB15
MKPKHNKAKRDQILDRGVSTIEEAKDWFARQHIEEIECVVPDLAGVARGKIMPVRKFLGSPSMNLPLAVFYQTITGDFPEFEGAVNAVQSDTDIFLTPDFATLAAVPWAQDPTAQVIHDAFHPDGRPVEEAPRQVLRRVLALYADKGWHPIVAPEIEFYLVDRNTDPDYPLKPPIGRSGRPETGRQGYSISAVNEFDALFEDMYEYSERQGLEIDTLIHESGVAQMEINLQHGHPLELADQVFMMKRTIREAALEHEIYATFMAKPMANEPGSAMHIHQSIVDKKGRNLFSDEDGAESAMFHGFIAGQQTYLPAIMAILAPYVNSYRRISRDSGAPVNTQWGYDNRTCGLRVPPSGPNNRRVENRIPSSDANPYLAIAASLAAGYLGMVQGLKPSEPVSIDAGARGIELPRSLSDSLRLFVACQPLVEILGPTFCAAYDRVKQAEYETFMRTISPWEREFLLLNV

SEQ ID NO: 1142 - protein, 379 aa, Xanthomonas campestris pv. vesicatoria str. 85-10
MNFAPVPELIEELRAGRMVVIVDDEDRENEGDLIMAAELVKPSDINFMVTHARGLVCLSLTRERCAQLGLAPMVRNNTAQFQTNFTVSIEAAEGVTTGISAYDRAHTVRTAVRPDARPQDLSQPGHIFPLISQPGGVLTRAGHTEAASDLPMLAGLEPAGVLVEVLNPDGSMARRPQLEVFAREHGLKMGSIADLIAYRLANEHTVERVDERQITTEFGPFKLVTYRDRIAHDLHFALVRGRADPQTPTLVRVQVENPLADLLHWQRDDFGVAATDALRAIAAEGQGVMVVLSAPRDSESLLARLRQQPEAAANAKDVSQWRRNGAGAQILADLGLGKLRVLGTPRRQVGLAGFGLEVVEYLECHPGEGVRSVPPSAVP

SEQ ID NO: 1143 - protein, 356 aa, Pisum sativum
GLTIRAGSYADELVKTAKTIASPGRGILAMDESNATCGKRLASIGLENTEVNRQAWRTLLVTVPTLGEYISGAILFEETLYQSTTDGRKIVDVLIEQNIIPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYYGDGESEEAKKELFVKGYSY

SEQ ID NO: 1144 - protein, 340 aa, Bacillus subtilis subsp. subtilis str. 168
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 1145 - protein, 549 aa, Zea mays
MLPLSRCSLPTSSNPGPGPSLGFLLHVHTMICYVLWLAACCLLLLLYSVRFRSRISHGNGPRTYPLIGCLVSFYQNRWRLLDWYTEMLAASPTQTIVVDRLGARRTVVTANPVNVEHILKGNFGNYPKGKPFTDILGDLLGTGIFNVDGELWYAQRKLVSHEFSARALRDLEFAVLEDEARERLVPALGLAAARGDAVDMQDLLRRFSFDVICRVSLGVDPGCLDPALPAPRLAAAFDAAAGIIARRGAAPVAAVWKAKRALGVGSERLLREEIRVIHEAVMDLIRIRKKERGLQVNDADGRRSDLLSRMIECGYPDEMIRDMVISFIMAGRDTTSSALTWFFWLLTRHRDVEREVLREVTGGGGASHAAGGQGKMSVLHAALCETMRLYPPVAWDSKHAAAGDVLPDGTRVERGDRVTYFQYGMGRMESIWGANAADFSVQRWLSIGEDNAPPAAVAGVSPFKYPVFQAGPRTCLGKEMAFVQMKFVASTVLRRFEIVPVDEGRVPVFLPLMTAHMAGGLNVTVRRRGDPEPIAAAATPLDPSADPVL

SEQ ID NO: 1146 - protein, 536 aa, Trichophyton rubrum
MKFFTTGLLATAALAAAQEQQVLQAEDGMGRAPLPDSSIFDETLQKFQSSLEDGISHFWSEMKTNFKDYLPLISLPKKHTRRPDSEWDHVVRGADIESVWVQGADGEKRREIDGKLHNYDLRVKAVDPGVKQYSGYLDDNDADKHLFYWFFESRNDPKNDPVVLWLNGGPGCSSLTGLFLELGPATIDKNLKVVSNPYSWNSNASVIFLDQPVNVGFSYSGSSVSDTVAAGKDVYALLTLFFKQFPEYATQDFHISGESYAGHYIPVFAAEILSHKNTNINLKSALIGNGLTDPLTQYPQYRPMACGEGGYPAVLDQGTCRSMDNSLERCLSLIETCYSSESAWVCVPAAMYCNSAILAPYQQTGMNPYDVRTKCEDMASLCYPQLNAITEWLNQKPVMQALGVEVESYESCNSGINRDFLFHGDWMKPYHRLVPSVLEKIPVLIYAGDADFICNWLGNKAWTEALEWPGHKKFAETKLEDLKIVDNKNKGKKIGQVKSSGNFTFMRIFGAGHMVPLNQPEASLEFLNRWLRGEWH

SEQ ID NO: 1147 - protein, 467 aa, Xylella fastidiosa Temecula1
MNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDETAFQTAVHVAAAAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 1148 - protein, 132 aa, Aspergillus nidulans FGSC A4
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKAGKGSQEL

SEQ ID NO: 1149 - protein, 998 aa, Coprinellus disseminatus
MLRLRCVQRFPRLHNKRAAPLARGLASLKQPSSIFSPLDTFQERHIGPDDAEATTMLSNLGYDSMDAFIADTVPPKIRISPSTVSNESIPALSESELQANAKALGAQNKPFKSYIGMGYHNAVVPPVILRNVMENPSWYTQYTPYQPEIAQGRLESLINFQAMVMSLTSMDIANASLLDEATAAAEGMVMAHTSAPKKKTFIVDSGVAPQTLAVIRSRAKGFDVKIVVGDVSALVEDSSLIADVCGVLVQYPDVDGNIKDWAALAEQTHKIGGLVVAATDLLALTKLKAPGEWGADVVVGNSARFGVPAGYGGPHAAFFAVTDKLKRKMPGRLIGLSRDAQGKPAYRLALQTREQHIRREKATSNICTAQALLANMATMYAVYHGPEGLKRISNKVHGFTQVFKSSVESLGFKAINTTFFDTLTLDVTGAVANSWAVHASANAAAINLRRIDDKHVGVTFDESVTPAELVDLINVFATAANKSPFALSDLAESTESAISPHLKRTSKFLPHAVFNKHHSETEMLRYINHLSSKDLSLTHSMIALGSCTMKLNSTSSMVPLTWPEFSNVHPFAPQDQVEGYRTIIKELEEYLCKITGFHSASLQPNSGAAGEYAGLCVIRAFHESRGEGHRDICLIPLSAHGTNPASAHLAGLKVVPVKVHNDGNLDLADLKAKAEKHKDNLAAFMITYPSTFGVFESGVQDACQIIHGKGGQVYLDGANLNAQVGLTSPATCGGDVCHLNLHKTFAIPHGGGGPGVGPICVAEHLAPFLPGHTALPVQGESAINAVAAAPFGSASILLISWAYIKMLGGKGLADSSKLALLNANYMAHKLAPYYTLRYKNENGRVAHELLIDLAEFDKAAGLKVTDFAKRLQDYGFHPPTCSWPISTCMLIEPTESETLEELDRFCEAMIQIRKEADDVIAGKQPKENNLLKNAPHPISVISLSEDRWNRPYSRETAAFPLPWLKEKKFWPTVGRLDDAYGDLNLVCDCPSVEEVASN

SEQ ID NO: 1150 - protein, 157 aa, Triticum aestivum
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAATKEPKAGTTKSPRKSPAKKAADA

SEQ ID NO: 1151 - protein, 141 aa, Bordetella bronchiseptica RB50
MSIERTLSIIKPDAVAKNVVGQIVARFEQAGLKVIAARMQQLSRTDAERFYAVHKERPFFKDLVDFMVSGPVFVQVLEGESAIQKNRDLMGATDPKKAAPGTIRADFADSIDANAVHGSDAPETAAVEVAFFFPEINIHSR

SEQ ID NO: 1152 - protein, 172 aa, Triticum aestivum
  misc_feature (80)..(80): Xaa can be any naturally occurring amino acid
  misc_feature (91)..(91): Xaa can be any naturally occurring amino acid
  misc_feature (93)..(93): Xaa can be any naturally occurring amino acid
  misc_feature (100)..(100): Xaa can be any naturally occurring amino acid
  misc_feature (102)..(103): Xaa can be any naturally occurring amino acid
  misc_feature (109)..(109): Xaa can be any naturally occurring amino acid
  misc_feature (118)..(118): Xaa can be any naturally occurring amino acid
  misc_feature (127)..(127): Xaa can be any naturally occurring amino acid
  misc_feature (129)..(129): Xaa can be any naturally occurring amino acid
  misc_feature (137)..(137): Xaa can be any naturally occurring amino acid
  misc_feature (139)..(139): Xaa can be any naturally occurring amino acid
  unsure (1)..(172): unsure at all Xaa locations
MAPTVMASSATSVAPFQGLKSTAGLPVSRRSNGASLGSVSNGGRIRCMQVWPIEGIKKFETLSYLPPLSTEALLKQVGLXLIRPKWVPFLXFXQVRFIFXFXXASPGYXTAANWTCWXLLISGATDXPXVNKLEESXRXYPDPYSASQKQQLMPKPPAQGSGRLTVYTGLRH

SEQ ID NO: 1153 - protein, 371 aa, Acinetobacter calcoaceticus
MSELKDIIAAVTPCKGADFELQALKIRQPQGDEVLVKVVATGMCHTDLIVRDQYYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSLVTWGAGAVGLSALLAAKVCGASIIIAVDIVESRLELAKQLGATHVINSKTQDPVAAIKEITDGGVNFALESTGRPEILKQGVDALGILGKIAVVGAPQLGTTAQFDVNDLLLGGKTILGVVEGSGSPKKFIPELVRLYQQGKFPFDQLVKFYAFDEINQAAIDSHKGITLKPIIKIA

SEQ ID NO: 1154 - protein, 214 aa, Desulfotalea psychrophila LSv54
MGQSLLSSFGDAQQRVEKSLQALRQGEGVLLVDDEDRENEGDLIYSAEHLTAKQMALMIREGSGIVCLCLTGEKVDELKLPQMVTNNNSRHGTGFTISIEARDGVTTGVSAADRTQTVKAAIAEGAVAEDLCQPGHVFPLRARDNGVLDRRGHTEGTVDLMKLSGLAPAGLLCELTNVDGTMARLPEIVDFARKRDMQVLSIEDIAQYRQGHNL

SEQ ID NO: 1155 - protein, 409 aa, Bacteroides thetaiotaomicron VPI-5482
MPYERKIINDPVFGFINIPKGLLYDIVRHPLLQRLTRIKQVGLSSVVYPGAQHTRFQHSLGAFYLMSEAITQLTSKGNFIFDSEAEAVQAAILLHDIGHGPFSHVLEDTIVQGVSHEEISLMLMERMNKEMNGQLSLAIQIFKDEYPKRFLHQLVSGQLDMDRLDYLRRDSFYTGVTEGNIGSARIIKMLDVADDRLVIESKGIYSIENFLTARRLMYWQVYLHKTSVAYERMLISTLLRAKELASQGVELFASPALHFFLYNDINHTEFHNNPDCLENFIQLDDNDIWTALKVWSNHPDKVLSTLSLGMINRNIFKVENSAEPIGEDRIKELTLQISQQLGITLSEANYFVSTPSIEKNMYDPADDSIDIIYKDGTIKNIAEASDMLNISLLSKKVKKYYLCYQRLHR

SEQ ID NO: 1156 - protein, 393 aa, Saccharum hybrid cultivar SP-80-3280
MSLSLKRKDLMIVNMGPQHPSMHGVLRLIVTLDGEDVIDCEPILGYLHRGMEKIAENRSIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWMDKCLDFCDYFLQGVVEYQQLITQNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 1157 - protein, 124 aa, Oryza sativa
MCSMAAAFGFGALFSIVSGMGTPNPVANAITTGAAFAIFQGGFFMIGQKFSKPQREDLYYSRARSMLQKLGLEKYEKNFKKGFLPDQNLPFLTASVLRDVKIPPGPRVLILDQIKRDPEFGKAG

SEQ ID NO: 1158 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNAIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 1159 - protein, 452 aa, Bacillus clausii KSM-K16
MTTQAPTRESLIETIRETIEKKNVELLHMQFVDLEGMLKHVTITAEQLDQAVNGKTMFDGSSITGFTPINQSDLYLSPDLTTFAVLPWTEEEGYSEARFLCSVKNPDGSDFEGDPRNILKKTVKRAADKGYSISVGPELEFFLFDTDEHGEPTMRTQDAGGYFEPSPKDDGEKVRLAIYKALRMMGFTIEASHHEVAVGQHEINFKYSDALGSADAATTYKWVVKTVAKQFGLHATFMPKPLGGANGNGMHVNMSLFDIEKQENSFYNEDDKNALSKTAYHFIAGLLDNVKDFVAITNPLVNSYKRLVPGYEAPCYIAWSASNRSALVRIPATRGPGTRVEIRCPDPSANPYLAFAVIASAGLDGVENEIECPASVDADIFSMSSAEIKERAIENLPTSLEDAINRFETGAIGRKTLGDHAFEEYIELKRSEWDDFRTSVHPWEVASYQSKF

SEQ ID NO: 1160 - protein, 584 aa, Aspergillus oryzae
MSPHAVHTVPSGENNWWKEATVYQVYPASFKDSNGDGWGDIPGLISKVPYLHSLGVDVVWLSPMYDSPMHDMGYDVSDYENVLPAYGTVEDVERLIDACHERGMKLILDLVINHTSDQHKWFQESRSSKDNDKRDWYFWRPPRYDEQGNRLPPTNYRGYFAGSTWTWDEHTQEYYLHLYAKEQPDLNWDNEATRKAIYDSAVRFWLDKGVDGFRVDTVNKYSKHTDFPDAPVTDPKSYIQPAIQMWCNGPRIHEFLREMYDDALQPYGDVVTIGELANTPDPEHVLKYVGASAKQLSMVFHLDIGHIGMGKSLEDKYIFNPWQLTEMKSIVTKWQSFIEGTDGWTTAFCENHDNGRSVSRFASDAPEHRERSAKMLALMMMAMTGTLFLYQGQEIGMINAPRDWSVEEYKDIEGRGYYQEAERQVAAGVDPTRKDRIMDGLRILARDHARLPMQWDDSSHAGFTTGTPWMRAHDLYPEINVQKQADDPESVLSFWRSVLRLRKEYRELFIHGAFEVVDFDNQQTFCFFKSRDEKKALVALNFTAENQPFTQATTTEGMKLLVSNYAELLPETLRPFEGRIYISQ

SEQ ID NO: 1161 - protein, 241 aa, Anabaena variabilis ATCC 29413
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNPDVPIQYGGSVKPNNIDEIMAQPEIDGVLVGGASLEAASFARIVNYQ

SEQ ID NO: 1162 - protein, 522 aa, Zea mays
MEPFFLFVGLALVLCFLTPYYRHLQSKKTSPLEPTEWPIVGHLPGLVANIHHFHDWATGVLAGVGYNFEARAGRTGVRYFITCDPSNVRHIFTSNFANYPKGEEYAAIFDVLGGGIFNADGESWRRQRVKAQMLMTGPRFRAFTARCSRDKVERSLLPFLAHHAADDGRTPPCDLHDVFLRLTFDMTCTLVFGVDPGCLAFGLPVVPFARAMDDALETLFLRHIIPMACWKLMHVLEVGQERKMAAARRTIDSFVAATVAKRRADKLKGCECCVSNSYDLLSSFICHEEDGSSENDDDVFLRDTTVNLLLAGRDTTGAALSWFFYLVSKNPRVEQKILDELTPIAASRRTKGAEDAAHAASGMVTFDADELGSLVYLHAALSECLRLYPSVPFEHKVADKVLVFNYSMGRMEGVWGKDCMEFRPERWLNVEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 1163 - protein, 964 aa, Gibberella zeae PH-1
MSAFKSFPAVRGEGGLSRRRDSSALSTLPETEPPVRRQSLAARSDSQVKGAGTSLDLPSSRLSTTQPSLSGSQNAKETKDKRPSFKSISPSPPPNAGLDPLSTQIYLRTNSNTAEPTIAQRLRSQGRSESDNIQRQSSEISNSAGTPQDSSKDRRKGVSFLSRLGMRGSWRKDDDMLDSDSELGELRTDGAYARALTSVMGAGGGYIPLHKEPPRYIRVKAHNKKDRDYNHLFLAQELTASEHKPQNTHGRAVATAVGSKILRGGDAIWAAEFSLDGRYLAVAGKDQVVRVFAVISTPEERKEHEEEEAQHGTHGEKLSAPVFRTKPVREFREHTGEVLALSWSKNNFLLSSSMDKTVKLWHMSRNDCLCTFVHKDLVTSIAFHPTDDRFFLAGSLDAQLRLWSIPDKNVAFQAPVGEFITAVAFSPDGNIAICGVLSGLCTFYTTEGLKLKYQIHVRSSRGKNAKGSKITGIRTMTIPDGPEAGQVKVLVTSNDSRVRIYNLNDKVIQVKYKGLENQSSQINARFSDDANYIICGSEDRKAYIWKVGSQDDIKDKQPYESFDAHPEVVTTALMAPMKSRQLLSASGDPIYDLCNPPPVTLRSLEESTPSQSAPSEEENGDSLHSNRRPEETPAYVERSRHLDGNIIITTDRTGKIKVFRQDCAHKKRQQGLWESGSRLSNRLSGVGRSGSVMTRTSASSRVQSRRGSLTIPGPNPIQLQHASDRINSWRQDIDGEPLSLNHNSVRSVRSERSMSPNKQAQSPVTSAANLAAESRKQPYASSPITRPTPTSPAGSGLSHHTTVRASHDRDRSNSITSPPTPSFSLISASDSDGLNDREGSFWNLSRWRSTRQSNRHSSVLSSPNGSPNLSNNRPGSDFLSVKDRSSLRMSLGMNDSKPSREEIVNRRRSAGPRLTSRLSVQGDRKSVVEEEVDVPEQITPTKKRVDSGVGRISDESATSVHPKY

SEQ ID NO: 1164 - protein, 248 aa, Thiobacillus denitrificans ATCC 25259
MRKKLVAGNWKMHGSLAENAALLAALKPALQGIEAAVCVPFPYLAQVQTALAGSSLAWGAQNVSEHGKGAFTGEVSASMLLDFGCKYVIVGHSERRSLYGESDALVAAKYMAAQAAGLTPILCVGESLAERESGVTEQVVARQLDAVVAAAGIASLARAVVAYEPVWAIGTGKTASPEQAQAVHAFIRGKLADLDAAVAAGLIIQYGGSVKAANAAELMAQPDIDGGLIGGASLLADEFVAICRAAAK

SEQ ID NO: 1165 - protein, 404 aa, Oceanobacter sp. RED65
MHEFHKSNKLANVLYDIRGPVLTAAKRMEEEGHRILKLNIGNPAPFELNAPDEIIQDVIHELPNAEGYSDSKGIYSARKAVMQYSQQKGIDGVEIDDIYLGNGVSELIVMALQALINNGDEVLIPAPDYPLWTGAVSLAGGTPRHYICDEQSNWYPDLDDIRAKVTPQTKAMVIINPNNPTGALYPKEVLEGMIEIARENNLVVFSDEIYDKIIFDEVEHTSTASLADDLLFITFNGLSKTYRLAGFRSGWLIVSGAKHKAKDYMEGLDMLANMRLCANVPAQYAIQTALGGYQSINDLIKPGGRIYEQRMTAHNMINDIPGLSCTLPQGALYSFIKMDQKRFNIKNDEKMVLDLLEQQKILIVHGRAFNWPEPDHFRLVFLPRVEDLEQAIEKMGHFFERYSQ

SEQ ID NO: 1166 - protein, 319 aa, Pseudomonas syringae pv. phaseolicola 1448A
MLTLLKLLADGAFHSGQVLGNALGISRSAVWKQLQQLEADLGIEVHKVRGRGYRLATPISLLSPAGIAQCGFPASWSVRTYDTIDSTNAEATRLIAHGAPMPLLVVAEQQTSGRGRRGRKWVSPFAENLYYSLVLRIDGGMRQLEGLSLLVGLAVMNVLRDIGVQGAGLKWPNDVLVGRQKIAGILLELLGDPADVCHVIIGIGVNVNMRSSSEVDQLWTSIRLETGSLADRNRIAALISSQLESLLAVHRKEGFVAFQDEWERGHLWQGAAVRLLSGAEAVEGVVLGADSLGALRLEVNGVEKSFSGGELSLRLRDDS

SEQ ID NO: 1167 - protein, 280 aa, Bacillus subtilis subsp. subtilis str. 168
MTTHLQAKATLHNGVEMPWFGLGVFQVEEGSELVNAVKTAIVHGYRSIDTAAIYGNEAGVGEGIREGIEEAGISREDLFITSKVWNADLGYEETLAAFETSLSKLGLDYLDLYLIHWPVEGKYKEAWRALETLYKEGRIKAIGVSNFQIHHLEDLMTAAEIKPMINQVEFHPRLTQKELIRYCQNQGIQMEAWSPLMQGQLLDHPVLADIAQTYNKSVAQIILRWDLQHGIITIPKSTKEHRIKENASVFDFELTQDDMNRIDALNENLRVGPDPDNFDF

SEQ ID NO: 1168 - protein, 153 aa, Triticum aestivum
  misc_feature (44)..(44): Xaa can be any naturally occurring amino acid
  misc_feature (100)..(100): Xaa can be any naturally occurring amino acid
  misc_feature (102)..(102): Xaa can be any naturally occurring amino acid
  misc_feature (114)..(115): Xaa can be any naturally occurring amino acid
  misc_feature (119)..(120): Xaa can be any naturally occurring amino acid
  misc_feature (124)..(124): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(133): Xaa can be any naturally occurring amino acid
  misc_feature (135)..(135): Xaa can be any naturally occurring amino acid
  unsure (1)..(153): unsure at all Xaa locations
MAEQTFIMIKPDGVQRGLIGEVISRFEKKGFYLKGLKLQNVEKXSFAEQHYAHLSSKPSSAWLVEYIVSRPVRRYVWEGQERPLQLDAKIIGATQPPGPXPXTSVGDFAFNFGXXVLQXXDQFXMXEGIAXWXLXDFQWRRTKLYKKIVIFQN

SEQ ID NO: 1169 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 1170 - protein, 441 aa, Candidatus Pelagibacter ubique HTCC1002
MPINLSKIAKAKKIKYFLISFVDFFGVLRSKLVPAQAIADMQKNGAGFAGFATWLDMSPADGDMFALPDPKSLIQLPWNKEIGWLASDLYMYGKPVKASPRVMLKEQINKLHKKDLVMKSGVECEYFLISEDGSKIADARDTQSKPCYDQSALMRRYDLIKEICDSMITMGWNPYQNDHEDANGQFEMNWDYTDCLTTADRHVFFKYMVKSLAEKHGLRATFMPKPFSNLTGNGCHAHISLWNGKINKFLDNGDKLGLSKLAYNFLGGIMKLTQPLTAFFNPTINSYRRINAPPTKSGATWSPSSISYTGNNRTHMIRIPDKGRFELRLMDGAVNPYLLQAGVIAAGLHGINNKIDPGEPLSCNMYTDHKNYPHLKKLPDIIEDALDQLENSKEIKEAFGGDTIKSYLKLKRSEINDFNQEEKFDKKSSVTHWEKNSTLDC

SEQ ID NO: 1171 - protein, 266 aa, Triticum aestivum
  misc_feature (222)..(222): Xaa can be any naturally occurring amino acid
  misc_feature (230)..(230): Xaa can be any naturally occurring amino acid
  unsure (1)..(266): unsure at all Xaa locations
HYRTSLYKKAGWYRSGIPGISSTHASGQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILYSALTTLLMLPSIGIAMRLWDMSGRRFLLPSKIPCLEITTSCXLVLVNVLXVETWCPPPLSTIRVILLFLLLPQGGFGPFPNYPPAG

SEQ ID NO: 1172 - protein, 397 aa, Solibacter usitatus Ellin6076
MQAAVNPIADRISSISVSSTMKVSAEAEKLRSEGVDVVDFGAGEPDFPTPDNIKQAAVRALEQNFTKYTAAGGTAELKKAVCEAHARDFGTDYKPAECLITVGGKHVIFNLIQALVNPGDEVVIPVPYWVTYKDVVNYAGGKCVFVDTDESQGFALTAAMLEPHLTARTRLVIINSPSNPSGAVVDRAEFEKIFQLTSSRGIYLMTDECYCKFLYDSQPFSIASLPGAKETVLVAGSLSKTYAMTGWRIGFGLVPQAIVGAMTKLQSHSTSNPCSISQKAAVEALRGPQESVAIMLAEYHKRRDYVVERLRAIPGVKCAMPQGAFYAYPNVGVVLGGKSGIANTLQLSERLLAESHVAVVPGEAFGTDQHIRLSYATSMHELGRGLDRIHEFIVKNS

SEQ ID NO: 1173 - protein, 356 aa, Zea mays
  misc_feature (179)..(179): Xaa can be any naturally occurring amino acid
  unsure (1)..(356): unsure at all Xaa locations
MAKSGALELARSTGGSLSKDQVKSAVDQYVKYHDLHGGKQESRKSNYTDLANKYYDLVTGFYEYGWGDSFHLAGGYPGETSREAIKRHQHFLALQLGLKKGMKVLDVGCGIGGPLIEIARFSSTSITGLNNNDYHISRGKELIFSAGLSEQCCFLKGDFMDMPISDNTFDAAYAIQTTXCHAPDAQGVYSEVYRVLKPGQYFALDEWCLTDRFDPNNAKHLAIKAEIELGDGLPDIRTTRQCVQAMKDAGFEVVFAKDLAQVFPCPWYRVMDPTYFSWAHFQCTRPGRIVTRAIVNTLEFLRIAPAGSMGAYNVLMSASDGLLKGGREGIFTATFFVLGRKPLKEVDIVSLSRKLI

SEQ ID NO: 1174 - protein, 505 aa, Roseovarius nubinhibens ISM
MSIPKPVVLCILDGWGLSDSDVGNAPRLAQTPIMDRLLADCPNATLLTHGHDVGLPAGQMGNSEVGHMNIGAGRVVEMDLRRIDRAIETGAFATLPGILRFAEALKASGGTAHLLGVLSDGGVHSHITHMIAAAEALTAQGLRVAIHAFTDGRDVAQVSAKTYLEELRDALPQGAFIATVSGRYYAMDRDNRWDRVSLAFDALVNARGYTADTASDAIDNAYDKGRTDEFIKPRVLGDYDGMKDGDGILCLNFRADRAREILASFADPEFADFDTGPRPQFAIVSGFTEYSRRHTAYMDCIFPDEAPENTLSQWIAAKSRTQFHIAETEKYPHVTFFLNGGRERPEPGEERYMAASPKVATYDLAPEMSSGEVTDHLVRAIEQGFDFIVVNYANPDMVGHSGDLDAAIAACEAVDRGLGRVRAAIEAKGGALIVTADHGNCEQMIDPVTGEPHTAHTTNPVPVLLLGGPEGAALRHGRLADLAPTVLALMGLDQPAEMTGQSLLA

SEQ ID NO: 1175 - protein, 272 aa, Agrobacterium tumefaciens str. C58
MVYKASGPLVLVGAGNMGGAMLSGWLKKGVPGSKVIVIDPRPSDAMRTTIAEAGATHSESVPEGVKAGILFVAVKPQMMDAILPSLKPLLGPETVVVSIAAGTTIATFVSHFGAVAAVRAMPNTPAMVGRGVTGAYANDLVTAELKTVVDGLLKVSGPVEWVEAESDIDAVTAVSGSGPAYVFYLVECMAEAGRKAGLPADVAMRLARETVAGAGELLHQSPEEAARLRQNVTSPGGTTAAALSVLMAEDGMQPLFDRAVAAAKTRAEELAG

SEQ ID NO: 1176 - protein, 315 aa, Oceanobacter sp. RED65
MAQYHVYGIGNALVDKEFEVSDAFFAENGIEKGQMTLLDQAQQESLLTKLMDQFGLKNRAGGGSAANTIFAAQYLGAKTFYSCNVANDETGDFFIKDLTSAGIDTNLGDDREDGTTGKCMVMITPDAERTMNTYLGITADLNHEHITPDALHQSEYAYIEGYLVTNDGARDAAIKCKRLAEEKGVKTAMTFSDPAMVQFFKDGITEMLDGGVDLLFCNEQEAKLYAGVESLEDAKQAISKLAKTYAITRGAKGALVFDGQQEHIIEPFAAKAVDSNGAGDNFAGAFLYGITNGLDFAQAGKLASRISSQVVSQLA

SEQ ID NO: 1177 - protein, 575 aa, Cryptococcus neoformans var. neoformans B-3501A
MKGGRFLLPALFKTLLLPPLIAALFIHHFPSLFPTFTALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKVFDMQAHIGQLALELAIMWLCGEDMSRDTNNVAWTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDIAVRLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 1178 - protein, 149 aa, Desulfitobacterium hafniense DCB-2
MEKTFIMLKPDAVQRGLVGQIIARFEAKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 1179 - protein, 143 aa, Idiomarina baltica OS145
MALERTLSIIKPDAVAKNLIGAIYNRFESAGLRIVASKMMHLSKEQAEGFYAEHSERPFFGALVEFMTSGPIVVQVLEGEEAILKNREIMGATNPADALAGTLRADYAETIDENAVHGSDAAETAAREIAYFFSDEEICPRTR

SEQ ID NO: 1180 - protein, 417 aa, Thiobacillus denitrificans ATCC 25259
MAEIRNYTMNFGPQHPAAHGVLRLVLELDGEVIQRADPHIGLLHRATEKLAEHKTFLQALPYMDRLDYVSMMVNEHAYVMAIEKLLGIEVPERAQYIRVMFDEITRVLNHLLWLGAHALDVGAMTVFLYAFREREDLMDCYEAVSGARMHAAYYRPGGVYRDLPDRMPQYQAQHTRNESTMKSMNANRQGSLLDFIEDFTTRFPAYVDEYETLLTDNRIWKQRTVGIGVVAPERALALGFTGPMLRGSGVEWDLRKKQPYEVYERMDFDIPVGTNGDCYDRYLVRIEEMRQSNRIIRQCVDWLRKNPGPIMVDNHKVSPPPRVDMKQNMEELIHHFKLFTEGMHVPAGEAYAAVEHPKGEFGIYLVSDGANKPYRMKIRAPGFAHLEALDEMSRGHMIADVVAIIGTQDIVFGEIDR

SEQ ID NO: 1181 - protein, 489 aa, Rubrivivax gelatinosus PM1
MHHITPVVLAGGSGTRLWPLSRALYPKQFLALSGTSTLFQQACLRLAALADPHTTIAAPLVVGNEEHRFMLLEQLREIGTSQSTLLLEPIGRNTAPALTLAALASRAAHGDDSILVVTPADQTVTDGPAFTRALRQAVAAAADGSLVTLGIVPDRPETGFGYIHSEGADAVRRVKAFVEKPDRATAERYLDDGGYAWNSGMFVLRASVWLAALAHFRPDIAQATEAAWAGRSTDASFVRPDKAAFAAIPGESIDYAVMEPCPADAASGFSVKMVPLDAGWSDLGAWDAVWQVSERDAQGNASHGDALIEDSRNTLVHATSRLVGAIGLDDVIIVETPDAVLVTDRSRSQQVKQIVASLQREGRSEGTLHRRVHRPWGWYDSVDAGARFQVKRILVKPGATLSLQMHHHRAEHWIVVSGTAEVTCGESKKLLTENQSTYIPLGEVHRLANPGSIPLEIIEVQSGSYLGEDDIVRFSDTYGRADGVGTDRK

SEQ ID NO: 1182 - protein, 144 aa, Yarrowia lipolytica CLIB122
METREDGLLPSQAFTTAAALLPVIDRKVVVTLRGGRKFFGILRSFDQFANLVLQDTYEKYFAVPEKVYGEEYRGTYIIRGENVELMGEVNLDEDLAAIDYEEKNGVTVNGYKKVEFAEAKKLALKTMQKEAKEIKAKNELLMGI

SEQ ID NO: 1183 - protein, 431 aa, Pyrococcus abyssi GE5
MKAIDVIERYSKIIAPANRMHYFPLVPVRAENAKIWDIEGKEYIDFLSNAAVQNVGHNNPRVVKAIKEQVEKLTHASYIYSYPVEPLLLAEKLAEIAPVDDPKISFGLTGADANDGAIKYARAYTKRQAILSYMKSFYGSTYGAMSLTGLDFQVRAMVGELSEIHYIPYPNCYRCPFGKEPGSCKMECVEYLKEKFEGEVYAEGVAALFAEPIQGDSGIVVPPKDYFRKVVKILREHGILFVVDEVQSGMGRTGKWFAIEHFGVRPDIITVGKSLGGGLPISATIGRREIIDSLPPLSHAFTLSGNPTASRAALAVIEEIEEKNLLRRAEKLGNHAMKRLKKMMDEHELIGDVRGIGLMIGVELVKDRETKERAIEETQKVIERAFELGLIVTHFNGNVLRIEPPLTIEEETLDEGLDILERAISEVEEEK

SEQ ID NO: 1184 - protein, 45 aa, Zea mays
SESKTKPYPAEASRTIMELAKVGTLCTLTQEGLPLGTGVRFAVDP

SEQ ID NO: 1185 - protein, 390 aa, Burkholderia sp. 383
MNAPSDMPTTPVFPSRLPNVGTTIFTVMSALAAEKGAVNLGQGFPDFDCDPRIVDAVATAMRNGHNQYPPMAGVAPLRDAIADKIAQVYGRRYDPATEITVTAGATQALLTAIMCTVHPGDEVIVVEPTYDSYLPSIELAGGKPVFVTLEAPDYAIPFDRLAAAITPKTRMILINTPHNPTGTVWREADMRKLEEIVRGTNVLILSDEVYEHMVYDGARHESVARYPELAARSFIVSSFGKTYHVTGWKVGYVAAPAALTAEFRKVHQFNVFTVNTPMQIGLADYLRDPAPYLTLADFYQKKRDFFRAGLERTRFKLLPCTGTYFQCVDYSAISDQPEAEFSKWLTSEIGVAAIPVSAFYHEPHESGVVRFCFAKQESTLASALERLARL

SEQ ID NO: 1186 - protein, 585 aa, Bacillus subtilis subsp. subtilis str. 168
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 1187 - protein, 489 aa, Candidatus Pelagibacter ubique HTCC1002
MTDLDRHVRQPGRDKLVKQVRAKINELGVEYIFFQFISVTGRVVGKGIPTDHWERTCEKGFQLVYGATANLFVDRHGDYIGYGPEAKELVGIPDPETFCQLPWDKKVARVFVTCFRNREERENPGAHLTSDCRGNLRIHAQEFKKKHGYQLRVGTEPEMMWLTKNEDGSPTGKGFSKPYCYHIDQFESLRPVFMKVFEYARAMGFDMIQGDHEDAPGQLELNWMYDDVLRNADRLSTYRQICAQVAREFNLIACFMTKPFMGVSASGCHTNMSLWKGGKDKVNKLSHKSIPAMDEVFTYVEGGTNYFMPDTKDIQLPGKVGLKAIGGVMKHLGALTAIGSSTVNSYRRLWDTGFWAPVYADWGFQNRTCGLRVSAPGRFEYRSVDSMHNPYLMGSGLLKCFDDGITNNIDPGKPESRSMYDAQAAGKEVKKLPLSLGEALDRLAEDEVIKSAMPDEMYKVFHWYKNDEWERFLGATTQWDLDTYLDCLP

SEQ ID NO: 1188 - protein, 248 aa, Enterococcus faecium
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYNLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRKLIL

SEQ ID NO: 1189 - protein, 652 aa, Ipomoea trifida
MAPAGKVTSFYRQGNDWFCNASLPSDISLIVDGVNFHLHKFYSGVIYDTLNSNLTTKKMLTVQFPLISKCGRIFKALEEAEGTNGQTSTTRLEDFPGGADIFLVTVKYCYGCRVEFTPRNIVMVYCAADYLEMTDEYGENNLLSKSDDYFHKNVLTNWKDCILALQSCNSMIPRAIKLQIIGKCLNALSVMVCTDPSLFGWPMLMYGSLQSPGGSILWNGINTGARIQSTASDWWFEDISYLSVPLFERLIQTMETKGIKPESLAGAIMHYCRKYLPGLGRWQSGQIVTSRTVASFSMTPATVDQKDLLESIVKLLPTKKGKSFCRFLLGLLRVALILGINHSCQETLERRIGMQLHLATLDSLLIPSYSDSDTLYNTDCVERMIHHFISEPAVTTVSPSSFDLGTSPSSEPLCRVAKLMDSYIAEIASDVNLKPERIRALAEALPDSSRSLHDGLYRAVDIYFKAHPWLPDRDKEQLCNIIDFQKLSIDACAHASQNERLPLRIILQVLFFEQLQLRTALAGCLHVLDTESANAAPAAGPSDMAGHIVQRDGWVTVVRENQVLRVDLERMRSRVRELEEEFSKIKQEMRKVSKSHSHLSSPRFLARRMGCKLLPRSSDAQPDVIGSTGPTPRASVEHPRTSGGHRKSFSLF

SEQ ID NO: 1190 - protein, 364 aa, Pichia ofunaensis
MMKALCYLGSKTIKWQTVAKPTLKSPTDVIGKLSALTLCGSDLHIIAGHVKESTDIAESQPGRGLILGHEGIIKVEEVGDAVKNFKRGDVCIVSCITSCGECYYCKRDLQSHCNRTEGTSGWILGHEIDGTQAEYVRIPYADQSLYKAPENVPIESLLMLSDILPTAYEVGVVSGNVKKGDTVAIVGLGPVGLSALLSAKALDPAKIIAIDMDDSRLEVARRLGAHETINPGKQDAAKLVHELTASEGKSSGVDVAIECVGVPATFEMCEDLLCPGGHLSNVGVHGSSVELKLQELWIKNISISTGLVSAYSTETLLQKVIDKKLDPTPLATHHFKLSEIEKAYDVFSHAADNQAIKMVITCDE

SEQ ID NO: 1191 - protein, 480 aa, Gloeobacter violaceus PCC 7421
MQIHTPNWVKHAIFYQIFPDRFSRTQQLKQKLLQAVSFEDWAAAPTLYGYKGGDLWGVIERLDYLSDLGINAIYFTPIFQSASNHRYHTHDYYRVDPLLGGNEAFKALLDAAHARDIKVVLDGVFNHASRGFFFFHDILENGQLSPWLDWFKIEGWPLSPYNVEQPANYACWDNNRALPQFNHANPMVREYIMEIAEYWIKAGIDGWRLDVPACVEAEGFWQEFRERVKAINPEAYIVGEIWEDARQWLDGTQFDGVMNYLFAAPTIAFTAGDRVQVQYVQDRSYRPYPALFAVEYKEAIDKLLGLYDWEIQLAQLNLLDSHDTARVLTIAGGDRASVELATLLLLTFPGAPSIYYGDEVGLPGGIDPDSRQGFPPESQWNGELLALHRDLIALRHRHEALRIGKYKSVYASGQCYVFERRLEAEVLLVAVNAGTEPARVTLEAPGETYPRKVLFGPGQVEAAEGHLELSLPARSGLVLG

SEQ ID NO: 1192 - protein, 90 aa, Zea mays
MSSSAAKKGASLVAATSMAAVEALKDQAGLCRWDYALRSLYHRAVPASLSSSSQHAGSGSAAAVGRAARPRRSEEEKLHKAYHIVCWGPN

SEQ ID NO: 1193 - protein, 396 aa, Synechococcus sp. CC9605
MRVSNAATEHCNEALFTVVASGPHVGSQPSVVQTYTVGMNQFSALFKRLGASGAKILSVNGVEVERQASPVATTPAPAKKTAKKPAKKAVTSTAPKKKPHADVPVNTYKPKTPFMGTVTGNYSLLKDGAIGRVQHITFDLAGGEPQLKYIEGQSIGIIPEGEDANGKPHKLRLYSIASTRHGDNLEGNTVSLCVRQLEYKNDAGEQIYGVCSTYLCDIEPGTKVKITGPVGKEMLLPDDEDANIIMLATGTGIAPMRTYLRRMFEPREQEANGYKFRGKAWLFMGAPKTANLLYDEDFLHYEKEYPDNFRYTKAISREQQNAKGGRMYIQDRVLEHAEEIFAMIEDPKTHVYMCGLRGMEPGIDEAMTAAAAAKGLDWAELRPQLKKADRWHVETY

SEQ ID NO: 1194 - protein, 228 aa, Malus x domestica
MGITGMIYMVTMVFSLIVLILSSPTVGYDYFQFTQQYQPAVCHFNPTPCRDPPDKLFTVHGLWPSNSSGNDPIYCKNTTMNSTKIANLTARLEIIWPNVLDRTDHITFWNKQWNKHGSCGHPAIQNDMHYLQTVIKMYITQKQNVSEILSKAKIEPVGKFRTQKEIEKAIRKGTNNKEPKLKCQKNSQRTELVEVTICSDRNLNQFIDCPRPILNGSRYYCPTNNILY

SEQ ID NO: 1195 - protein, 612 aa, Oryza longistaminata
MISLPLLLFVLLFSALLLCPSSSDDDGDAAGDELALLSFKSSLLYQGGQSLASWNTSGHGQHCTWVGVVCGRRRRRHPHRVVKLLLRSSNLSGIISPSLGNLSFLRELDLGDNYFSGEIPPELCRLSRLQLLELSDNSIQGSIPAAIGACTKLTSLDLSHNQLRGMIPREIGASLKHLSNLYLHKNGLSGEIPSALGNLTSLQEFDLSFNRLSGAIPSSLGQLSSLLNMNLGQNNLSGMIPNSIWNLSSLRAFCVSENKLGGMIPTNAFKTLHLLEVIYMGTNRFHGKIPASVANASHLTRLQIDGNLFSGIITSGFGRLRNLTELYLWRNLFQTREQEDWGFISDLTNCSKLQTLNLGENNLGGVLPNSFSNLSTSLSFLALHLNKITGSIPQDIGNLIGLQHLYLCNNNFRGSLPSSLGRLKNLGILLAYENNLSGSIPLAIGNLTELNILLLGTNKFSGWIPYTLSNLTNLLSLGLSTNNLSGPIPSELFNIQTLSIMINVSKNNLEGSIPQEIGHLKNLVEFHAESNRLSGKIPNTLGDCQLLRHLYLQNNLLSGSIPSALGQLKGLETLDLSSNNLSGQIPTSLADITMLHSLNLSFNSFVGEVPTM

SEQ ID NO: 1196 - protein, 342 aa, Physcomitrella patens
MVGSAKIKVGINGFGRIGRLVARVALERDDIELVAINDPFITPEYMTYMFKYDSTHGQWKKTEVTLHSEGHLTFGGNPVAVYACRDPSEIPWGKHGADFVVESTGVFTDKDKAAAHLKGGAKKVVISAPSKDAPMFVMGVNENKYSDEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKTAIKEASEGQMKGILGYTEDDVVSTDFITDSRSSIFDAKAGIALSDTFVKLVAWYDNEWGYSNRVVDLIVHMAKQGTSQ

SEQ ID NO: 1197 - protein, 226 aa, Malus x domestica
MVTGMIYVVMMVFSLILLILSSSTVGFDYYQFTQQYQPAVCNSNPTPCKDPPDKLFTVHGLWPSNSNGNDPEYCKAPPYHTIKMLEPQLVIIWPNVLNRNDHEGFWRKQWDKHGSCASSPIQNQKHYFDTVIKMYTTQKQNVSEILSKANIKPGRKNRPLVDIENAIRNVINNMTPKFKCQKNTRTSLTELVEVGLCSDSNLTQFINCPRPFPQGSRNFCPTNIQY

SEQ ID NO: 1198 - protein, 996 aa, Oryza longistaminata
MISLPLLLFVLLFSALLLCPSSSDDDGDAAGDELALLSFKSSLLYQGGQSLASWNTSGHGQHCTWVGVVCGRRHPHRVVKLRLRSSNLTGIISPSLGNLSFLRTLQLSNNHLSGKIPQELSRLSRLQQLVLNFNSLSGEIPAALGNLTSLSVLELTNNTLSGSIPSSLGKLTGLYNLALAENMLSGSIPTSFGQLRRLSFLSLAFNHLSGAIPDPIWNISSLTIFEVVSNNLTGTLPANAFSNLPNLQQVFMYYNHFHGPIPASIGNASSISIFTIGLNSFSGVVPPEIGRMRNLQRLELPETLLEAEETNDWKFMTALTNCSNLQEVELAGCKFGGVLPDSVSNLSSSLVSLSIRDNKISGSLPRDIGNLVNLQYLSLANNSLTGSLPSSFSKLKNLRRLTVDNNRLIGSLPLTIGNLTQLTNMEVQFNAFGGTIPSTLGNLTKLFQINLGHNNFIGQIPIEIFSIPALSEILDVSHNNLEGSIPKEIGKLKNIVEFHADSNKLSGEIPSTIGECQLLQHLFLQNNFLNGSIPIALTQLKGLDTLDLSGNNLSGQIPMSLGDMTLLHSLNLSFNSFHGEVPTNGVFANASEIYIQGNAHICGGIPELHLPTCSLKSRKKRKHQILLLVVVICLVSTLAVFSLLYMLLTCHKRRKKEVPATTSMQGHPMITYKQLVKATDGFSSSHLLGSGSFGSVYKGEFDSQDGEITSLVAVKVLKLETPKALKSFTAECETLRNTRHRNLVKIVTICSSIDNRGNDFKAIVYDFMPNGSLEDWLHPETNDQAEQRHLTLHQRVTILLDVACALEHLHFHGPEPIVHCDIKSSNVLLDADMVAHVGDFGLARILVEGSSLMQQSTSSMGIRGTIGYAAPEYGVGNTASTHGDIYSYGILVLETVTGMRPADSTFRTGLSLRQYVEPGLHGRLMDVVDRKLGLDSEKWLQARDVSPRSSITECLVSLLRLGLSCSQELPSSRTQAGDVINELRAIKESLSMSSDM

SEQ ID NO: 1199 - protein, 249 aa, Xylella fastidiosa Temecula1
MRPKIVAGNWKLHGSHAFAQALVAQVAAGLPLPGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 1200 - protein, 280 aa, Oryza sativa
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 1201 - protein, 366 aa, Zea mays
MRLPPPSTTAAAAAATVGAVLAAVALRRYLSASRHREPARVPMSAAAGATTLVVYGKSAQEQELLASAAGSVVLGEGDPSGDVAIALAYESAGFDAAAYMSALRARRFGRWMLWTPRIGSTQDLITRNFAKLPVGVVCVADVQFKGRGRSKNVWESPPGCLMFSFTSQMQDARKLPLMQYVVCLSITEAIKELCRAKGLPELDVRIKWPNDLYLKGLKVGGILCTSSYEPKVYNICTGVGLNVDNEKPTTCLNAALQEANHTSPILKREDILAYFFNKFENLFEIFMNHGFQVLEEQYYNSWLHSGQRVVVHDAHENKSGSVVTIQGLTPTGYLHAIGEDNKSYELHPDGNSFDFFTGLVRRKMEA

SEQ ID NO: 1202 - protein, 398 aa, Dictyota dichotoma
MILKNKKQKKNLQHFTINFGPQHPAAHGVLRLILELNGEVVQRADPHIGLLHRGTEKLIESKTYLQALPYFDRLDYVSMMCQEHTYALAVENLLNVSIPRRAQYIRVIFAEITRILNHLLAVGCHAMDVGAMTPFLWAFEEREKLMEFYERVSGARMHASYFRPGGVSQDLSLGILNDIYSFCNQFGHRLDEIEEMLTSNPIWKLRLVDIGVVTAREAVDWGFSGVMLRGSGLIWDLRKNQPYEVYPEIKFDIPVGVNGDCFDRYTIRIQEMRQSLNILYQCLNKMPQGSVKVDDYKISPPSRVELKQNMEALIHHFKLYTEGVLVPVGETYIATEAPKGEFGVYLISNGTNRPYRCKIKAPGFSHLQALNLMSSSHMLADVVTIIGTQDIVFGEVDR

SEQ ID NO: 1203 - protein, 505 aa, Silicibacter pomeroyi DSS-3
MNAPKPVVLCILDGWGLSDDKTANAPYLAKTPTFDAIMTKGPHARLITHGPDVGLPSGQMGNSEVGHTNIGAGRVVAMDLGQIDLAIEDGSFFDNAALRDFIARTRAAGGTAHLMGLVSDGGVHGHLNHIIAAAQAITNAGVPVVMHAITDGRDVAPKSAYGFMAELEDRLPKGARIVTVTGRYFALDRDNRWERVQEAYDAMVRGEGRRVSTAHSAIDYAYNQSESDEFITASVLTGYDGMRDGDSLFCLNFRADRAREILRAIGEPGFADFDTGARPALSALLGMVEYSDAHNAYMTTVFPKRDIVNTLGAWVARHGLRQFRLAETEKYPHVTFFLNGGKEEAEPGEDRFMPKSPKVATYDMQPEMSAPEVTDKFVEAIGAGYDLIVTNYANPDMVGHTGDLKAAIKACEAVDQGLSRVIAALEQAGGAMIVTADHGNCEMMIDPETGGPHTAHTLNPVPVALVGGPAGVTLRDGRLSDLAPTVLALMGLPKPPEMTGESLIT

SEQ ID NO: 1204 - protein, 110 aa, Brassica napus
  misc_feature (103)..(103): Xaa can be any naturally occurring amino acid
  unsure (1)..(110): unsure at all Xaa locations
MESELIALFETAKKAADAAAVDGVTSSSPEVSQSLDAFEKLKTFPVTYNTLVATQVGKKLRSLAKHPVEEIKSVATDLLETWKRVVIEETTSKAKKTESTNGXSQTGGGS

SEQ ID NO: 1205 - protein, 169 aa, Triticum aestivum
  misc_feature (84)..(84): Xaa can be any naturally occurring amino acid
  unsure (1)..(169): unsure at all Xaa locations
MAPTVMASSVTSVAPFQELKSTAGLPVSRRSNGASLGSVSNGGRIRCMQVWPIEGIKKFETLSYLPPISTEALLKQVDYLIRSXWVPCLEFSKVGFIFREHNTSPGYYDGRYWTMWKLPMFGCTDATQVINEVEEVKKEYPDAYVPIIGFNNMSQVQCVSFIAFKPPGC

SEQ ID NO: 1206 - protein, 241 aa, Neorickettsia sennetsu str. Miyayama
METCVQRFVVANWKMNGSQQLCDVFVNRFSAFAFNPEVEIVIAPPAVYLGQMRAAVMSSDLPLALGAQDCASGDNTPSTGDISSRMFKEVGARYVLVGHSERRTLHCESSKVVGMKANAGLRSRLIPIICVGQNNRPINRESLTKQCRDSIPMNSHDFIVAYEPVYAIGTGIVPSNEEIEEAVCLIKDAVGDAVPVLYGGSVSPVNCSEIFAVKNLGGVLVGGASLDPDSFIKICEVANRF

SEQ ID NO: 1207 - protein, 277 aa, Bacillus cereus G9241
MNLTSLKDYTTLHNGVKMPWFGLGVFKVEDGSEVIESVKAAIKNGYRSIDTAAIYQNEEGVGQAIRESGISREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIATKYNKSTAQIILRWDLQNEVVTIPKSIKEHRIIENANIFDFELSADDMKAIQALNEDRRVGPDPDNFNF

SEQ ID NO: 1208 - protein, 444 aa, Prochlorococcus marinus str. MIT 9313
MSNLLLFEVAPVTSSPLREFPCSEALLEEALNLIPLASQTFSKSVSQLPRGVSPLFVDRADGARFWDVDGHSFIDLTNGLACVTLGYRHPAVDEAVRSQLQSGVSFSLPHKLELQVAKLIIEMVPCAEMVRFAKNGTDATSGAIRLARHCTKRDRIALCGYHGWQDWSIGTTSRNGGVPKGVSDLSHTFIYNDIDSLKNLLNRYPDEFAAVILEPMNITWPEPGFLETIKSIAHQHGALLIFDETITGFRFSNGGAQELFGVIPDLSTFGKGLANGFPLSALVGRSSFMKEISNIFFSGTFGGETLSLAAANAVLLQLLNNNVTDKLSSIGSQIADGVNHLINHYSLSHVFSLSGHPSWKIWSINDHYDATAWEIRTFLFQELYARGMFTIGSHNISLAHLDFVDEILDTYSQVLSLLSSSLTTKGGVRHSLRCKPIEPLFRVR

SEQ ID NO: 1209 - protein, 267 aa, Bacillus cereus G9241
MLTKHRILFIGAGRMAEAIFSGLLKTSKEYIEEIIVSNRSNVEKLKQLRARYNVSTATDWKQHVTSVDTIVLAMPPSAHEELLAELSPLLSNQLVVTVAAGIGPSYLEERLPIGTPVAWIMPNTAAEIGKSISLYTMGRSVNEMHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 1210 - protein, 156 aa, Arabidopsis thaliana
MKPRMCLILFIALMRVMSIVSAQSSCTNVLISMAPCLSFITQNTSLPSQQCCNQLAHVVRYSSECLCQVLDGGGSQLGINVNETQALALPKACHVQTPPASRCHSGSSVNSHSEHGNGSKTIPREKSSSDGSIKFSFPLLAILFTASYITLIYAKY

SEQ ID NO: 1211 - protein, 520 aa, Tuber borchii
MGFIIKRPEGESGKALPAILIGLFVAFGGILFGYDTGTINGILAMDFFQSEFATDGRKELTSSQTSLIVPILSAGTFFGALCASPFGDILGRRMGLIASCLVFSIGVALQVAATAIPLMAAGRVIAGLGVGLVSALVPLYQSESAPKWIRGSIVGCYQLAITIGLLLAACANQGTHARNNHGSYRIPLAIQFVWAAILAGGMFILPETPRYYIKKDNMEAAAKSMSRLRSLPADHPAIIEELNEIKAIHDLEMQATGEATYLDCVKPDMIKRLLTGCGIQALQQLTGINFIFYYGTQFFKNAGIKNAFLIGLITNLVNVISTFPGLWMVEKMGRRNLLLFGAIGMCACQFIVAIVGITTVSAIANNVLIAFVCFYIFFFACSWGPCSWVVTGEIYPLKVRAKCLSISTATNWLLNWAIGFSTPYLVAEGPGKPNLGTKIFFVWGSCCFLCIAFVYLFIYETKGLSLENVDQLYMTVGHAWESKKFTPSVSYNSDKMLSNGHGADGKSSELAHIEGGHGEV

SEQ ID NO: 1212 - protein, 406 aa, Zea mays
  misc_feature (255)..(255): Xaa can be any naturally occurring amino acid
  unsure (1)..(406): unsure at all Xaa locations
MHDLVVSSNFLEQEGVSSSACSALFYFTPSALELEPSPSPQTQASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLXMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 1213 - protein, 492 aa, Ipomoea trifida
MEKFNVVVYVLVSFLLSSPLFHLGGAGAKTAGDGSEAWGYVQVRPKAHMFWWHYKSPYRVEDPNKPWPIILWLQGGPGASGVGIGNFQEIGPLDVNLEPRNSTWLKKADLLFVDCPVGTGYSFVEDTKLLVKTDVEAATDLTTLLIKVFNKDVNLQKSPLYIVAESYGGKFAVTAGLSALKAIEAGKLKLKLGGVALGDSWISPEDFVLSWGPLLKDVSRIDENGLELSNRQQLDQLGWVAPLICMNIGNVCCLTKHVSENSIANQIKKKLVGGQFEEATTLWSKLEDVISAYSNSVDFYNFMLDSDQELLSTTSQSLAMKRYKSYLGSLKASPGSGGDLDSLMNGAIKKKWGELSGSVFDTMAGDFMRPRINEVDELLSKGVNVTIYNGQRKILIDTSTICTKYKVDLICATKGTEAWVQKLKWEGLKTFKSIDRTPMYCGNDQTTRGFTKSYKNLHFYWILGAGHFVPVDQPCVSLDMVGNITQSPATSH

SEQ ID NO: 1214 - protein, 359 aa, Streptomyces avermitilis MA-4680
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 1215 - protein, 86 aa, Triticum aestivum
MAAPAKASWMVAMSVGAVEALKDQAGLCRWNYALRSIHRAAKASVRGGVSHGKKQLPATAVVETWRAEKAEEGLRTVMYLSCWGPN

SEQ ID NO: 1216 - protein, 258 aa, Trichodesmium sp. IMS101
FGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAERLEFRCPDATCNPYLAFAAMLCAGIDGI

SEQ ID NO: 1217 - protein, 390 aa, Magnaporthe grisea 70-15
MGKVKTPRRAGAASSSPYDRKGGNNAAAAAAAAPTKNNVFRFKKDYGQHILKNPGIAEEIVKKAYLRPTDTVLEVGPGTGNLSVKILERAQKLIAVELDPRMGAELTKRVQGKPEQRKLEVILGDVIKADLPPFDVLISNTPYQISSPLVFKMLALPNPPRCMVLMFQREFSSRLTARPGEALYSRLSVNVQLFSKVTHIMKVGKANFKPPPQVESSVVRIEPKLGRERPNVSWEEWDGMLRVCFNRKNKTLHASFLGVKEVLAMAERNYKVWCTMNDIPIDESVVETTDGDVEMDADDGEWGGIMDVDEDGGDAGDDDDVPEFFKEKAPAPVAKTPSKRKKTKVGELVRSKIEKVLKDTDLAEQRANKCDQNDFLRLLAAFNAEGIHFA

SEQ ID NO: 1218 - protein, 435 aa, Xylella fastidiosa Temecula1
MNQIRQAPAASASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKESRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKMNPGQVMVENCKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 1219 - protein, 149 aa, Trichodesmium erythraeum IMS101
MERTFIAIKPDGVQRGLVGQIISRFETKGFTLVGLKIMTVTKELAEKHYDVHKERPFFSSLIEFIKSGPLVAMVWEGEGVVASARKIIGATNPLTAEPGTIRGDYGISLGRNLIHGSDAIETAQTEINLWFKEEELVSWKPTLTSWIVE

SEQ ID NO: 1220 - protein, 134 aa, Zea mays
GAFTGEVSAEMLVNLGVPWVILGHSERRALLGESNEFVGDKVAYALSQGLKVIACVGETLEQREAGSTMDVVAAQTKAIAEVAESTRIIYGGSVTAANCKELAAQPDVDGFLVGGASLKPEFIDIINAATVKSA

SEQ ID NO: 1221 - protein, 514 aa, Candida albicans SC5314
MSMYPQRTQHQQRLTELLDAIKTEFDYASNEASSFKKVQEDYDSKYQQQAAEMQQIRQTVYDLELAHRKIKEAYEEEILRLKNELDTRDRQMKNGFQQQQQQQQQQQQQQQQQQQQIVAPPAAPPAPPTPVTSLSVIDKSQYIVNPTQRANHVKEIPPFLQDLDIAKANPEFKKQHLEYYVLYNPAFSKDLDIDMVHSLDHSSVVCCVRFSRDGKFIATGCNKTTQVFNVTTGELVAKLIDESSNENKDDNTTASGDLYIRSVCFSPDGKLLATGAEDKLIRIWDLSTKRIIKILRGHEQDIYSLDFFPDGDRLVSGSGDRSVRIWDLRTSQCSLTLSIEDGVTTVAVSPDGKLIAAGSLDRTVRVWDSTTGFLVERLDSGNENGNGHEDSVYSVAFSNNGEQIASGSLDRTVKLWHLEGKSDKKSTCEVTYIGHKDFVLSVCCTPDNEYILSGSKDRGVIFWDQASGNPLLMLQGHRNSVISVAVSLNSKGTEGIFATGSGDCKARIWKWTKK

SEQ ID NO: 1222 - protein, 409 aa, Oceanobacter sp. RED65
MSTTSLDKSKIRILLLEGVHQSALDTLNAAGYTNIEYVKTALAGDELKEKIKDAHFVGIRSRTQLTEDVFEVANKLIGVGCFCIGTNQVDLNAAAKRGIPVFNAPYSNTRSVAELVLAEAILMLRGIPEKNAVCHRGGWLKSAVGSFECRGKNLGIVGYGSIGTQLSVLAEGLGMKVYFYDVVTKLPIGNATQVESMDELLSISDIVTLHVPETGDTKDMMGAEQFAKMKKGSLFINAARGTVVDIPALAEALETGHIAGAAVDVFPVEPKGNDDEFLSPLRKFDNVILTPHIGGSTQEAQENIGKEVGEKLAGYSDTGTTLSAVNFPEVALPQHGNFHRILHIHKNQPGVLNAINTIFAENNINVLGQFLQTSADIGYVVIDVEESAGELALEKVQEVEATIRARILY

SEQ ID NO: 1223 - protein, 857 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCISDFPEDFIFGAATSAYQVEGAAHEDGRGPSIWDTFSEKYPEKIKDGSNGSIASDSYHLYKEDVGLLHQIGFDAYRFSISWSRILPRGNLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYTESAEDRLAAARAMAFTFDYFMEPLVTGKYPVDMVNNVKDGRLPTFTAKQSKMLKGSYDFIGINYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYSVRFGLVYVDFNDGRKRYPKKSAKWFRKLLSEKKRN

SEQ ID NO: 1224 - protein, 120 aa, Cucurbita maxima
MAVEGQVIPLRDAEEFDAIIDKEKESGRLIVIDFTASWCPPCRFIAPVFAELAKAHVHVTFLKVDVDNVKEIAKRFEVTAMPTFVFLKGGNEVHRIVGADKVELGVKVLELSAAPATCAS

SEQ ID NO: 1225 - protein, 486 aa, Burkholderia xenovorans LB400
MTTLTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLCVGGI

SEQ ID NO: 1226 - protein, 538 aa, Candida albicans SC5314
MSPSLVHQILAITHPYVEYLEENITKWYILVPGILIVLNVLTTLHTKYLEYKFNAKPVTNFIQDYTFGVITPLILIYYKSQGTVMEFANNFWNFKFLIKNPDVGTGELRIFGMHLIETKDPENIKAVLATQFNDFSLGTRHGFLYSLLGDGIFTLDGAGWKHSRSMLRPQFAREQIAHVKILEPHMQVFFKHIRKNKGKTFDIQELFFRLTVDSSTEFLFGSSVESLRDETIGMSPSVKNLAGRDEFADAFNYSQTINAYRFLLQQFYWLCNGTKFRKSIAAVHKFSDFYVQKALSLSQDELDEQKGYVFLYELAKQTRDPKVLRDQLLNILVAGRDTTAGLLSFVFFELARNPEVYAKLKEEIYNKFGSGEDARIDEITFESLKQCEYLKAVINESLRLYPSVPHNFRTATRNTTLPRGGGPDGMSPIVVKKGQSVMYTVLVTHRDTKTYGADANEFRPERWFEPETRKLGWAYVPFNGGPRICLGQQFALTEASYVTVRLLQEFEHLTMDAETRYPPKLMNSLTLSLLDGANVEMY

SEQ ID NO: 1227 - protein, 148 aa, Triticum aestivum
HYRTSLYKKAGWYRSGIPGISSTHASVLFALPWLRRNRQRPRGGEIANRPAMGVTKEDVEAAVAAALSPTHLVVTDTSGGCGASYEIEVVSDKFEGKRLLERHRMVNTALAPLMAEIHAVSIKALTPAQAQPKPQPEPAAAAADKPQA

SEQ ID NO: 1228 - protein, 522 aa, Candida albicans SC5314
MSVSDIVQEYITKWYVVIPTLFVVYQVVDFFYVRSLRSRLGAKAPTNNESDGYWGFHLPFLLVSKKAEGTIIDFAGERFKSIAHPEVPTFQFPIFTVKVISTVDPENIKAVLATQFNDFSLGTRHNQFAPLLGDGIFTLDGAGWKHSRSMLRPQFAREQVAHVKALEPHMQVLFKHIRKSGGRTFDLQELFFRFTVDSATEFLFGESVESLRDESIGMALEAVDFDGKKEFAEAFNFSQNYLASRAVMQQMYWLLNSSEFKSCNSKVHKFAEYYVNKALELSHEELEKQQGYVFLYELAKQTRDTKVLRDQLLNILVAGRDTTAGLLSFVFFELARNPRVFAKLREEVEEKFGVGEDARVEEISFESLKSCEYLKAVLNECLRLYPSVPQNFRVATKNTTLPRGGGSDGMSPILVRKGQTVMYSVYVTHRDTKVYGKDADEFRPERWFEPETRKLGWSFVPFNGGPRICLGQQFALTEASYVTVRLLQEFGHLTMDPNTDYPPKKMSHLTMSLYDGTNVEMY

SEQ ID NO: 1229 - protein, 1022 aa, Cryptococcus neoformans var. neoformans JEC21
MPSSANAHDGAARQATVTRKRTNGSSTRDEKQYIGQWRIGRTIGKGSSGRVKIAKHAVTGKYAAIKIVPKGLILNSRMSMSEAGAKADKVLLGIEREIVIMKLIDHPNVLNLYDVWETSSELYLIMEYVPGGELFDYLVKRGRLPVSEALHYFQQIIYAVDYCHRFNICHRDLKPENLLLDKDKNIKVADFGMAAWEAGERMLETSCGSPHYASPEIVAGKAYHGSSSDIWSCGIILFALLTGRLPFDDDNIRSLLQKVKIGIFEMPDEIKDPARDLLRRMLERDPERRITMPEILSHPFFISRPPRPIPGRSLVSPPSLDEVERPVNSVDEIDPDIMGNLKTLWSGVSDEEIIKALMCKDKTWEKTIYHLLIKYRNKHLENYNMEEEEYAEARERRQARKQLQSSSSPARRKGVPAQDQSARLAPLGENETVANTPVKRPQAPTPNKASRKAPPECPTPTKQVSQARSPAGPRPANSRGNSGASNSSQAPAIVLQGATPTKELPPPHTTSSHPRPEMITTPTSPAPLSVPRVEDANLQTFLNQIADQMNRFSVRSSVASQSSTSSSAVLGSDYQACLAFAAGVTPSANPSSSVTESVIEEQGQFEDAADDQTDTEVASIHSGFTASIAPQSPLAGLGLGAPSAAVRPGLHPVAGPNQQRWSYASSAGSSYQGSSVGSYAPVESPQYIHSPLEVQAPVLQAERSAPRPPPRATRPAPPPISRPLPFSPAQQTYSEPTESLLPRDTSYVIIDNSELPSDASLSSWGSKSSGFKAHRGLDGFGMLKKKKLNVEPVPYSYGNLGSSATSPLNSPKRSWFNNLFNFKPATCTLLSRDNVANTRERVRKILLSIGVRTAVTEIDGHKALKCRLDEVRDNGNVTTKGVRFRVEFTRASTSQTYSTLVTLTQEKGAESSFRACFAELKHFMDSQPSAPTTLSLNRPSVEQSRSVNSSNLLPAHSYQQQRYSSTSADTPAGAPTSPLLSAPPIRYTASAPTTPVIESSPRFTSPYLQLPVSPQSLQMPSY

SEQ ID NO: 1230 - protein, 492 aa, Mycobacterium sp. KMS
MRRGRRVGLLGFPARATQSGPRGDERMIDARTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYQPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 1231 - protein, 345 aa, Saccharomyces cerevisiae
MPPKKGKQAQAAGKKKDNVDKTFGMKNKNRSTKVQKYIKQVQSQSDPKKEEMRLKKLEEKKRREAEEAERRALFNPVADQRVRAGVDPKSMVCALFKLGNCNKGAKCKFSHDLNVGRRMEKKDLYQDTRSEKENDTMDNWDEEKLRKVILSKHGNPKTTTDKVCKYFIEAVENGKYGWFWICPNGGDKCMYRHSLPEGFVLKTNEQKRLERESLEKQPKITLEEFIETERGKLDKSKLTPITIANFAQWKKDHVIAKINAEKKLSSKRKPTGREIILKMSAENKSFETDNADMPDDVTQGSAWDLTEFTDALKKADHQDDGGIKDYGDGSNPTFDIKKANSATLA

SEQ ID NO: 1232 - protein, 264 aa, Triticum aestivum
TRSVLSTIIDPKDGSMASTQALKQMALEHDVPIVSIADLIRYRRKREKLVELIAVSRLPTKWGLFRAYCYQSKLDGTEHIAVAKGDIGDGEDVLVRVHSECLTGDILGSARCDCGEQLDLAMQLIEKAGRGVLVYLRGHEGRGIGLGQKLRAYNLQDQGSDTVEANVELGLAIDSREYGIGAQILRDIGVRTMRLMTNNPAKFVGLKGYGLAVVGRVPVISPITKENQKYLETKRTKMGHLYGSDLPGGLLKEFLNPTEDNATN

SEQ ID NO: 1233 - protein, 525 aa, Bacillus subtilis subsp. subtilis str. 168
MFRVLVSDKMSNDGLQPLIESDFIEIVQKNVADAEDELHTFDALLVRSATKVTEDLFNKMTSLKIVGRAGVGVDNIDIDEATKHGVIVINAPNGNTISTAEHTFAMISSLMRHIPQANISVKSREWNRTAYVGSELYGKTLGIVGLGRIGSEIAQRRGAFGMTVHVFDPFLTEERAKKIGVNSRTFEEVLESADIITVHTPLTKETKGLLNKETIAKTKKGVRLINCARGGIIDEAALLEALENGHVAGAALDVFEVEPPVDNKLVDHPLVIATPHLGASTKEAQLNVAAQVSEEVLQFAKGLPVMSAINLPAMTKDEFAKIKPYHQIAGKIGSLVSQCMKEPVQDVAIQYEGTIAKLETSFITKALLSGFLKPRVDSTVNEVNAGGVAKERGISFSEKISSSESGYDNCISVKVTGDRSTFTVTATYIPHFGERIVEINGFNIDFYPTGHLVYIQHQDTTGVIGRVGRILGDNDINIATMQVGRKEKGGEAIMMLSFDRHLEDKIVKELTNVPDIVSVKLIDLP

SEQ ID NO: 1234 - protein, 339 aa, Escherichia coli K12
MKSILIEKPNQLAIVEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 1235 - protein, 475 aa, Bacillus cereus G9241
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 1236 - protein, 506 aa, Rhodobacter sphaeroides 2.4.1
MTAPKPVVLCILDGWGLRAEREANAVALAETPTFDRLMATCPNATLVTHGPDVGLPRGQMGNSEVGHTNIGAGRVVAMDLGAIDLAIEEGSFPQNPALRDFIGKVKAKSGTAHLMGVVSDGGVHGHIQHLISAVEVLAGEGIPVVIHAITDGRDVAPTSAGEFVGQLVRVLPEGARIGTVIGRYWAMDRDKRWDRVKRASDAMLHATGEHAPDAEAAVAAALARGETDEFIAPTVVGDYAGARDGDGFFCLNFRADRAREILAGLAQPGFDAYDTGARPDWSAFLGMVDYSKEHDRFMTTAYPKPVIRNTLGEWVASHGLRQFRIAETEKYPHVTFFLNGGREAPETGEDRYMANSPKVATYDLQPEMSAPDVSDHLVEAIGAGYDLIVVNYANPDMVGHTGDLKAAMAAVEEVDRGLGRAVEAVTKAGGAMIVTADHGNCETMVDPETGGPHTAHTTNPVPVILVNGPAGARLHAGRLADLAPTLLQLMQLPQPEEMTGRSLIDA

SEQ ID NO: 1237 - protein, 187 aa, Triticum aestivum
  misc_feature (123)..(123): Xaa can be any naturally occurring amino acid
  misc_feature (133)..(133): Xaa can be any naturally occurring amino acid
  misc_feature (155)..(155): Xaa can be any naturally occurring amino acid
  misc_feature (157)..(157): Xaa can be any naturally occurring amino acid
  unsure (1)..(187): unsure at all Xaa locations
TLYQSTKGGKPFVDILKEGNVLPGIKVDKGTVELAGTNGETTTQGFDDLGKRCAKYYEAGARFAKWRAVLKIGLTEPSQFPSDQNAQGLARYAIICQENGWVPIVDLRSLVDGPHDIDRCAYXTEWPCCLLQXLNDNILLEGTLPEPKWYPGSDXRXTRDADRRTSKDSCASCNVSKETEHSQDLLV

SEQ ID NO: 1238 - protein, 417 aa, Burkholderia sp. 383
MAEIKNYTLNFGPQHPAAHGVLRLVLELDGEVIQRADPHIGLLHRATEKLAESKTFIQSVPYMDRLDYVSMMVNEHGYVLAIEKLLGIEVPERAQYIRVLFDEITRVLNHLMWIGAHALDVGAMAVFLYAFREREDLMDVYEAVSGARMHAAYYRPGGVYRDLPDAMPQYKASKIRNEKALAKMNEARSGSVLDFIDDFFARFPKCVDEYETLLTDNRIWKQRLVGIGVVSPERALQMGLTGPMLRGSGIAWDLRKKQPYEVYDRMDFDVPVGVNGDCYDRYLVRVEEMRQSIRIAKQCIEWLRKNPGPVMTDNHKVAPPSRVGMKTNMEDLIHHFKLFTEGFHVPEGEAYAAVEHPKGEFGIYLVSDGANKPYRLKIRAPGFAHLASLDEMARGHMIADAVTIIGTQDIVFGEIDR

SEQ ID NO: 1239 - protein, 548 aa, Rhodobacter sphaeroides 2.4.1
MDISRTSDVWWKNAVFYCLDVETFQDSNGDGIGDFAGLTRRLDHLDRLGVSCIWLMPFYPSPNQDDGYDITDYYSVDPRLGTLGDFVEFLRAAHDRGMRVIADLVVNHTSREHPWFQASRADPDSPYRDWYVWRDEKPDEDAASLVFPGEENSSWTWDAKAGKYYLHRFYSHQPDLNVENRAVRDEIQRIVGFWLQLGLSGFRVDAVPFLLEQMSTVDTGFAPHRWLRDLRAFINRRSGDAVLLGEVNLDYPDVRRFFGDEDGDELHMCLDFNLNQAMALALAREDAGPIVHGLRHMPELAPDDGWAHFLRNHDEWSLDKLTEAERQEVFASFGPDPSMQLFGRGLRRRMPTMLKGNPDRLRMAYALMASMPGSPVIFYGEEIGMAENLEIPGRLAVRAPMQWDAGPHGGFSNASTEALHRPMVSDPQWGPGKVNAIDQQDRPDTMFHFMEHLLRRRRECPEIAFGEHAVLPFPEPEIFAIRHDWEGRTLIALANLGAKPQKVTLTLPKASGLGRLRPILGEGKVSLRKDELTVELGGYGLRWVRFES

SEQ ID NO: 1240 - protein, 138 aa, Actinobacillus pleuropneumoniae serovar 1 str. 4074
MIQQTLCLIKPDATQRNLIGKILSHLEEAGLTIKALKKVQLNQEQAEGFYAEHQGKEFFAPLVEFMISAPIVAVVLEGENAIAHYRELMGATNPEQRKAGTIRALYAISGRENSVHGSDSEQSAKREIAYFFTPNEIL

SEQ ID NO: 1241 - protein, 335 aa, Pichia angusta
MTANVGINGFGRIGRLVLRIALSRDDINVIAINDPFIAPDYAAYMFKYDSTHGKFKGTVTHEGKYLVINGKKIEVFQERDPANIPWGKEGVDYVLDSTGVFTTIEGAQKHIDAGAKKVIITAPSKDAPMFVVGVNHEEYTPDIKILSNASCTTNCLAPLAKVINDIFGIEEGLMTTVHSITATQKTVDGPSHKDWRGGRTASGNIIPSSTGAAKAVGKVLPALAGKLTGMSMRVPTTDVSVVDLTVNLKKPTTYEDICATMKKAAEGPLAGILGYTDEAVVSSDFLTDSRSSVFDAKAGILLTPTFVKLVSWYDNEYGYSTRVVDLLQHVAKVSA

SEQ ID NO: 1242 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 1243 - protein, 464 aa, Agrobacterium tumefaciens str. C58
MTEIGFRTPSTDTTGAQPVSKLATARLALSLIRNPLKALPPEIFSEPAVFTRLGGVMRVHLADPVLIHEALVKNAALLGKGEDVRRALGPALGQGLLTADGDHWKWQRQSVAAAFRHEKLLELLPVMIETARRTQKRWRSSSTADIDIGHEMMRTTFDIIVETMMSGGYGIDIARVEQSITDYLKPTGWTFALAMLGAPEWLPHPGRRKSRAAVDYLRASLATVITGRRKNPTDRPDLVSMLLEAKDPETGRMMSDEEIIDNLLTFITAGHETTALGLAWTFHLLSQNPETERKAVEEIEAVTGGEPVAAEHIANLAYVRQVFSEAMRLYPPAPVITRTALQDFRLGEHDIPAGTVLYVPIYAVHRHTALWDEPERFDPSRFEPEKVKARHRYAYMPFGAGPRVCIGNAFAMMEAVAILAVILQKNHLENRTMASAEPLMRVTLRPQERLMMKITQRQNKSPAV

SEQ ID NO: 1244 - protein, 391 aa, Arabidopsis thaliana
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 1245 - protein, 353 aa, Cryptococcus neoformans var. neoformans JEC21
MPPKAKDDKTFGMKNKNKSSKVQKHIATVQKQQEQAGKSKGDKAKEREREKAAEAKAAALAKKKMEAELFRPAQIQKVPFGTDPKTVLCVFFKAGHCEKGNKCKFSHDRNVERKVEKINLYADQREEKSKDSMDTWDEEKLRNVVTENGRKQNNATDIVCKYFIQAIEDRKYGWFWECPNGGNKCMYRHALPPGFVLKSDKKKQEEAAKKDQISLEQFIEVERHKLKPPLTPVTPETFATWKKNRLEKKAAEQEALEKAKATQRAAGKMTGMTGKDMFEFGGELYEHVDEGEEEDEDWDISRMLARYRDDETATTAFDPTKGKFVNPRTGEVVDDPEDESIAEVAKKVEGVKV

SEQ ID NO: 1246 - protein, 527 aa, Escherichia coli CFT073
MTIAKNDCHCPNLIRHPNEINLSPSRRYFIRISCSSNTWLFQSTEYYMSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQEAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 1247 - protein, 504 aa, Oryza sativa
MEGMGMAAAWAAGDLWVLAAAVVAGVVLVDAVVRRAHDWVRVAALGAERRSRLPPGEMGWPMVGSMWAFLRAFKSGNPDAFIASFIRRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRVRYLPHPRPVDNCLATITKVSDEH

SEQ ID NO: 1248 - protein, 334 aa, Aspergillus oryzae
MSRYAEAHANPQGPGDARPTALQIVKDTEMEGKLAGKSAVITGVSSGIGLETVRAIAATGAFLYLTARDLNKAKTALDDIFKPEQMELIHMDQSSLESVRNAAKTILSKTDKVSLLINNAGIMALPELRLSMDGYELQFATNHLSHFLLFNLLKPAMLAASTPEFQSRVVNVSSDSHRHHGINASDNYNFQKGGYEPWTAYSQSKTAVIYMANELDRRYGSRGLHATSVHPGMIATNLGQYLTPEQIEQLLQNTRWNSLWKSFEQGAATTVWAAVGREWEGNGGKFLAGCAEAVRGPEGTEDYVGTFVNHTYKPEDEARLWKDSLEMVGLSDDK

SEQ ID NO: 1249 - protein, 473 aa, Bacillus cereus E33L
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 1250 - protein, 250 aa, Flavobacterium psychrophilum
MRAKIVAGNWKMNKNSEETEDLINELIDKLPTNSNAKIIIAPTFINLASAVDHTEFTNIRVAAQNMHQAENGAYTGEISADMLKSIGVNTVILGHSERRAIFHETDAIISFKVDTALRHEMTVIFCFGEELKDRQNKQHFNIVENQLRDGLFHIDKSAWANIILAYEPVWAIGTGETASPEQAQEMHEFIRETVRKVFGSDIAEDVSILYGGSVKPDNAKEIFSKPDVDGGLIGGAALKADDFVVIVNGI

SEQ ID NO: 1251 - protein, 364 aa, Triticum aestivum
TSLYKKAGWYRSGIPGISSTHPRVRKSWIGTALACDSKAAAQPRHVCRAVQQSSKSKVSVAPLDLESAKEPPLNTYKPKGPYTATIVSVERAVGPNAPGETCHVVIDHGGNVPYWEGQSYGIIPPGETPKKPGNPQNVRLYSIASTRYGDSFDGKTASLCVRRAVYYDPETGKEDPSKNGVCSNFLCNSKPGDKIQMTGPSGKIMLLPETDPNATHIMIATGTGVAPYRGYLRRMFMEDVPNFRFGGLAWLFLGVANSDSLLYDEEFTSYLKQYPDNFRFDKALSREQKNKSGGKMYVQDKIEEYSDEIFKLLDGGAHIYFCGLKGMMPGIQDTLKKVAEQRGESWDQKLSQLKKNKQWHVEVY

SEQ ID NO: 1252 - protein, 509 aa, Yersinia pestis biovar Medievalis str. 91001
MMSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 1253 - protein, 1095 aa, Thiobacillus denitrificans ATCC 25259
MEENDPLWYKDAIVYELHVKAFFDANGDGAGDFRGLISKLDYLQELGVNALWLLPFYPSPGRDDGYDISDYHNLHPSFGDMADFRRFIREAHQRGLRVITELVVNHTSDQHPWFQAARRAPPGSVKRNYYVWSDTDTRFSETRIIFSDTEKSNWAWDEVAQAYYWHRFFSHQPDLNFNNPHVFKAIMRTMRFWFDAGVDGMRLDAVPYLCERDGTSNENLPETHAVIRRMRAELDARYSNRMFLAEANQWPEDVREYFGNGDECHMAYHFPLMPRMYMAIAQEDRHPIVEIMEQTPDIPDLCQWAVFLRNHDELTLEMVTDRERDYLYQAYASDPQARLNLGIRRRLAPLLDNDRHRIELMNLLLMTMPGSPIVYYGDEIGMGDNLLLGDRNGVRTPMQWDGGPNGGFSSAPTERLFLPPITDPVYGYGAVNVEAQQRNPSSLLNWTRRLIAMRKAHRALGRGTLRFLRPGNRKVLAYLREYEGETILCVANVARAPQAVELDLSPFKGHVPVELMGRSSFPPIGELPYLLTLGGYGCFVFRLATDVEAPAWHEERPVPPDLPVLVLVDAGWRTLFARTDEGVNQLMVRRAREQLERQIIPRYFRTQPWFVYSEAALEKFEFGTLREWGTDSGTWLLATVTVTLLDGSIYHYALPLGLAWEDEDEGRVAALLHVTLAKVRRLARVGILFDAFWDDGFCCAIVSAMERGETLAYGDGHLTFRTASAYPGFFCPLVTSSITRTVSEHGRLRVNLNDQLVLKSYPRQMQGTHPELEMSRFLTETAKFAHIPQLGGTVEYVASSGRHSTLAILERYAPNQGDAWAYTLNYLERFLDLSRTTGEQAPDGRHGRYMGLMKTLGERTAEFHRALATPDRSGDFGSEPIAPPDILEWVNKVRHEMGVMYELLERALPALPEPVAVAAQQLFLVRPKLYRRVIRASRVRVDASKTRCHGNYHLGQVWLVQNDFLIANYGGIPGRSWEERRAKHAPLRDVASMLLSLSQAGAAALARVAGDSVDVMAALQPHVDAWELAARKAFYRGYRKGMDGHAAYPTDATAAEALLTLFLAEKAIAELTEALERRAVGSAAAMRRLVQVTRR

SEQ ID NO: 1254 - protein, 105 aa, Zea mays
GWKGLGSREAAYYQQGAGFAKWRTVVSIPNGPSELAVKEAAWGLARYAAISQDNGLVPIVEPEILLDGEHGIERTFEVAQKVWAETFYAMAENNVMLWSIPYVCP

SEQ ID NO: 1255 - protein, 501 aa, Aeromonas hydrophila
MRCLYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQQAFTNAVNSAIPFAESGKLVTFGIVPNTPETGYGYIHRGSELKSFLNEEKAYGVNQFVEKPNLAVAKGYLASGEYYWNSGMFMFSARRYLAELKLSRPDIYQACLASMNDIRSDLDFIRINNDEFKQCPSDSIDYAIMEKTSDAVVIPMDAGWNDVGSWSSLWDISDKDACGNVSRGDVILIESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 1256 - protein, 251 aa, Burkholderia sp. 383
MSKQRTKRVIGNWKMHGRLAGNQALLNEVVQGAGAVAAETSIGVCVPFPYLAQVQAQLDGGRVAWGAQDVSAHEQGAFTGEVAAAMVAEFGARYAIVGHSERRAYHGERNETVAAKTQRALAAGLTPVVCVGETLDERESGATEQVVGAQLDAVLAVLTADEATRIVVAYEPVWAIGTGKSATSAQAQDVHAFLRARLAAKGAADVSVLYGGSVKPDNAEELFAQPDIDGGLIGGASLKAEDFLAICRAAR

SEQ ID NO: 1257 - protein, 998 aa, Magnaporthe grisea 70-15
MATSLALNVTLCFTATFPTEKLDELEQNCAWSLDSGTGSCTEPRYCRARKRIAALMAKRVGEAETLFQLCLVSQHSSGAPPPTGLIIPQLPLAIDRGILPHDLRPVAQDKMATDKPQRIPMRERRPSSGAPLVDITGSVSPAGVSRPKHKRTLTGFGAQEIKSVEASIPEGQRAAWSKHQAKPFQDKEEFENEVVRHIETTLARSMFNCNESAAYSAAGLAFRDRLIMEWNKTQQRQTFEDKKRVYYLSLEFLMGRTLDNAMLNLNLKDVAKQGLSELGFNVEDIIGEERDAALGNGGLGRLAACFLDSLASLNYPAWGYGLRYRYGIFKQEIVDGYQVEVPDYWLDQNLWEFPRHDVTVDIQFYGHVEKSQESSGSKTSANWVGGETVTAIAYDMPIPGYATPTTNNLRLWSSKAASGEFDFQKFNSGEYESSVADQQRAETISAVLYPNDNLERGKELRLKQQYFWVAASLYDIVRRFKKSKRAWREFPEQVAIQLNDTHPTLAVVELQRILIDLEGLDWDDAWNIVQSTFGYTNHTVLPEALEKWPVGLIQHLLPRHLQIIYDINLFFLQSVERQFPGDRDLLSRVSIIEEGQTKMVRMAHLAIIGSHKVNGVAELHSDLIKTTIFRDFVEIFGPDKFTNVTNGITPRRWLHQANPKLSELISTKCGSYDFLKDLTGLNELEKWVKDEEFRKEWAAIKRSNKARLADYIKRTTGVTVSPDALFDVQVKRIHEYKRQQMNIFGVIHRYLALKAMTPEEREKQLPRVSIFGGKAAPGYWMAKQIIHLINSVGAVVNKDEDIGDKLKVVFLEDYNVSKAEMIIPANDLSEHISTAGTEASGTSNMKFVLNGGLIIGTCDGANIEITREIGENNIFLFGNLAEDVEDLRHAHTYGKTHAIDPELLKVFDAIQAGKFGEPQNFGSLIAAIKDHGDYYLVSDDFSSYLDTHKLVDESYRDQEGWITKCITSVARMGFFTSDRCINEYAEEIWNIEPLKVGA

SEQ ID NO: 1258 - protein, 576 aa, Thermoanaerobacter tengcongensis MB4
MENEIKAQQDRKKYVRALYSKFGASILEEKWQTPDQVTLTVKLNILPEIVEEAYYGQGGWLSNVIGNDERSINGHFAVYYVLSIEAEKDPDKNLWLTVKALVPADKPEFPSVAPRVPAAVWYEREVRDMLGLEPVGLPDARRLVLPDDWPDNLYPLRKDMDYRLRPEPAAEEENYEFIEVKGEGIVEVPLGPLHITSDEPGHFRLYVDGEYIVDADYRLFYVHRGLEKLAESRMDYNQVTFLAERICGICGYAHSVAYAMAVEAANRIEVPLRAQYIRTILLEVERIHSHLLNIGLAAHLVGFDSGFMHFFRIREKAMQMAEILTGGRKTYGMNLIGGVRRDILKEEKVQALRLISEIRSELKELIDMLLNTPNFISRTQGVGRLDPKVARNFGSVGPNLRGSGYGRDTRADHPYCAYKHVSWNVISKEGCDVLSRVLVRAEELFESLDIIERCLSDLPPGPILHEGFTYTPYTFALGYTEAPRGENVHWVMTANQHQVYRWRVRASTYNNWPVLRYMFYGNTVADAPLIVASIDPCYSCAERVTLVDVRKKRAKTVQYQELEQYCRERKYSPLKN

SEQ ID NO: 1259 - protein, 635 aa, Methanococcus maripaludis S2
MSAEDILNEIKAAVINKAPGNAVITDVEFEGSEVVIYAKNPELFSNNLIKEFARDFRKRLAIRPDPSVLVEPDIAKDKILKIVPEDAEITNCIFDANTGEVIIESKKPGLVIGKEGSTLEDIKKAIQWAPKPVRTPPIPSDTIKAIRATMYRERADVKDILRRIGRRIHRDVRLRDDSWVRTSFLGGSREVGRTCLYHQTPESRILVDCGINIAVEDEKAFPHFDAPEFSIEEIDAVVVTHAHLDHCGFIPGLFRYGYDGPVYCTKPTRDLMTLLQKDYVDITEKEGKNVPYSSKDIKNCIKHTIPLDYGVTTDIAPAIKLTMHNAGHILGSAIAHCHVGDGLYNVAYTGDIKFEASRLLEPAVCQFPRLETLIIESTYGGYDDVLPERDETEKEFLRVIAETIARKGKAIIPVFGIGRAQELMLVLEEGYNQGIFNAPVYLDGMIWEATAIHTAYPEYLSKNMRNRIFHEGDNPFLSEVFKKVKNTNDRRNIMDSDEPGIILTTSGMLSGGPSVEYFKNLADDEKNSIVFVGYQSEGTLGRKIQKGFKEIPLMGKNGRSKAVKVNLSVHTLEGFSGHSDRKQLIKYLRKLKPIPDRILTVHGEVSKCIDLASTAYKLFKKETKAPMNLDSIRLR

SEQ ID NO: 1260 - protein, 701 aa, Borrelia burgdorferi B31
MNKKIFYITILLHLPNLLFSYSTKYDIEVKMSAFVMSLAIIVISSISIGNLVAKIGIPKVIGQITAGIILSPNAFGKIQIPLLFPLGITQIGENYLINEKIFAISTIASIILLFTAGLETDLKLFIKFLPRGGIIGITEVVGTFTSFVLMASIIFNVPLISPTSLFIGIIGTPTSAGIAASILSAKKKMSTSEGVTIISTSIIDDVLSMLMLTSVITISRSISDLDIASSIKAIVQNIVIWLCLTFSLIYISETLSRLLKKLNSVTLATVITLSLALTIASIFQNLGMSFVVGAYVFGLAMSKTDIVYVIQDKLTIFERFFIPIFFTSIGLMSDINEILSKEVLILGLAISAIAIITKSIFCFIPALFLGFNKLGALKIATGMVPRGEVSLIMANVALSSGFISQKIFGIIIIMVFLPTIIATPIINFLFKINKSGLKKELPIDQNTHICVSFEYDNLAKILIWDFKNELRKEGFFTQQIKNDSSQYINARKNNISFSIKREGSKITFECPNNHLIIIQDLFRETILNLEKITKEVETVSLRAKKLDYSINYDKILSNINLNKRIKKENIILELKSSNKADVIRELLSVINIEIDKERIFQDLMEREKLITTALKEGFAIPHLKTNLISKIHIAIGISHEGIDFNALDKNLSHVFILILCPAKDYVSYPRILASVVGKVDLYKKEILNAKTDKEIYNIIVS

SEQ ID NO: 1261 - protein, 461 aa, Escherichia coli O157:H7 EDL933
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 1262 - protein, 648 aa, Musa acuminata
MSSPPPSPSATPPSTSPPPPTSLSPPPASNSPPPAPNAPPPTPPSPPPASPPPPTPPPPADVPPPPVVTSPPPPAPPPPSVSPPPPALSPPPASTPPRPPSASPPPAAAPPPPPPSATPPPTNSPPPPPSATPPPTISPPPPGSQSPPAPAPSNSTGGTPPAPPKPPSPPSPSPSASHRAPAYPISPSSNGSGIPTSDVGQKSGQSSGDGGMKAGPAVAVALVTAVVLLGLLGAITWIVRRKRRKPPANYESGFAMSSPYQSSVMSESSHQRSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDIQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDSRLEDAYDDTEMFRMIEAAAACTRHSAAMRPRMGKVVRVLDSLSDVDLHNGVKPGQSEVFNVGQTADIRLLQRLAFGSQEFSSEYSQSNWSRQSDL

SEQ ID NO: 1263 - protein, 390 aa, Desulfovibrio vulgaris subsp. vulgaris str. Hildenborough
MNISDRLTRIKPSATLAVNAKALELKARGVKVVSLAVGEPDFGTPAHICEAAKRAIDEGFTRYTPVPGIIELREAVAGYFGRCYGVEAPAEATIVTNGGKQALYNLFQALLNPGDEVLVPAPYWVSYPALVQLAEGVPVFVPSPAERGFKITPAELDAHRTPRTRVLLLNSPSNPTGACYTREEMDALMQWAVDHDIFVIADEIYDRLVYGDMQPVSVSGWWQRFPDRVAVVNGLAKTFAMTGWRVGYVLAHPDLVKAVAKIQGQSTSNICSIAQKAALAALTGPYDAVEEMRCAFVRRRDLAYDIISGWKDVVCPRPDGAFYLFADIHRHYNASMPDSAAVCTRLLEEAQVALVPGSAFGDDKCIRFSYAVADDVLEDALSRVAKVLFG

SEQ ID NO: 1264 - protein, 490 aa, Burkholderia xenovorans LB400
MTRTFELGELIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLCQGNLE

SEQ ID NO: 1265 - protein, 455 aa, Francisella tularensis subsp. holarctica
MDNNQDKLKRDILSRHIVMISLGGTISASFFLGIGSILNTVGAFGTVIGFFIGGIIMMLVMISLAEMAIEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQIPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 1266 - protein, 64 aa, Zea mays
  misc_feature (26)..(26): Xaa can be any naturally occurring amino acid
  unsure (1)..(64): unsure at all Xaa locations
MDGGGGGVGGGGVVAGVIGGRAESGXAGGVGGDVELVSKTLQFEHKLFYFDLKENPRGRYLKIS

SEQ ID NO: 1267 - protein, 472 aa, Anaplasma phagocytophilum HZ
MFLFTKDLLDYVEKHGIKFIDWRFTDLLGRWYHITHSTNFLDPGVFTAGVAFDSSSVPGWQPIEASDMLLVPDISTAFVDPFSAQATLSVICNVVCPGDRTDYSRDPRYTARKAHHYLVSKSIADKCFFGPEVEFFVFDRVRFAAESHNSFFKLTSVESSSGASKRFDSSHGYGLKERGGYLCSSPMDSSHDMRSEVLSMLDEVGVKPLLHHHEVASSQCEVGFHHNELVAAADSVQKCKYVLRNVVGSYGKSVTFMPKPVVGDNGSGMHCHQSLWKDGNNIFAGDNGTAGLSDTCLYYIGGILAHGKALNAFANPSTNSYKRLVPNFEAPTWLAYSHGNRSAAVRVPFVPSNSVAARRIEVRFPDPLANPYLCFASQLMAGLDGIKNKIMPPEVQGRSLYDMSEDEVRGLSSVCFSLEEALEALDKDRGFLVEGGVFTNDQIDAYIKLKRQEAHELRIHPHPVEFSNYYAL

SEQ ID NO: 1268 - protein, 205 aa, Pseudomonas aeruginosa UCBPP-PA14
MSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQRGLNKHNRRYLATKAGKLGHMLGSLHQGEAETT

SEQ ID NO: 1269 - protein, 382 aa, Mycobacterium avium subsp. paratuberculosis K-10
MQISGTLLLQLGALLATLAVLGAAARRFALSPIPVYLLAGLALGKGGLLPLATGGQFITTSAPIGVVLLLLTLGCEFSLAEFSSSMRHHLPSAAVDVVLNAAPGAIAGWLLGLDGVAILCLAGVTYISSSGVVARLLEDLHRLGNRETPAVLSVLVLEDFAMAAYLPLFAVLASGGGWLHAVVGMVVAVSALVAAFAASYRWGHHVQRLVEHPDSEQLMLRVLGITLIVAAMAESLHASAAVGAFLVGLTLTGETATRTRQVLAPLRDLFAAIFFLAIGYSVDPHELIPMLPAALILAAATAATKVATGIFAARHDGVARRGQLRAGTALIARGEFSLIIIGLAGSSLPAVAALATSYVFIMAIAGPVLARYTGPRPAAPAT

SEQ ID NO: 1270 - protein, 251 aa, Desulfotalea psychrophila LSv54
MKRKALIAGNWKMHMTVLEGCRLAAEIVASCKDYTDREVLLAPPCTIISEVSHILAGSKIILSSHNVCWEEKGAFTGEISPTMLQDAGASCAIVGHSERRQVFFESDEVINKRLKGALAFGLMGILCIGETLEEREAGNTQAVLERQVRKGLADVPASQMKQVVLAYEPVWAIGTGVTASKEQVQETHAALRQLISEIYEKDIAEGLRILYGGSVKATNVDELMSQQDIDGALVGGAALDSISFARIINFE

SEQ ID NO: 1271 - protein, 252 aa, Glycine max
  misc_feature (238)..(238): Xaa can be any naturally occurring amino acid
  unsure (1)..(252): unsure at all Xaa locations
FQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWETAYSYFYEAFESYDSIDSPXAITSLEYMWLGKSC

SEQ ID NO: 1272 - protein, 321 aa, Gibberella zeae PH-1
MPPPSANQQKVLIAQFVSLTGQTERQATRYLKNAGFKLNEAVDAFKMGWKGVKNRIATRVPIWSASKKASTDGPASFYQEPAAKPPKNSTSRYFASSGDSKGPSPLETKLDALFDQLQDTNDEKDKLELESTMSYLTDKLNVSIENAELLVALELLQAPAVGIITRRGYVDGWKVTGAGTTHQEHATHLRKLIKSLSSDQALFKKVYRHAFVAGRETDQKALSLENAFVYWEILFTPPGMEWKTSNHDWLQLWKDFLKAKWTRSVNKDMWNMTLEFALKSLSDESLSFWNEDGAWPSVIDDFVEWCRENGIAKTDGMDVDN

SEQ ID NO: 1273 - protein, 531 aa, Acidobacteria bacterium Ellin345
MKIVVAEKIAKAAIDLFKQDPTWNVVTPDQVAQKEQLLEQLKGADALIVRSAVFVDAAMLEHADQLRVIGRAGVGVDNIELEAATRKGIAVMNTPGANAIAVAEHTIGLMLALARFIPRATETMHAGKWEKKSLQGTELRGKTLGIVGLGRIGLEVARRAASFGMTLVAHDPYVSPAIAHDAKIRLADRDEVLAVADYITLHVGLTPQTANMINATTLATMKKGVRIVNCARGELIDDAALAEAVKSGHVGGAALDVFTEEPLKASPYHGVPNVILTPHIGGSTAEAQDAVGVQIAHQVRDYLQRGVVQNAVNMPSLTEQEYVALEPFITLGERLGSLLAQLAESRFEEIGIRYTGPLADWKTELIRNASIKGILQHTTDESVNVINANSVAETRGIRVHESKKEHPSSGAAANVLGLTVTTPKGTLSVRGTVLHGNSPRLLSFDNIDVEAPLEGTLLVIRNRDIPGVVGRVGTILGEHEVNIANFALGRPSGNSGGNAIAAVQVDGPLKEPVLQQLRQQKAILAANVVQF

SEQ ID NO: 1274 - protein, 280 aa, Leuconostoc mesenteroides subsp. mesenteroides ATCC 8293
MSLNELYELNDGHQLPKIGLGTFQIRGYQGVDQILNAIQIGYRLLDTSTNYDSEGAVGEAIRRSGIPRSQFYVTTKLPGKYHHFDDALKIIEESLLRLGLDYLDLYLIHWPLPKRDNYVEAWQALIEAQRRGLVRSIGVSNFEKEHLDKIISATGVTPAVNQNEIHPYWPQESLVATNQEYGIVTEAWSPLGRGSSELTEPLILKLAEKYDKNAGQIILRWHIQRGILPVAKSTTPQHQRRNLDIFDFTLTETEVSQISDLERKDGRVDDQDPKEYEEFV

SEQ ID NO: 1275 - protein, 481 aa, Roseovarius nubinhibens ISM
MRRHRNVKIVATLGPASETYETIRALHEAGADVFRLNMSHGDHAGIREKHRIIREVERDLNSPIAILADLQGPKLRVGTFGNGPEELAQGATFRLDLDKAEGDGSRVCLPHPEIFAALQPGAHLLVNDGKIRLRVRECGADFAECEVVIGGVISDRKGVNVPDVELPLAALSEKDRKDLEFVCQLGVDWLALSFVQRPEDVTEARELANGRAAILSKIEKPSAVERFSGILAASDGIMVARGDLGVELPVQNVPPIQKRLVRACRAAAKPVIVATQMLESMIESPMPTRAEVSDVATAIYEGADAIMLSAESAAGSYPVEAVRTMDNVAREVEGDPTYTQIIEASRKAQRNTVADGIVAAAREIAETADIKVICCFTQSGTTALLTARERPRVPIMALTSLRGTARRLALSWGVNCVMTEELTRFKLAVVNAARAARAEGYAEALDQIVVTAGVPFNVPGTTNILRVAPCQESLIYSTDPG

SEQ ID NO: 1276 - protein, 360 aa, Mannheimia succiniciproducens MBEL55E
MFYVDVKKYCGRIIQGWQSFGNGFFKKNFYFFELYDKKTSYIFSGKFMSSLLEILADGQPKTFKKLTALLSLSQAQLLDETERLQTLGIQIKASPQTLQLIPQLDLLDGARLSKALFPHRVVIQPVIDSTNQYILNHLAELKKGDLCLSEHQTAGRGRRGRQWLSPFAGQLILSIYWTLNARKPLDGLSLVIGMAIADAIKSAGGKEINLKWPNDLLLNGRKLAGILIEIANRQQDQLNLVIGIGINLSLPKLKAQIDQPWAELCEILPQLDRNELLIRVVKHLYLYLAAFEREGINAVFREKWAETDYYFNKEVNIITEKQTITGINQGIDENGYILIKTKNGELLKFNGGEVSLRKPA

SEQ ID NO: 1277 - protein, 281 aa, Oryza sativa
  misc_feature (32)..(32): Xaa can be any naturally occurring amino acid
  misc_feature (86)..(86): Xaa can be any naturally occurring amino acid
  unsure (1)..(281): unsure at all Xaa locations
MCNGKGIRECVQCAGECVIWQESIDEQPWEKXVRSSSPLKVKEDDEVDKLEIKINTSKRSRRTYPSPSPEVALKISRSLRLNNNCXSLNAKTGLFTKHMKIIHQDPKLHAQRVAAIKKTKGTAAARKHASETQKAFFSNPENRLKRSIAMKGVKFFCSKCGQEGHRSFYCPTVREISGRAHFRCRLCGGKGHNSRTCGKPKSENECQRQPRHCSQCGERGHNRRNCPRSTTVEVEVGASGYIVKQDNVHSSGIYSCSFCSAKGHNRRTCPKRKASIGQQKD

SEQ ID NO: 1278 - protein, 169 aa, Borrelia burgdorferi B31
MSMLLQKTLCIVKPDGVRRGLIGDVVSRFERVGLKMVAAKMLIVDESLAKKHYLYDDIVFRHSEAVWNSLIKFISNSPVFTFVVEGVESIEVVRKLCGATEPKLAIPGTIRGDFSYHSFKYSNEKGFSIYNVIHASANEADAMREIPIWFKDNEILNYKRDDECEHYYC

SEQ ID NO: 1279 - protein, 361 aa, Triticum aestivum
  misc_feature (180)..(180): Xaa can be any naturally occurring amino acid
  misc_feature (225)..(225): Xaa can be any naturally occurring amino acid
  misc_feature (309)..(309): Xaa can be any naturally occurring amino acid
  misc_feature (323)..(323): Xaa can be any naturally occurring amino acid
  misc_feature (345)..(345): Xaa can be any naturally occurring amino acid
  unsure (1)..(361): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSIDQNAQGLARYAIICQENGLVXPIVEPEILVDGPHDIDRCAYVTEMVLAACYKALNDQHVLLEGTLXLKPNMVTPGSDAKKVAPEVIAEYTVRTLQRTVPAAVPAIVFLSGGQSEEEATLNLNAMNKLETKKPWNLSFSFGRALQQSTLKXAWAGKVENEEKAQXAFLVRCKANSEATLGTYKGDAXLGEGASESLHVKDYKY

SEQ ID NO: 1280 - protein, 404 aa, Mycoplasma mycoides subsp. mycoides SC
MYLKVIRDNVHGDIYFDDVIYIQLINTYEMQRLRRILQLAGTQLAYSSATHTRFSHCIGTYYILKEFFKNKAFLKINSYEQKLVKIAGLLHDIGHGAFSHTFEKITHKNHEQYTSEIILNKKGNIYPILKKHHINPQDIVDIINGTYKNKIINLLVSSQIDADRFDYLKRDSISCGVDYATLDFKWMIRNTFIIGDKIVFPKKTIYAIESYLLGRYHMYQQVYNHKTSTIFDAMFISWFKRVTDLFNNDYKFKDNRIIELFSNLFYNKDIDLDSYLKIDDYLMFDIFKNCSSEKDVILSDLSKRLTDRKLFTIRDEKLINKTTIINKLNKLGLDPKYYLLETNIKPLSMYNPVIKNNKDENIYLYDSNNQQVHELSYYSKLVKFFQKSNSQKNLRKIIFPKEIV

SEQ ID NO: 1281 - protein, 342 aa, Oryza sativa
MAGGGVGASAAAAATIPEAALRSGKPMPLVGMGTASFPLDAPQLPATVRDAVLRAIDAGYRHFDTAAAYGTEAPLGEAVLEAVRAGMVASRDDLYITSKLWISDTHPGRVLPALRRTLRNLQMVYIDLYLIHWPIRLRVEQETPSPVYDNDFVMMDMEGVWKDMEECQRLGLTKAIGVSNFTCKKLNTLLSFATIPPAANQVEINPYCRQNKLREFCKEKEIQLCAYSPLGASGTIWGSNAVLDCPVLKHIAVQKGKTVAQVCLRWLHEQGDCIIVKSFNERRMRENLEIFDWELTDADRQEISALPEFRGNRDFYVHESGPYKTTDEFWDGEITGPQLKTC

SEQ ID NO: 1282 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 1283 - protein, 377 aa, Glycine max
MAHLALSQMAVTVPVGNDLSLRRSAVKAPNLNFWDKSWAPVFTLDLKPNNPSLRSRHVVCMSVQQASVSKVNVSPLELEDAKEPPLNLYKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFMESVPAYKFGGLAWLFLGVANTDSLLYDDEFSKYLKDYPDNFRYNRALSREQKNKSGGKMYVQDKIEEYSDEIFKLLDNGAHIYFCGLKGMMPGIQDTLKKVAEQRGESWEEKLSQLKKNKQWHVEVY

SEQ ID NO: 1284 - protein, 479 aa, Oryza sativa (japonica cultivar-group)
MGLSGDPSLARFERGRSAPCDAVGPLPSSPVARSRSSGATPASAAKPPLGGGRLRGASSDVSDATLEAVEEDPRCLIRNLDDGSEFLVREEFGLREVGTGRQLTMEEFELFIGRSPIVQELMRRQSVVNSNSNSNSQSGASTPIERSSSGSSNGGARYKRRNSWLRSLRSAAGSMVTYTRDRRSSDEKDTSSDKGGHRSSSATDDSQDGVANHGPDRVKVRQYGKSYKELSGLFMNQDIKAHSGSIWSIKFSPDGHFLASAGEDCVIHVWEVLEWKMIEEKGLEENGVFDPESMLVSTASEGSHREKKLRAKAVHNQRSVSSDRLMVPEHVFALSEKPVITFAGHSEDVLDLSWSKSQYLLSSSMDKTVRLWHVSSTYCLKTFSHSDYVTCIQFNPVNDKYFISGSLDKKVRIWSIQERKIVDWIDLHEMITAACYTPDGQGALVGSHKGKCHVYDISVCSREFFKGHHHICRFTNSSY

SEQ ID NO: 1285 - protein, 336 aa, Bacteroides thetaiotaomicron VPI-5482
MIKVGINGFGRIGRFVFRAAMKRNDIQIVGINDLCPVDYLAYMLKYDTMHGQFDGTIEADVENSKLIVNGQAIRITAERNPADLKWDAVGAEYVVESTGLFLSKDKAQAHIEAGAKYVVMSAPSKDDTPMFVCGVNEKTYVKGTQFVSNASCTTNCLAPIAKVLNDKFGILDGLMTTVHSTTATQKTVDGPSMKDWRGGRAASGNIIPSSTGAAKAVGKVIPALNGKLTGMSMRVPTLDVSVVDLTVNLAKPATYAEICAAMKEASEGELKGILGYTEDAVVSSDFLGDTRTSIFDAKAGIALTDTFVKVVSWYDNEIGYSNKVLDLIAHMASVNA

SEQ ID NO: 1286 - protein, 541 aa, Glycine max
MQRSREALLHRRRAKTGSGYKLSLSLLFLLWPLIFRAHGYPAPTESNWKQNKQGQCKTSNFANKCLLKETHDYILPDPEDAESVPNDSDTPTREDVQKSDHLPWAVPLGLDEFKSRAISSKINSGTAGSSGSVMHRVEPGGAEYNYASASKGAKVLCSNQEAKGASNILSGDKDKYLRNPCSAEEKFVIIEISEEILVDTIQVANFEHHSSNLKAFELLGSLSFPTDVWVFFGNFTASNVRHAQRFVLQEPKWVRYLKLNLQSHYGSEFYCTLSAVEVYGVDAVERMLEDLIHTQDNLYAPGDGDADKRTVSPHPNPPESEDVHQNNFGDPASDISSANHEKVNSNVPDPVEETHQQVGRMPGDTVLKILMQKVRTLDLNLFALERYMEDLNSRYVNIFKEYSKDMGGKDILIQNIKDGIRNLVDRQDAITKGASDLKSWKSHISMQLDHLLRDNAVLRSEVNEVRRKQTSLENKGVLVFLVCCIFSLLVILRLSLDMATSVYRVVLSVNRTDCSRKFCAVSSSWFLLLLNCIIVIFILTL

SEQ ID NO: 1287 - protein, 369 aa, Perilla frutescens
MAEAVTPGICTTGWRRGGVHAPTYNISIKPATALLVGCTTKTKSITSFSTDSLRTRGRARRPTMSLNAAAAEMETEMETLRKGIAEFYDESSGVWENIWGDHMHHGFYEPAADVSISDHRAAQIRMIEESLRFASFSPITTTEKPKNIVDVGCGIGGSSRYLARKYGAKLSRAITLSSPVQAQRAQQLADAQGLNGKVSFEVADALNQPFPEGKFDLVWSMESGEHMPDKKKFVNELVRVAAPGGRIIIVTWCHRDLSPSEESLRQEEKDLLNKICSAYYLPAWCSTADYVKLLDSLSMEDIKSADWSDHVAPFWPAVIKSALTWKGITSLLRSGWKTIRGAMVMPLMIEGYKKGVIKFAIITCRKPAS

SEQ ID NO: 1288 - protein, 244 aa, Deinococcus radiodurans R1
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDABVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 1289 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWESSLHSWIYE

SEQ ID NO: 1290 - protein, 240 aa, Glycine max
FLSISSTELSLKSVVYGELSETLGGLLKLTFAMAASTTSQVYIDVIEDVMVKVRDEFVNNGGPGEEVLKELQAMWESKMMQAGAVLGPIERSTAAKPTPGGPITPVHDLNVPYEGTDEYETPTADMLFPPTPLQTPIQTPLPGTGDNSTYNIPTGPSDYPSSGNDTGGNADGKGARPAPYMQSPSPWTNQNQNQNQRAPLDVNVAYVEGRDEAERGASNQPLTQVSILVRSFRKMICFQI

SEQ ID NO: 1291 - protein, 278 aa, Yersinia pestis biovar Medievalis str. 91001
MIRLIERSQRTCSLKYDGHIPNLIGVNVMAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 1292 - protein, 354 aa, Anabaena variabilis ATCC 29413
MSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAETFLSTGRYSWNSGMFVFRAGVVLKELYTYAPEIIEPLVEHGVDVYPQLPKKSIDYALMEKTNLVYVLPAEFGWDDLGDWNAIERLLKKPDDPNVELATHVGLDTQGAIVYATNPEDVIVTIGLEDVVIVRDRNVTLIVNKERTQEIKQIIKTLQGDPRFTDLL

SEQ ID NO: 1293 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGAIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 1294 - protein, 260 aa, Candida glabrata CBS 138
MSYTPLPNINDFPTLGNPLEDAKRAAAYRAVDENLNFDEHRIIGVGSGSTVVYVAERIGQYLKDEKYHDKVSKFICIPTGYQSRNLIQDNGLILGSIEQHPHVDIAFDGADEVDHNLQLIKGGGACLFQEKLVSTSAKIFIVVADSRKKSDTNLGINWKRGVPIEIVPSAWSRVQHDLTSILHANSAPVRQGGSAKAGPVVTDNMNFLIDADFGEIQDPKALHEQIKMLVGVVETGLFIDNAHRAYFGKPDGSVEVIDKK

SEQ ID NO: 1295 - protein, 485 aa, Prochlorococcus marinus subsp. pastoris str. CCMP1986
MINNLKSDLKLQPVILSGGKGSRLWPLSRECYPKQYLELYEGNKFSLLQNTFLRLNLLDNLEPPIIICNESQRFLVAEQMLKINVVPKSIIIEPVGKNTGPAVALAAIAANKKGQDPALLILSSDHVINDSKEFTATIIEGLIHAKQGKIVSFGVVPTYPETGYGYIESLEELTNFKKSSSIKRFIEKPEEDRAKQFIQSNLFTWNSGIFLFKASTIIQEFNRFAPEIIHICKKSIVSAVSDLDFLRLNNEIFQKCPNVPIDIAIMEKTDKGTVVRLNAGWSDIGNWESVWDNSTKDNERNSTKGNVLLMESHGCYLRSEKRLLVGLGLKDLIVIETDDAVLVINKSSAQKVKHIVEDLEKKNISEGKVNKKIYRPWGSYTSISNGITWQVKKLEVNPGASLSLQMHFHRTEHWIIVDGTAKVEINNHETILNQNESIYVPIQAKHRLSNPGNENLIIIEVQNGKYLGEDDIVRFEDIYGRKKDL

SEQ ID NO: 1296 - protein, 489 aa, Ustilago maydis 521
MDIPLSSDALDLCFHPAAETNLLAVGLISGKIQLINYDDYLSSPSSSRTPLAPPSKKSKPSTISSAVETPTKLYRKLYTSRPSKKSCRGLHFSTTGSSIFSISKDKSLFSTDTQTGKVVQSWIEVHDAAPSRVLPVDESLVVTGDDDGVVRLWDVRKGGGKGIKPVRMWEHHFDWITDMVYLADLPVPKPKSIKEAKKSKTQLKKQRRRARQAERLKEHDKEKREQNASDTEASEPDSEDDAAIKVESRSRLIVTSGDGSLSSIDLLSSGPTSFEQSEDQEDELLSITSIRSSTKLVVGTQLGILSLWTPSRGLLDHVDRVPGHPASVDTLVTLDNETVLTGSSDGLVRVVQILPSKLLGVIASHNGLPVERMKRKQSVLASIGHTNAVKLTDLSPLLDDNDDQGDDDDEQAGALGIVGLAEDDSDDDDDDDDDDDDDDDEKHLVVELDGAEQTDGDAESGQDDEQDPDSEDVTPSQNKAGKGGFFSDL

SEQ ID NO: 1297 - protein, 398 aa, Fucus vesiculosus
MALKKKEFEKKLQHFTINFGPQHPAAHGVLRLILELNGEVVQRADPHIGLLHRGTEKLIEAKTYVQALPYFDRLDYVSMMCQEHTYVLAVENLLQVSIPRRAQYIRVLFAEITRILNHLLAVGCHAMDVGAMTPFLWSFEEREKLMEFYERVSGARMHASYFRPGGVSQDISLGIVDDIYTFAGQFGQRLDEMEEMLTDNRIWQERLVDIGVVTAQEAVNWGFSGVMLRGSGVRWDLRKNEPYEVYSELNFRGVVGKTGDCYDRYLARVEEMRQSLSIIHQCLNNMPKGSVKIDDAKISPPSRSEVKQNMESLIHHFKLYTEGVSVPSGETYTATEAPKGEFGVYLVSDGSNRPYRCKIKAPGFSHLQGLNFMAKSHMLADVVTIIGTQDIVFGEVDR

SEQ ID NO: 1298 - protein, 658 aa, Thiobacillus denitrificans ATCC 25259
MHSGSSLQLVLILLAVAVLVAAAARALRLPTMLAYLVTGIAIGPFALGWIPDSDEARYLAEFGVVFLMFSIGLEFSLPRLMTMRMTVFGFGGAQVVLTIVLSAAVAWMLGLPPLAALAVGGIMSMSSTAIVSKMLTERLEVQTSHGRQIFGALLFQDLAVVPLLILIPAFAKESDAMAATLGLALLKATVVLGFLLFVGQRVMRPWFQWVAGHKSPELFTLNLLLFTLGLAFLTESAGLSLALGAFLAGMLVSETEYRYQVEDDIKPFRDVLLGLFFVTIGMRLDPTQVMLDWADVLMIVAAIVIGKGVLVAGLAMAFGSGRPTAWRTALGLAQAGEFGFVLLAQAADLRLLGVEVAQPLLAAMVLSMLIAPLLIHRMDTLTRLLAGSEWSGRAKEVHDISIKSFGKTRHVIVCGYGRSGQNLARLLEAEGITFIALDADPERIRAVAASGVSAVYGDASRREVLVAAGLSRAQAVVVTYSDVHSSMAILRHVRELRPEVPVIVRTIDDTHIDALKAAGAAEVVSEVMEGSLMLASHALMLLGVPLAQVLRRVRDVRDTRYALMRGFFRGASDVDHELDQQSQPRLNTVLITQGSAAAGHTLAELALDELAVEVVAIRRQGIKGVDPQPEAEIRVGDVLVLRGGAGGLAAAEFRLLQG

SEQ ID NO: 1299 - protein, 321 aa, Malus x domestica
ILPFKLPAIGPNDVRIRIKAVGICGSDVHYLRTMKCADFEVKEPMVIGHECAGIVDKVGSEVKHLVPGDRVAVEPGISCSRRQQCKGGQYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSIKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEASLEF

SEQ ID NO: 1300 - protein, 319 aa, Malus x domestica
ILPFKLPAIGPNDVRIRIKAVGICGSDVHYLRTMKCADFEVKEPMVIGHECAGIVDKVGSEVKHLVPGDRVAVEPGISCSRCQQCKGGQYNLCPDMKFFATPPVHGSLANQIVHPADLCFKLPENVSLEEGAMCEPLSVGVHACRRANVGPETTVLIIGAGPIGLVSVLAALAFGAPRIVIVDMDDKRLAMAKSLGADGTVKVSTKMEDLDDEVAKIKEAMESEVDVTFDCVGFNKTMSTGLNATRPGGKVCLVGMGHGMMTVPLTPAAAREVDVVGVFRCKNTWPLCLEFLRSGKIDVKPLITHRFGFTEKEVEEASL

SEQ ID NO: 1301 - protein, 523 aa, Rhodospirillum rubrum ATCC 11170
MTSQMPPFRRPRPVVLCILDGWGHRDDPTDNAIALANTPTWDRLMATCPHSLIATSGADVGLPAGQMGNSEVGHMNIGAGRVVMQDLPRIDAALADGSVAHFPALVRFIDALRASGGTAHLLGLLSPGGVHSHQDHIAKLARVIAAAGVPVKIHAFLDGRDTPPRSALGFLETFAAAAGPEAPIATVSGRYYAMDRDKRFDRVRLAYDVLVSGKGESAADAASAVSQFYDSKDKGDEFVLPTAIAGYDGMKDGDGVFMVNYRSDRAREITQALLDPTFDGFERQPPHFAGALAMTEYSTAHNAFMDVLFGPESLNNILGQVVSEAGMTQLRIAETEKYAHVTFFFNGGRETSFPGEERILIPSPKVATYDLQPEMSAPELTDRLVEVIDAGRFDVIIVNYANGDMVGHSGILEAAIKAVEAVDGCLGRVEEAVVRAGGTMLVTADHGNAELMRDPVTGEPHTAHTTGRVDLLLVNGPEGASLADGRLADLSPTLLALIGLPQPAEMTGKTLVAKAAVAVGASH

SEQ ID NO: 1302 - protein, 483 aa, Nicotiana tabacum
MDFIIYLFLSFSISLITFLLLRAAAAAHFRRRKTRLPPGTLGLPFIGETLQLISAYKTENPEPFIDDRVSKYGNIFTTHIFGEPTVFSTDAETNRFILQNEGRPFESSYPSSLQNLLGKHSLLLMRGSLHKRMHSLTMSFANSSILKDHLLADIDRLVRLNLDSWTGRVFLMEEAKKITFNLTVKQLMSLDPCEWTEKLMKEYMLVIEGFFTIPLPFFSSTYRKAIQARRKVAEALGLVVKERRKERGGGERLKNDMLEALFEGDGVEGFSDEVIVDFMLALLVAGYETTSTIMTLAVKFLTETPHALSLLKEEHEEIRLRKGDVESLLWEDYKSMPFTQCVVNETLRVGNIISGVFRRTMTDINIKGYTIPKGWKVFACFRAVHLDHEHFKDARTFDPWRWQSNAGSTSSPNVFTPFGGGPRRCPGYELARVELSVFLHHLVTRHSWVPAEPDKLVFFPTTRMQKRYPIIVQRRSLFDPCKE

SEQ ID NO: 1303 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 1304 - protein, 202 aa, Leuconostoc mesenteroides subsp. mesenteroides ATCC 8293
  misc_feature (179)..(195): Xaa can be any naturally occurring amino acid
  unsure (1)..(202): unsure at all Xaa locations
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLXXXXXXXXXXXXXXXXXRHSVSHM

SEQ ID NO: 1305 - protein, 298 aa, Zea mays
WIGKIIHLAPAAAAFCCTQVQSLILRCLQMYMDQKEVVDALSHHSKIEPCITELVWRQLEHQNPLFFKAYYMRLMLKTQIMVFNKLLQDQFEVINKEFSSGIPSMSLPNGSNSNLLKQNSCFLPETAPGSAMPDGIMHNGSSRGIINGTPSGDQLLNASKDLHGLHNGIDASTSLQSDQNAAAVLYGVDNETSATIKTESCYSSNADFAFCGNTFLESCQSIGDASGGGSFSSSELNGQPLNDSILDMESSSFSFLNQMPQSFIFPDLADDFNQSAEITPFLTPETNFSDSTGGDHTG

SEQ ID NO: 1306 - protein, 174 aa, Zea mays
  misc_feature (61)..(61): Xaa can be any naturally occurring amino acid
  misc_feature (120)..(120): Xaa can be any naturally occurring amino acid
  misc_feature (131)..(131): Xaa can be any naturally occurring amino acid
  unsure (1)..(174): unsure at all Xaa locations
MSARPSMSAVGHAAHTDSHMRPHTIHLDMVMYCNDCSGPFIINNPSGYQIILIGDFIRSLXKKKGFYLRAMKMMNVYRPFHQQHYAYLTDTPFLPSVGEYIISGLVKPMVYQAKDVWMTXGRYIIVANKPXEAHPSTIRTDYHAECGMKLIHGSDFKQNGKKEIALWLPVRLAQ

SEQ ID NO: 1307 - protein, 566 aa, Corynebacterium diphtheriae
MDTRDPHAWWRDAAIYQIYPKSFASSGGPMGTLRGITSRLDYVRDLGVDAIWLSPFYTSPQRDGGYDVADYFSVDPLFGSNADAEELISEAHDRGLRVIFDLVPNHTSDQHVWFREALQAGPGSPKRNHYWFREGKGPQGCEPPNDWLSIFGGSAWTQVCARDDAPDSPWEHDTSWYLHLFDSSQPDLNWSNKDVVEFFDSILRFWLDRGVDGFRVDVAHGLAKDPELPDWQFHWTMVDGGHDSPEDVPPPPMWNREEVHQIYRHWRTVLDEYPGNRALVAEAWVDATTDIAHYVQPDEMNQAFNFDFLICPWRSEDLGRVIHTSLEALAPTGSPATWVMSNHDVVRASSRLGLSTPGARPNGIRATDEQPDADLGARRARAAHMLMYSLPGSVYIYQGEELNLPEHTTLDDALRQDPTYFRTEHREAGRDGCRIPLPWTSQRPGLGFSPTGQTWLPQPEGWENRAVSHQESDPHSDLMLFRRMLQVRKSLNFGRGRLSPVWLKQDCLAYINSDDGRCDVMLIVAFDQDVAVPEGWHIALSTEECHDVVAANSAAWLLREGDSWHV

SEQ ID NO: 1308 - protein, 596 aa, Corynebacterium diphtheriae
MHPNCNDIAQPHPLLPMDINRALARNEPICRYFYPHTTTPTTPLVITSYLTTKNTSRELSTIESMTSKSLPTRTTLSSGTFYQIYPPSFADSNKDGIGDFRGIISRLDYLSDLGITGIWLNACFDSPFKDGGYDVRDYTKVASRYGTHEDLVELFHQAHARGIAIILDLVPGHTSEQHPWFQQSAASKYTDFDDRYIWTSHAFEGGAGLAFIGGEHPRNGAYIINFFKSQPALNYGFAELTQPWHQPVDAPGPRANQDAMVEIMKYWLSQGADGFRVDMADSLVKNDGTSKRATIGIWQSMLSQVRAEFPNAIFVSEWGTPTQAFEAGFDADFYLDWRGNGYNLLARNTDTPLERRDDASFFNSDSATGAQEFLDMYLPQWERTHEAGLFSFISGNHDCPRLAPRLNEQERALFFLFQLTMPGLPFIYYGDEIGLPYAEIPTKEGGYARTGSRTPMCWDSQLPNGGFSLGDAPLYLPMTDTSQNVAQQRERADSLFHHVQKLIQLRSQLPALDGFADLEFDLSLLKKHPKVMVYRRTHHHGDSVLIALNAGNKPIRVELQQPQAHELFRCGDVTYPDLSDHSVVELGPTSGVILSV

SEQ ID NO: 1309 - protein, 388 aa, Zea mays
MLMAQIHHGSERNLIPLPQETTTSARAVRHGRRAQRARLTEALRLKMDQVPIPLIEYSKNLLHSKYSSRREIQGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTNSVKSVDSNFSSTSRKDISEDTREFVGELNITVVKGTNLAVRDMLTSDPYVVLTLGGQKAQSTVKKSDLNPVWNEMLKISVPRNYGPLKLEVYDHDTFSADDIMGEAEIDLQPMITAAMAFGDTSRLGDMQIGRWFTTKDNALMKDSTVNVVAGKVKQEVHLKLQNVESGELELELEWVPIL

SEQ ID NO: 1310 - protein, 555 aa, Medicago truncatula
MAVSGRGSRGGSTLRGFFSYRIFISAMFSLLFIATLSVLFTTNPSTENDDSDLPTTGNAYVHRTFLALKSDPLRTRVDLIHQQAKDHISLVNAYAAYARKLKLDISRQLKMFDELAGNFSDIALKPTYRASLFESDGPIDEDVLRQFEKEIKDRVKIARMMIVEAKENYDTQLKIQKLKDTIFAVNESLAKAKKNGALASLISAKSVPKSLHCLAMRLMGEKISNPEKYRDESPRLEFEDPSLYHYAIFSDNVIAVSVVVRSVVKNAVEPWKHVFHVVTNRMNVAAMKVWFKMRPVEGGAFLEIKSVDEFTFLNSSYVPVLRQVEAAKMQQHYIENQGDKATNDARDMKLRNAKYLSMLDYLQFYLPEMYPKLRNILLLDDDVVVQKDLTGLWKIDLDGKVNGAVEICFGSFHRYSQYVNFSHPLIKETFNPKACAWTYGMNIFDLDAWRREKCTEHYHYWQNKNEDQTIWKSGTLPPGLITFYSTTKSLDKSWHVLGLGYNPSISMDEINNAAVIHYNGNMKPWLDIALNQYKNLWTKYVDSDMEFVQMCNFGL

SEQ ID NO: 1311 - protein, 497 aa, Salmonella enterica subsp. enterica serovar Typhi
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQTMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTESVVLKEEAAT

SEQ ID NO: 1312 - protein, 417 aa, Burkholderia vietnamiensis G4
MAEIKNYTLNFGPQHPAAHGVLRLVLELDGEVIQRADPHIGLLHRATEKLAENKTFIQSVPYMDRLDYVSMMVNEHGYVLAIERLLGIDVPERAQYIRVLFDEITRVLNHLMWIGAHALDVGAMAVFLYAFREREDLMDVYEAVSGARMHAAYYRPGGVYRDLPDAMPQFKASKIRNEKALAKMNEARSGSVLDFIDDFFTRFPKCIDEYETLLTDNRIWKQRLVGIGVVSPERALQMGLTGPMLRGSGIAWDLRKKQPYEVYDRMDFDVPVGVNGDCYDRYLVRVEEMRQSVRIAKQCIEWLRKNQGPVMTDNHKVAPPSRVGMKTNMEDLIHHFKLFTEGFHVPEGEAYAAVEHPKGEFGIYLVSDGANKPYRLKIRAPGFAHLASLDEMARGHMIADAVTIIGTQDIVFGEIDR

SEQ ID NO: 1313 - protein, 468 aa, Roseovarius nubinhibens ISM
MSATDLLKMIKDEDIEYVDVRFTDPRGKLQHVTLMSDQVDEDFLEEGFMFDGSSIAGWKSIEASDMKLMIDTDSAYVDPFYAEKTLCVHCSVVEPDTGEAYERDPRGTAEKAEAYLKASGIGDVAYMGPEAEFFLFDDVRFSNTINKVSYEVDAQDASWNSDTEYEMGNMGHRPGVKGGYFPVNPIDDAQDIRSEMLSTMKRLGMKVDKHHHEVASCQHELGLIFDSLTKQADELQKYKYVIHNVAHAYGKTATFMPKPIAGDNGTGMHVNMSIWKDGKPLFAGDKYADLSQEALYFIGGILKHAKSLNAFTNPATNSYKRLIPGFEAPVLRAYSARNRSGCVRIPWTESPKAKRVEARFPDPAANPYLAFAALLMAGLDGIKSKIDPGEAMDKNLYDLPAEELEGIPTVCGSLREAMEELKADHDYLLAGDVFTKDQIDGYIALKMEEIELYEHTPHPVEFGMYYSC

SEQ ID NO: 1314 - protein, 285 aa, Aspergillus oryzae
MSVVSLLGVKIQNNPAPFLAPYQFEITFECLEQLQKDLEWKLTYVGSATSSEYDQELDSLFVGPIPVGVNKFIFEAEAPDLKRIPTSEILGVTVILLTCSYDGREFVRVGYYVNNEYDSEDLSAEPPAKPIIERIRRNILAEKPRVTRFAIKWDSEESAPAEYPPDQPEADILEDDSAAYGAEEAELEAALVRELADAERDVKSEDHEMEGAEPAIKEEEEEDISDAESEDIEDESDDDEEDLDEEEAGDGDEDVEMGDDSEQKDDGPKADSTNQHSHQPEVMVH

SEQ ID NO: 1315 - protein, 251 aa, Burkholderia vietnamiensis G4
MSKQRTKRVIGNWKMHGRLAGNQALLNEVVQGADAVVAGTSIGVCVPFPYLAQVQAVLGGSRVAFGAQDVSAHEQGAYTGEVAAAMVAEFGAQYAIVGHSERRAYHGERNETVAAKAQRALAAGLTPVVCVGETLDEREAGTTEQVVGAQLDAVLAVLTADEAARIVVAYEPVWAIGTGKSATSAQAQDVHAVLRARLAAKGAAHVSVLYGGSVKPDNAEELFAQPDIDGGLIGGASLKAEDFLAICRAAR

SEQ ID NO: 1316 - protein, 317 aa, Yarrowia lipolytica CLIB122
MAKAPAKKFSGGAQRESAGGEQRKTAVFKMNTDLGQHILKNPLVAQGIVDKSDIKPSDTVLEVGPGTGNLTVRILEKARKVIAVEMDPRMAAELTKRVQGKPEQKKLEIMLGDCIKTELPYFDVCISNTPYQISSPLVFKLLNQPRPPRVSVLMFQHEFAMRLLARPGDSLYCRLSVNVQMWAKVSHVMKVGRGNFRPPPNVESSVVKIEVKNPRPPIDFNEWDGLLRVCFVRKNKTINAGFKTSAVLAVLEKNYQTWLSTQGEIIPEGSNLSDVVKQKINKILTDTGIGEMRSAKCDQTEFLTLLNEFHKAGIYFA

SEQ ID NO: 1317 - protein, 158 aa, Glycine max
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKATKSPKKTTQA

SEQ ID NO: 1318 - protein, 489 aa, Frankia sp. CcI3
MSRAPHVRSVAAPPSTAKTSDIKTSDRVPGSGEGPVEAIRRLRADPLTRLNELARAHGPVVRLASWPVSAFLVTDPDAIADALVSGHRAYAKGAVRRGAGSRRTVVQPLALLLGQGLLTSAGDTHRQQRRLLQPLFHKQRIAGYADAFAAIADKTADGWRDGQRLDVHTEMTEMTLAIVARTLFDVDLDSHVVDVIRAALDQNMPAARRAQLPGFTTLERLPLPAPRRRRDARNALDRVVHDLIADRRATGATGNDLLSLLLTARDADTGASMDDSQVRDEALTLLLAGHETTANALTWTFHLLGRDPEVLATLQAELDRVLGERRPTIDDLPQLPYTNAVISEAMRLYPPVWAMGRHLVEDRDVAGYRLPAGSTLVFSQWVVHRDERWWPRPELFDPIRWTGPDTADEPADAGPKMRPRFAYFPFGAGPRQCIGNTFAITEGVLALAAIARRWSFTPVPGLPVTPQPLVTLRPKDGLPMIAHGRYPNR

SEQ ID NO: 1319 - protein, 750 aa, Arabidopsis thaliana
MEEDRATMTGAVATRDSVEPSEDILICVDVDAESTVEMKTTGTNGKPLNRLECLKLAITRFIHDKLSRNSDHRFAFATLSQSAAWLKKEFSNDAKSAAASLREMSATRSSGPADLTFLFQEAAQEAKTSRAQNRILRVILMYCRSSVRPTHDWPINQKLFTLDVMYLHDKSGPDNCTHDVYDSLVDAIERVSEYEGYIFEGSHGLSQSVFRRMSTLLSHPPQRCAQVDLPKPPAKKPAVSCDKSASDSTKGAKQPLEKKPKTNTKRIHSLGKEKTSDFKKYDEKIVGSRVKIWWPLDRAYYEAVVISYCSAKERHRDKEANQTGCDEEASTMPQKKKAKTRKEQSTNKQSKMLSPFPPNVKKDDEVPQISRRQAEQVLSNCASQIKKYLTEAGKLSSVSLANPSDVVDSICGRAFDALKQEDVVANEKEDRQGPREAAVKACFFLPETSIETLKSFICKKKMNVILAYVGTISSMNENGHKILEMVQQPVAEEEDLAETKTKTYKRARVESSSVHKADGEMEKEAAEGEPSCRSHKSSAEPGDLQPKNLPEPCSVTQQLAKVKQSILDTVASVRQFRCELERKEQSIADTLSIVRQFRSEIEEKEDMLEASLLEIDVLGLSDNVMFGTNRGEDIGNQQNPQLKIIKWIANSTGILKLVGRLSNVVDNQREVIFLYSVITRSSLKTVDFLNVKSKTNSGSYRHHFFDDLTKFEVTAIANTDRFNQKKAPRNCIASITEVKESLLCPSGTTQ

SEQ ID NO: 1320 - protein, 363 aa, Acidobacteria bacterium Ellin345
MTDFPTDNAGIARSGQNRDAMEGTLTDERLGHLVRLLGDHPTVVMSGTKIADELGVSRSEVWRLIEHLRELGVQIEGHPATGYQLGAIPDLLLPEALEPQIKGTLFAHNVHHYFRIGSTNVAAMQAGAAGAPEGTVFVAEEQTAGKGRGGHSWHSVESAGIYCSVLLRPRVAPADALILALAAGVATADAIASVTGLAPDLRWPNDLLFGLKKFCGILTELNAEATRVRYVVIGVGINVNHQEFPEEISKVATSLRLESGRVWSRVEVAAALLKSLDRVYAELLRGGAEARRGMIARFQEMSSLAKDRRVFVEEDGGYAGTSAGLDERGFLQVSTNHGKSVRTVLSGGVRSIEDVEGIRQLHH

SEQ ID NO: 1321 - protein, 808 aa, Arabidopsis thaliana
MMELSLVRLWNTCFPSFFYISTVLFLLTGGGVYSHSEYLIGLGSYDITGPAADVNMMGYANMEQVASGIHFRLRARTFIVSEPQGKRVVFVNLDACMASQIVKLKVIERLKARYGDLYTEQNVGISGIHTHAGPGGYLQYVVYIVTSLGFVRQSFDALVDGIENSIIQAHENLRPGSIFLNNGELLDAGVNRSPSAYLNNPSKERSKHKYNVDKEMTLLKFVDDQWGPVGSFNWFATHGTSMSRTNSLISGDNKGAASRFMEDWYEQNTAERSYSEEFISDEIPRRVSSLIENHQDSHHELLELASYFESQPGKPVTRISSSARRVRSALRKADKPGFVSAFCQTNCGDVSPNVLGAFCLDTGLPCDFNHSTCGGKNEMCYGRGPGYPDEFESTRIIGERQFKMALELFNKASEQLQGKVDYRHVYVDFSQLNVTLPKKDGKSEVVKTCPAAMGFAFAAGTTDGPGAFDFTQGDDKGNPFWRLVRNVLKTPDKKQIDCHYPKPILLDTGEMTKPYDWAPSILSLQVLRIGQLFILSVPGEFTTMAGRRLRYAVKTQLKNSGNKDLSGEIHVVIAGLANGYSQYVTTFEEYQVQRYEGASTLYGPHTLSGYIQEFKKLSKSLVLDMPVQPGPQPPDLLDKQLSFLTPVMMDTTPSGDSFGDVISDVPKNLSLKRGNGQVTVVFRSACPRNDLLTEGTFTLVERLEQKDKTWTPVYDDDDLCLRFKWSRHKKLSSRSQATVEWRIPESASPGVYRITHFGAAKKLFGQRVQNGVKELMLRSLMESNIPFHVNVHIQFKYPGIGNYGCVSV

SEQ ID NO: 1322 - protein, 801 aa, Kluyveromyces lactis NRRL Y-1140
MQTTPVSEVPDPTDCLRLTPVNLKTLRSPLKQGQMNIETNDSLYKENFNLISRQLQNLLSELDVIYREVGYSNIEISRKEKQIFHNLSNSISKFFDEANAERDMLTKEYQVGQHSLQCMLNAINDPKGVYTIPDLFMRNSVLETSAQAIIDDNCSSPQRTSASLLNKLKTLNNVKVFVMNAYLPKFMDHLSTVMKLRHLMDKVPDMEDQILPANLALPTAALCDDFNTRIRTCKGDMQSLFKFFQEEEKAVFYQSFFSNLTSNCIHTLETLIKNYQEEYNRRLETYKELLNNLLQIADDLCIDIRSELPNELHIEISEDAKPTITWHAIESLQKSLKKCEYQRQNRLKERTELLRKCQVLWTKLKVPEQQQQKFIENNSDLSMRSLENLANELLKLEEMKKKLIKKLIQESWEKIKEYYKAMSFTMEEQEEFLTSFDNMSKESQSLEDDEHLLEYCESQIEDLKKKMDIYQPIWKLIESFDSLQKDKIRLDESTKDSSRLLARNSHKILLEEERTRKRISRHFPTIVQDLKEKLLQFQDVFGKPFLLNGEYFLDVVIQQEAELLSKYPKSRINMKPPSVKQDEIKKVVPKTPKASRVAGSTRLVKSVDKNKISKPVFTPRSRITIESTKKTNVLLPPPHISVKKDLSRIPTLDTRIGSLNCREKRKSIVKPKQLAPISSNLLNILKSTEKTHQPLAKLGDCSLNSFERNNMNVKDANGARYMATKLPSSPIKEPLGSVYSIIKSPEGKLKLNVCSNNGANNTNNGDSSFLNDDNFIEWKQSQLAKLNNANDENIDWDSSAF

SEQ ID NO: 1323 - protein, 445 aa, Arabidopsis thaliana
MEIDSEKIHERKQSDYNSLDERFEIQKEMYRGQQYSQIYFARLHLMRTLLYSLAPTWKSHLPVCKVLGLEKGKECIIVGTLFKHMKLKPCVLDEYSKERSVTPLVKPHNFMHPDDNLILEDESGRVKLAGSALSPAIYVTGVVVALHGKETNAGEFFVEDVLEAGLPPQIERPIDLQEDKYVVLLSGLCIGSKSANPLQFQLLVDHITGHLGDEEEQGLAAQIVHVVIAGNSFEFPRKLINGQVLITFNLASKDQSTLYEPIKELDIMLSQIAAGVSVDIMPGTNDPANFALPQQPLNRCLFPGSSPYNTFRSCTNPHSFDVDNIRFLGTSGQNIDDLGKYSEAKSKLDFVERTLRWRHLAPTAPNTLGCYPFTDRDPFLIETCPHVYFVGNQDKYDNRLIKGSEGQLVRLICIPKFCETGIAVAVNLRNLECHTLSFSTQINQS

SEQ ID NO: 1324 - protein, 199 aa, Ashbya gossypii ATCC 10895
MTQLKTFPSYGSERMVVEPVSDHRRRRSSSIISHVEPETFEEENDQQLLPNMNATWVEQRGAWGIHVVIIVLLKVFYNLVPGLSNEWSWTMTNMTYVVGSYIMFHLMKGTPFEFNGGAYDNLTMWEQLDNGMLYTPTRKFLISVPIALFLLSTHYTRYDLQLFVLNFVLTTMVAVVPKLPLTHRVRISIPGITGPAQIG

SEQ ID NO: 1325 - protein, 450 aa, Rhodospirillum rubrum ATCC 11170
MINEFEAWINEHGIAEVECLLSDMNGIVRGKVLPARKFLRSLEDNSLRIPSSVFLVTVTGEYPFADDNNTVVIDPDADLRPDFRTLCVAPGYRTPTAFVVVDAYKSNGIPLDLSPRQVLKRVLALYSEQGWKPVVAPEIEFYLTQVNADPDLPLSPPAGRSGRPETSPQPYGLEAITEFEDLIENIYEHAEIAGLQIDTLIHEAGAAQLEINFLHGDPITLSDQVVVFKRLVRQVALKHGVYATFMAKPMADQPGSAMHIHQSLVEIGTGKNLFVRDDGSDSPMFRHYIGGLQALLAQVTPLFAPNINSFRRMRPHHSAPINLECGYDNRSCGLRVPLSDPANRRLENRLPGADANPYLAMAASLACGYIGIMERIEPSIMVEGGNAYRRSRTLPRTLDEALDRLEKCTVIKNVLGEHFFEAFTMIKRVELDAFQDVISSWERNHLLLKV

SEQ ID NO: 1326 - protein, 368 aa, Zea mays
MDRELLETFDAAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSASASMKLEKRDVDVTGQKPNNAKVEKTTSNGSKAQSVKVERISKEVIRTPDAKRPASVPNGHPKLTSLVKCNDPTRDKIRELLAEAFVRVSRETSDDDRDEVRNILDEVEACDPYRVAVTVESALFERLGPSTGTHRAKYRSIMFNLRAENNTDFRRRVLIGLVAPERLPGIPPDEMASDARKQENMQIKEKALFDCERGAAPKATTDQFKCARCGQRKTTYYQLQTRSADEPMTTFVTCVNCNNHWKFC

SEQ ID NO: 1327 - protein, 459 aa, Kluyveromyces lactis NRRL Y-1140
MTETKKKHLFILVHGLWGNHKHMNSIKEMLEKTLDDIDDIVIFKPENSGYLKTLHGIRVVSYNVLDEICKFVLNYGPEKFDRVSMIGYSMGGLVSRFIIGKMVTECRDIFQHMEPMIFMTFATPHLGVNFYLPSDKTRRYVSRKILTSVLSGLGRTILGRSGAEIFISNKDDRILVDLSQGEYLYGLSRFHHRVCFANVKNDRTVAFYTSFITDSDPFIETGNNVRYHFNHNLPIDVSEYPVQPRVLDLDSLDPAVDRIKENETIVTLKERFSRILLIMALMTFFFPLVFTVNVIGTCYSYITTYHHHSLLRKGHWKLESGENGVFNTIMSSIRNVIGDAINDEQDSGKDQGSDWSIENNSLYHTLTNDSAQMNDVWKQFIRSHSKEWKHTKFPKLPFDESRATIYQNLTKLTWIRVPVYIKTLNAHDGIVARKGLDSATPYGVANVEFACELINHLLD

SEQ ID NO: 1328 - protein, 252 aa, Rhodopirellula baltica SH 1
MIVSTVRLPSVDSTNTWALNWLRSATDEQLERELPKVVIADQQTAGRGRHGKSWFASDDGLACTLITNASPELLSIAVGVALAEAIEMVAGPTTVHLKWPNDVWMNGCKVAGILIERHGDASHESDAVFAIGIGCNLGKHPELDQISGGVPPTSILNATGRLISKDQLLDTLGLHLLEVIGEVAEQPNDVVQRFENRNVLRGQNVRCMIGGQTVEGVCDGLHRDGSLVLRTASGLQTCSSGEVQQVRSRPLG

SEQ ID NO: 1329 - protein, 484 aa, Musa acuminata
MRLFSISSASFLLVLLFSCSLVRGGRSRELDREALRQQEADRVVGLPGQPPVSFRQYAGYVTVNESHGRALFYWFFEATHDVEKKPLLLWLNGGPGCSSIGYGAAEELGPFLMQKGVPELRFNQHSWNKGKKPIPKANLLFLESPVGVGFSYTNTSSDLQSLGDKITAEDSYIFLVNWLKRFPQYKSHDFYIAGESYAGHYVPQLSEKIFDENKKASKETYINFKGFMIGNALMDDDTDQTGMIDYAWDHAVISDRVYHDVKSNCNFGIEPATEACNNALREYFAVYRIIDMYSLYAPVCTSITSTRKSFQIEGAAPKLFSRYSGWHQKPAGYDPCVSDYSEVYFNRPDVQEALHANTTKIGYNWTHCSEVVTKWNDSPATMLPVIRKLINGGLRVWVFSGDTDGRIPVTSTRYTLNKLGMKTIQEWKPWYDRKQVGGWTIVFEGLTFVTVRGAGHQVPTFAPRQAQQLIHHFLANQQLPPSAF

SEQ ID NO: 1330 - protein, 254 aa, Rhodopirellula baltica SH 1
MSRRILIAGNWKMNMRAESGASLAKGIVDAVGKSPAVEVVLCPPSVYLSGVADAVVGTPVELGAQNLYAAEDGAFTGEVNASMLTDVGCRFVILGHSERRQLMGETDACVAKKLHAALAGNLVPIVCVGETLEQREADDTESVIETQIRGSLEGLDEARAANIVIAYEPVWAIGTGKTASKEQAEAVHAFIRELLGKMFSTEVAEQIRIQYGGSVKPGNAEELLSQPNIDGALVGGSSLKVDDFAGIIKAAPSA

SEQ ID NO: 1331 - protein, 126 aa, Triticum aestivum
PTRPPTRPPTRPLGSAGTERPRREGEEEAIANRAAMGVTKEDVEAAVAAALSPTHLVVTDTSGGCGASYEIEVVSVKFEGKRLLDCHRMVNTALAPLMAEIHAVSIKALTPAQAQPKPQPEPAAAA

SEQ ID NO: 1332 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYVIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVEVY

SEQ ID NO: 1333 - protein, 661 aa, Arabidopsis thaliana
MEEDRATMTGAVATRDSVEPSEDILICVDVDAESTVEMKTTGTNGKPLNRLECLKLAITRFIHDKLSRNSDHRFAFATLSQSAAWLKKEFSNDAKSAAASLREMSATRSSGPADLTFLFQEAAQEAKTSRAQNRILRVILMYCRSSVRPTHDWPINQKLFTLDVMYLHDKSGPDNCTHDVYDSLVDAIERVSEYEGYIFEGSHGLSQSVFRRMSTLLSHPPQRCAQVDLPKPPAKKPAVSCDKSASDSTKGAKQPLEKKPKTNTKRIHSLGKEKTSDFKKYDEKIVGSRVKIWWPLDRAYYEAVVISYCSAKERHRDKEANQTGCDEEASTMPQKKKAKTRKEQSTNKQSKMLSPFPPNVKKDDEVIYREVPQISRRQAEQVLSNCASQIKKYLTEAGKLSSVSLANPSDVVDSICGRAFDALKQEDVVANEKEDRQGPREAAVKACFFLPETSIETLKSFICKKKMNEQQRAAEVSTPELTCVPERGLNLEQSLSVCPHDSSVKSAISSMNENGHKILEMVQQPVAEEEDLAETKTKTYKRARVESSSVHKADGEMEKEAAEGEPSCRSHKSSAEPGDLQPKNLPEPCSVTQQLAKVKQSILDTVASVRQFRCELERKEQSIADTLSIVRQFRSEIEEKEDMLEASLLEIDVLGTTFLMI

SEQ ID NO: 1334 - protein, 471 aa, Bacillus cereus G9241
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKIAVVLIFIFAGFNYVKPENWTPFMPFGLDGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPILPALTVIFCLYLMLQLSGTAWISFGIWMVIGIAVYFLYSRKHSALNNSKDEEDVANL

SEQ ID NO: 1335 - protein, 613 aa, Oryza sativa (indica cultivar-group)
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNVDLAAATEHGCLVVNAPTANTVAAAEHGIALLTAMSRNIAQADASLKAGKWQRNKYVGVSLVGKTLAILGFGKVGSEVARRAKGLGMHVIAHDPYASADRAHAIGVELVSMEDALTTADFISLHMPLTPATNKMLNDETFAKMKKGVRIINVARGGVIDEDALVRALDSGIVAQAALDVFTKEPPAPDSKLVLHENVTVTPHLGASTVEAQEGVAIEIAEAVIGALKGELAASAVNAPMVPAEVLSELAPYVVLAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 1336 - protein, 273 aa, Ralstonia metallidurans CH34
MSYLLDPSRKTVTIPKLQAMREAGEKIAMLTAYDSSFSALLDLCGVEVILVGDSLGNVMQGQQTTLPVTLEHMVYHTECVSRGNQTALLVSDLPFGTYPTPEKAFESAAALMRAGAQMVKLEGGDWLAPTVKFLVERSIPVCAHIGLTPQSVHALGGFKVQGKTDESAAQLKRDALALQQAGAQLIVMEAVPAKLAAEVTAQLSIPTIGIGAGVDCSGQVLVLQDMINIYPGRKAKFVRNFMEGQPSIEAAIRAYVAAVKDGSFPAVEHTFSA

SEQ ID NO: 1337 - protein, 260 aa, Glycine max
MEQAGKQGIMVTSQSQNPIEQIQARFKELETGFRLWLSKQSLPVEAAVVTTTSAAQGAAIGAFMGTLTADASSTFPTPPPNASLNPQAMASLKQAQALAGGPLVQARNFAVMTGVNAGISCVLKRIRGKEDVQSSMAAAFGSGGMFSLVSGMGGPNQATNAVTSGLFFALVQGGLFQIGQKFSNPPAEDTHYAKTRHMLNNLGLQSYEKNFKKGLLTDNTLPLLTDSALRDVRIPPGPRLLILDHIQRDADLKEKRGRRK

SEQ ID NO: 1338 - protein, 837 aa, Pyrococcus furiosus DSM 3638
MIIGRGEERKEEIKLRVAEALKWDVGRGIVRFDKKYQRMLGVEPGDIVEIEGNRITAAIVANAHPDDRGLDIVRMDGYIRKNAGVSIGDYVTIRRAEVKEAKKVVLAPAQKGVYIQIPGDLVKNNLLGRPVVKGDIVVASGRSEFYTGTPFDEIFRGFFEMSMGFGELKFVVVSTVPRGIVQITYNTEVEVLPQAVEVREEKVPEVTYEDIGGLKEAIEKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKSRGKVIVIAATNRPDAIDPALRRPGRFDREIEVGVPDKQGRKEILQIHTRGMPIEPDYDKESVIKALKELEKEEKYEKSEIKKIIEEISKATSEEEVKEILKKHGKIFMDVRAKLIDKLLDELAEVTHGFVGADLAALAREAAMVVLRRLIKEGKINPEAESIPREVLEELKVTRRDFYEALKMVEPSALREVLIEIPNVHWDDIGGLEEVKQQLREAVEWPLKYPKAFKRLGISPPKGILLYGPPGTGKTLLAKAVATESQANFIAIRGPEVLSKWVGESEKRIREIFRKARQAAPAIIFIDEIDAIAPARGGYEGERVTDRLINQLLTEMDGIQENSGVVVIGATNRPDIIDPALLRPGRFDRLILVPAPDEKARLEIFKVHTRGMPLADDVDLKELARRTEGYTGADIAAVCREAALNALRRVVKSVPKEELEEESEEFLDKLIVTRKDFEEALKKVKPSVNKYMMEYYRQFEESRKRISGESMGREPDYFTG

SEQ ID NO: 1339 - protein, 278 aa, Xanthobacter autotrophicus Py2
MSESVLKSLSGPVVLLGAGKMGGAMLEGWLKLGLPAGKAVVLDPNLPADAAAALAARGVAVNPALADIPAPSVLLLAVKPQVAPDALPPLAPLVGAGTLVVSIMAGRTLAFMSAIFGAGAAIVRSIPNTPAAIGRGVSVCVPGANVSAAQRDLASALLGAIGIVEWIDDEALMDAATAVSGSGPAYAFLLAEVMAQAGAAAGLPPELAARIARATVAGAGALMDQSDLPAATLRQNVTSPGGTTAAALGVLMNETAGFGPLMVEAVAAATRRGKELAG

SEQ ID NO: 1340 - protein, 1024 aa, Oryza sativa
  misc_feature (844)..(844): Xaa can be any naturally occurring amino acid
  unsure (1)..(1024): unsure at all Xaa locations
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSRAAGIRHEVKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCPPPILHRDVKSNNILLDSDFEAHVADFGLAXKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVSDLVVPAESAEANEAKEQQQQQLNSPSSPPPDLISI

SEQ ID NO: 1341 - protein, 545 aa, Methanosarcina acetivorans C2A
MDVKMNEDTKELLSTISGIAEEEPELLSARENEIYLKISEAGFEDITPALAERKFSLIGLFCAEVFENTDGFTLFYAFKQAGKASVLVLVREPGKEKRVSSVAGIFPSASWFEREIRDGFGLDFAGALDNRRLFLHECYHEGFHPLQKAFKNGPVHPVETPSKEYKFRQVKGEGVYQIPVGPVHAGIIEPGHFRFSVIGEPIFSLEIRLFYKHRGIEKLAEGKSPSECVALAEAVSGDESMANATGFCMAVEQACGISVPERAERLRAIMLELERIYSLLGDLAGMAVDVGFALVASPFSILREEVFRQNEKLTGSRFLRGITVLGGLKKDIPDSALKELPAFLEKFSRAFESAYDRAMSSSSLIDRFATTGVIKKELVSPLNLTGPLARASGCPADTRIDRPYGAYRDFAPEPSVRKRGDVLSRFEIKADEIRASVNLILRLTENLPQEPVFAENREEAENIGQNSGKNGSSGVTGYSLALVEAARGQNLHWVYLKNGLIDRYKVRTASYCNWQAIEHAVIGNIVPDFPLINKSLNLSYAGTDL

SEQ ID NO: 1342 - protein, 531 aa, Kluyveromyces lactis NRRL Y-1140
MPQADGSLENKGAKIHLVVLVHGLWGNRSHMNEICNYLLSLNDSSAGHKSLNEMIVVHQTHLNEGYKTYDGIDVCGIRVSKEIKDQINHYGSDHVVKFSLIGYSLGGLICRYALGVLYQAQTFKKNDIELVNFITFCTPHVGVLAPGNNVAVNLFNIIVPLVLGNSGKQMFLKDKYNGYPLLYVMSSPSSVFYKALKQFKYRALYANIINDKRTAWWTSGISKNDPFFDVNERNGLGRFQFVQGYEPVILNHNSPLFIAPVADEMDSSYDELEELRKENEIDPQDYYFLNYWFSKMLRWIAVFINLIIITPLWFIWFIISGIMETCKSTVRATTFARKYSMYFITEVLDISTDRTESNDDTFSISSPTLFEPAESNYELRIEHSLTDQRDNLIESLFDAIERKETRTATVENINDKDSIYEHDPKVDVTIRELEQYSVEELISMKKPNVSSDNFNDEGELFKLLSNFSLNISKNQLDIIESLNKLSWSKFPIYIRKTPSTHAASIIRHADPNFVEGHIVLQHFVDNVFQLA

SEQ ID NO: 1343 - protein, 315 aa, Methanosarcina acetivorans C2A
MKKNSQNSVGSDGKSMSESSGNQDAQTGKEVAATKKWLSVKEAEALGYYDFMSYLGVPYYHTGGLVSTGKLAELCRIDSNKKVLMVGCGTGFSACYLARKIGCEVVGIDIAEVSIEEAKERARRQRVSDKAKFRVGDAYALPFEAGTFDAVVTESVSQFLDRKKAFKEFSRVLKPGGYIGINEMYKEEKIPPKTAEEIAHAEEVFREITGLPFSLPTPEEWKKGLEEVGLKEINVRKFRPSPSLGEIKTFIEGMEGIWNFTFHFAELMLKIGKYSLFSRKIRYRFKRLGEGKKILLRKKSTSKYAGYVLATGIKE

SEQ ID NO: 1344 - protein, 375 aa, Clavispora lusitaniae
MTSVKLAEKNFEQDKEFAKAMHGDSYKKRGISALMAKAKEASDVATNGYFKHWDGGVSEDDEKKRLDDYSSLTKNYYNLVTDFYEYGWGSSFHFSRYYKGEAFRQATARHEHFLAHKMNINENMRVLDVGCGVGGPGREICRFTDCTIVGLNNNDYQVERAQYYAKKYKLDDKLSYVKGDFMQMDFEPESFDAVYAIEATVHAPVLEGVYSEIYKVLKPGGVFGVYEWVMTDKYDENNEEHRKIAYGIEVGDGIPKMYKREVAEQALKNVGFDIEYEKDLADVNDEIPWYYPLAGEWKYVQTLSDCFTIFRTSKIGRTVTTNVVGLMEKIGLAPKGSKQVTGALEDAAVNLVAGGEQKLFTPMMLYIARKPLDAK

SEQ ID NO: 1345 - protein, 469 aa, Synechococcus sp. RS9917
MAPSLQRREADQRIQFILRLAIAAALGGFLFGYDTAVINGAVSSIQATFNASAMGLGLAVSSALLGSAAGALGAGWLADRIGRRRSMWLAAVLFIASAVGSALAPTLRDLVIWRVIGGVAVGFASVLAPAYIAEISPANLRGRTGSLQQLAIVVGIFIALLFDYVIVLATVDQEPLSSVGPLPAWRWMLMSELIPALLYGGMVLRIPESPRYLVQIGCIEHAREVILKTLGEPTQEVIDRIQASLGHRNGGQIQDLFSKRSLLLPVVWTGVLLAIFQQFVGINVIFYYSSSLWKAVGFSTTDSLSITVVTSITNVVTTFLAIATIDRLGRRPLLLAGSVVITISLGLMSWTFAGAPIVNGEPQLTGAASLVALISANVFVFAFGFSWGPVMWVLLGEMFSNRIRALALGLSATVNWLANFLISTTFPVLLQSSGPALAYGLYATAAAISFFFVLFMVRETKGRELEDMA

SEQ ID NO: 1346 - protein, 319 aa, Candida glabrata CBS 138
MSTLKLFILRHGQSDLNHENIFCGWIDAKLTDKGRSQAKNAGQLIAQHCKSNGITLPQIGFTSRLLRTEQTMDVILNELQLGKKDEVSGQFNNPVFVVFDYIYTLAEIRSYLLSEKEENPISNEIPVLRTWRLNERHYGAWQGQRKPKVLKEYGEEQYMYIRRDYNGRPPEVDLEKEMIQKHDLGAATGYEFKEPNRSLKYELEELNQNIKLPYSESLSDVVARLEPFLDEIILKVAKEFDLDSCLIVGHGSSVRSLLKILEGVSDEDIKGVDIPNGIPLVIELDKTNNFKFLRKYYLDPELAKINAEKVRKEGFEENP

SEQ ID NO: 1347 - protein, 219 aa, Shewanella sp. MR-7
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 1348 - protein, 489 aa, Magnaporthe grisea 70-15
MCVTYPYYQPERDIPSLRGKVVLITGGTIGLGKEAAAQLSQNGRPAQVWIAGRNAERAGAAIAEIRRRLRKKPGPMPTPHRAAPSSMAESESPFRSSNTSIASSVESTGSQPSTSSTTTGDQSGLQGSSSTGILDASSLRRNRSYIDVGSRSLRPDKVGRSLPDSASGSTTRSHLGVDDGGGKLPDETEVYFLYMDLANLDSVRDAASRFLACVDRLDILILNAAEVSVPSGVTAQGYERHFGTNHLGHALLIKLLMRLLVRTATCDSVGSDVRVICVSSFAHRFTPPEGIDFDSLKPDPSSFHDSASATGSTTNITQSDTNQPGQQGRDGGGGGRPATSGSSQRPTLRRRRSSHTGSGPSSRLLYGQSKLANILYARELAERCPLFTTVSIHPGIAKSEGNWRRGGSRVVGSGAVVERFEQWIVPVFGASIDEGAKNHLWAATGRGISNGQYYEPVGVPARPSGVGDDRVLSWKLWEWTQRELAGYSL

SEQ ID NO: 1349 - protein, 179 aa, Brassica napus
MHKLSRSNRDKVQQFVAITGASEKNALQTLKASDWQLEAAFDVFYSQPQPRSNADVRRLEELYNRYKDQYSDMILADGVSVLCSDLQVEPQDIVTLVLSWHMNAATACEFSREEFVGGLQALGVDSIKKLQEKLSFMRSELKDEQKFHEIYNFAFGWAKEKGQKSLALDTAIGMWQLLF

SEQ ID NO: 1350 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSEEVSEATRIQYGGSVKPNNIKEYMAQTDIDGALVGGA

SEQ ID NO: 1351 - protein, 346 aa, Rhodopirellula baltica SH 1
MKALLLTEYKNMQVTDVDEPEVGPDDVLVQVEACGICGSDIHGYDGSTGRRIPPLVMGHEAAGVVVQVGENVRDLELGARVTFDSMVSCGNCEFCREGHGNLCDNRMVLGVSCGDYRRHGAFAERISVPRRIVYRLPDTLPFEHAALVEAVSVAVHAAEVTPIKLGDTAVVVGAGMIGLLAVQAVRAAGATQVIAVDLNDKRLETAGTLGADVLLRADQVDVPEKVRELTGGRGADVALEVVGATPTVKTAIESVRKGGAVTLVGNVSPTIELPLQSVVTREIRLQGTCGCNGEYPQCIDLMNRGVINVEPLITAKISLADGPKWFDRLHAGDAEQMKVLVCPRSE

SEQ ID NO: 1352 - protein, 343 aa, Listeria innocua
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTICPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFIQVGLFAEKKNAIDEESIIQREIAYIGSRSQKPSSWILALDLLANGKINTDKMITKVYGLDDWREAFEAVMAGNEIKVLVKS

SEQ ID NO: 1353 - protein, 174 aa, Brassica napus
TAEILLDGDHPIERTLEVAEKVWSEVFFYLAQNNVMFEGILLKPSMVTPGAEHKNKASPETVAEYTLTMLKRRVPPAVPGIMFLSGGQSEAEATLNLNAMNQSPNPWHVSFSYARALQNSVLRTWQGKPEKIEDSQKALLVRAKANSLAQLGKYSAEGENEDAKKGMFVKGYTY

SEQ ID NO: 1354 - protein, 273 aa, Rickettsia akari str. Hartford
MLPSIAKHVASHQINPLKKHGQNFIFDSSLCDKIVRASHLAENSRVLEIGPGTGGLTRSILQKNPESLTVIETDERFIPLLNEIKEYYPNLNIIKQDALKINLTDLDYDKVTIISNLPYHIGTELVIRWLKEARLITDMTLMLQKEVVERICAMPSTKAYGRLSVICQLIAKVEKCFDVSPTAFYPPPKVYSAIVKLIPLANPPSIALINRVEKITTFAFAGRRKMIKSSLKNLVPNIHEVLTQLKINDNYRAENLAPQDYLRIAMSLSVNKL

SEQ ID NO: 1355 - protein, 350 aa, Listeria innocua
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIEPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 1356 - protein, 279 aa, Gluconobacter oxydans 621H
MSSQVPSAEAQTVISFHDGHTMPQIGLGVWETPPDETAEVVKEAVKLGYRSVDTARLYKNEEGVGKGLEDHPEIFLTTKLWNDEQGYDSTLRAYEESARLLRRPVLDLYLIHWPMPAQGQYVETWKALVELKKSGRVKSIGVSNFESEHLERIMDATGVVPVVNQIELHPDFQQRALREFHEKHNIRTESWRPLGKGRVLSDERIGKIAEKHSRTPAQVVIRWHLQNGLIVIPKSVNPKRLAENLDVFGFVLDADDMQAIEQMDRKDGRMGADPNTAKF

SEQ ID NO: 1357 - protein, 559 aa, Solanum tuberosum
MGSSGDAWKLKDHPKLPKGKTVAVIVLDGWGEAKPNEYNAISVAETPVMDSLKQGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRIRVHALTDGRDVLDGSSVGFMETLENDLAKLREQGVDARVASGGGRMYVTMDRYENDWDVVKRGWDAQVLGEAPHHFKDPVEAIKKLRQEPNTSDQYLAPFVIVDDNGKPVGPILDGDAVVTFNFRADRMVMLAKALEYEDFDKFDRVRVPKIHYAGMLQYDGELKLPNKYLVSPPEIDRTSGEYLVRNGVRTFACSETVKFGHVTFFWNGNRSGYFDEKLEEYVEIPSDSGITFNVKPKMKALEIAERTRDAILSHKFDQVRVNIPNSDMVGHTGDIKATIEACKAADDGVKMILEAIEQVGGIFLVTADHGNAEDMVKRNKKGEPLLDKNGNIQILTSHTLEPVPIAIGGPGLLPGVRFRTDLPTGGLANVAATFMNLHGFEAPSDYEPTLIEVVDN

SEQ ID NO: 1358 - protein, 294 aa, Cryptococcus neoformans var. neoformans B-3501A
MTTPSPESKSEMMFLGQECNHPACYLHDFLPFNCPACLLAFCQPHFLPSQHSCKAPLPASMVDRIAPTCPMCNEIVPYPKSMDPNEAVERHILSGTCVGLQGGEERKKAEAKRRRDAGEVCWKKSCGKVLVVKMKCESCQHVYCPTHRRPTTHTCSNQTPSPSSSSSRLGTPQTQATSRPAGKAALSRLLPPSMQPPASTGASRPVPPVKANSSNPNSSASKPLAASSEGNLGSNLDAKAAAAAAALKRAGQDVKVPFVKSSAEKRTQAETNSQIQALKARHEKGLLTKTEQVR

SEQ ID NO: 1359 - protein, 271 aa, Francisella tularensis subsp. holarctica
MNKTQLQILTFLDDEKYVIGEDIAQKLGISRAAISKNIKALKDSYQITVSSNSRVGYRLQKKLDLIKVDELAKFFKNINYFYSVDSTSKYAIENQANFSESAIFISEFQTDGFGRFKRRWISPFGKNIYCTMLEIVELDISKLNGLSLVVGISIARVLKNINLNAKLKWPNDIYVDDKKIAGVIINVSAEINGRAKLFIGFGINVNMQYNEEISKDWTSIKLQSQRHANRTNLTIQIVKAIKEDLSVFIDKGFTHFKNEFESLNYLKDKVF

SEQ ID NO: 1360 - protein, 294 aa, Aspergillus oryzae
MLQGIPGPQQVLSALTGTLGLSSLLGPGIESSQNSFQHCSKAELSCATPYHGQDKCCFNYPGGQFLQSQFWDADPAIGPEDSWTIHGLWPDYCNGGYPQFCDSKRRYSNISLILTDSGRGDLLDEMRIFWKDWKGDDPNLWEHEWNKHGTCISTLETHCYDIYYPQQEVVDYFDKTVELFHGLPTHEILAGAGIVPSYTETYSLSEIHDALVKAHGAEVVVRCRHHNLNEAWYFFNVAGPLQTGKFIPANPDGQTSNCPSKGIRYQPKTPRKDEPTKTRGPSEPTSTGTQLSSV

SEQ ID NO: 1361 - protein, 336 aa, Buchnera aphidicola str. APS (Acyrthosiphon pisum)
MVKNMTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 1362 - protein, 441 aa, Oryza sativa (indica cultivar-group)
MAKQWWQDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 1363 - protein, 477 aa, Helicobacter hepaticus ATCC 51449
MTISILCGGSGTRLFPLSRELLPKQFANLLPSKNAQTSSHSLFQETLLRNDFLRKSHKGKFQIITNDNHYFIAQEQAHKINIPLSEFILESLGKNTAPALTFAALKSLESFSLNQNEDDIILALPSDHLIKNTADYEQSIFQAIELAQKGFLVTFGIKPNCPHTGYGYIKAKDSVVEKFIEKPSIKDAKAYVENGNYLWNSGMFCFKAEVFLQELEVHNPEVYKRCKLTFEASKESEAKDFIRLDAKMSENLPDISIDYALMEKSQKVACVSSNFIWNDIGSFESLSNEYPTDEAENASKNTFIQKECKNNFVISDKLVAGIGLEDLMIIDENDCLLIAKKGYSQQVKDIVALLKTTHPELTQIHKTAHRPWGTYTILLESQNYKIKQIVVKPKGKLSLQKHYHRNEHWIIVSGCAIITLGESQKFLKANQSTYIPMGEVHRLENPGILPLVLIEVQMGEYLGEDDIVRLSDDYQRK

SEQ ID NO: 1364 - protein, 137 aa, Helicobacter hepaticus ATCC 51449
MEQTLSIIKPDAVKKGVIGKIIDRFESNNLRICAMKKLQLTRCDAEAFYAIHKERPFFKDLVDFMISGPVVVMVLEGNNAVMKNRDLMGATNPKEAEAGTIRADFAQSIDANAVHGSDSLENAKNEIAFFFSTREIC

SEQ ID NO: 1365 - protein, 231 aa, Buchnera aphidicola str. APS (Acyrthosiphon pisum)
MKINQVVLIRHGQSEWNTLNKFTGWHDAELDKKGKDEAKFAAILLKKEKFFFDCAHTSLLKRAIHTLQYILDELNQTWLSVKKSWRLNERHYGALEGLNKDEVIEKYGQKQVLLWRRSFDISPPQINIKDKRFPGNDPRYSHLNIHDIPLGESLEKTAKRVIPYWNKIVYPELKNNKKILIVAHGNSLRALIQHLYKIDNKAILDLNIPTAQPIILDFDNEKNPIKWHYLT

SEQ ID NO: 1366 - protein, 122 aa, Desulfovibrio vulgaris subsp. vulgaris str. Hildenborough
MSKHILIVDDSKTVRNLVAFIMKKEGFKVTTAEDGLDGLEKLYSSEGVDLIISDVNMPRMDGFTFIKTVREQDTYRNLPIVVLSTEGQEKDIQMGMSLGANLYMVKPAQPEKMVKNIKMLLG

SEQ ID NO: 1367 - protein, 722 aa, Mycobacterium avium subsp. paratuberculosis K-10
MTGSGSARQLTLTARLNTSAVDSRRGVVRLHPSAVAALGIREWDAVSLIGSRTTAAVAGLAGPEIPSGTVLLDDVTLSNAGLRDGTAVVVSPVTVYGARSVTLSGSPLTTRSVSPVTLRQALLGKVLTVGDAVSLLPRDLGPGTSTSEATRALAAAVGISWTSELLTVTGVDPDGPVSVQPNSLVGWGAGAAPAAASRASVEEARPQTVVEELKGCQPQAAKLVEWLKLALDEPHLLKTLGAATFLGVLVTGPAGVGKVTLVRAVCGDRRLVTLDGPEVGALGADDRLKAVASAVQTVRDGGGVLLITDVDALLPATAEPVASLILAELRGAVASEGVALIATSARPDQLDARLRAPDLCDRELSLPLPDAATRKALLESLLRNVPTDGLDLDEIASRTPGFVVADLAALIREAALRAASRASSDGRPPALHQEDLTGALSVIRPLSRSAAEEVSVGDITLDDVGDMAQARQALTEAVLWPLQHPDTFARLGVQPPRGVLLYGPPGCGKTFVVRALASTGQLSVHAVKGSELMDKWVGSSEKAVRELFRRARDSAPALIFLDEVDALAPRRGQSFDSGVTDRVVAALLTELDGVDPLRDVVVLGATNRPDLIDPALLRPGRLERLVFVEPPDAAARREILRTAGKSIPLSADVDLDELAAGLDGYSAADCVALLREAALTAMRRSIDATDVTAADLAAARENVRPSLDPAQVASLRAFAEAP

SEQ ID NO: 1368 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 1369 - protein, 302 aa, Haemophilus influenzae R2866
MMNFTLLTYLSDCQPKVRSELEKFSKNLEEEIQQLREIGLDILVDGQDYRLVSMLPLLNPQQISTALFPYSIHYQPIISSTNEWILQNILSLKKGDLCVAEYQTAGRGRRGRQWLSPFAGQIMFSFYWTFDPKKSIEGLSLVIGLAIAEVLNVQVKWPNDILFDERKLGGILVEIANHKNGMLNLVIGIGINVSLSKQTEISQPYAEVCEIDPDVERQTLLPKLIQHLYTRLNIFEKNGINTEFQQAWQSYNAFSNSEVKVLTEQGVISGIEKGIDERGYLKVLCGNKIQMFNGGEVSLRKK

SEQ ID NO: 1370 - protein, 458 aa, Gloeobacter violaceus PCC 7421
MSLPPGPSSPSPFQLMQWIGCPTDYLHTTAARYGDPFTMRVGVFPPLVMFSDPRAIQQLFTAEAGTFDAGASNVALRPTLGANSLLLLDGERHQQQRRLLTPPFHGERMRAYGELIRQVTEEVIVRWQPGKPFLVRNAMQRISLAVILQAVFGLHDGTRLVRLRQALGSMLDAMSSPLSMAMLLMLPEDFGPWSPRARLQAHLGAIDELLYAEIRERREHFDAGAGDILGLLLAARDEAGAAMGDAELRDELMTLLVAGHETTATAMAWALYWIHYLPQVRERLLAELDSLGSDPDPEAIARLPYLGAVCSETLRIYPVALIASPRVARHTVRILERDYEAGTRLAAGIYLAHHRPETYPEPERFRPERFLERTFSPYEFVPFGGGSRRCIGMAFALYEMKLVIATVLLERDLRLVQPRLLRPVRRGVTLAPPEGLYLVPTGERSASRLLSRTSTAGQ

SEQ ID NO: 1371 - protein, 513 aa, Fusobacterium nucleatum subsp. nucleatum ATCC 25586
MQKHNIKRDCCKLLYLLICNSLFYRRSIMGVKVVKDLVYSYIEIDESVQKLIDTASFQRLKRIKQLSSSYIFPSTNHTRYEHSIGVMHLACNFFEVLEKDFRKYGLTEDRISYLRLHIKLAGLLHDVGHPPFSHLGEKFLDKNEIIACIKNEYSHLVDVDKTFYNNGRLIGKEHELLSCYCILRKFYKILKEEIDKNIDVAFICRCIIGNTYPDSENWDKNICVRIISSDSIDVDKLDYLTRDNHMTGEIAPKMDIKRLLACLTITENKELKYVAKAIPAVQTVVDSRDILYLWVYHHHISIYTDYIIGRILKRCMTLYDEHRGQALEEMNREEYFSPKAITDYLITDDDIYSHLRKIYVLSLEGKVDDFNTIIIKQIFERDFLKPLWKTIYEYKDFEKNLVDKKIIKSYDELEDILKNEKNIEDITNTLLKKLNLKEGEVFIITKYNKFYNSNKEAPISLLLNGEERKLSDLLPQKEFGKFHTMAFFVFVPKKYKKEAKEIVIEELQKISQT

SEQ ID NO: 1372 - protein, 458 aa, Gloeobacter violaceus PCC 7421
MSLPAGPASPPPLQLLQWIGRPTDYLERTARRYGDPFTMRLGLHSPVTGVFFSSPEAFQQLFNTEPGLFDSGGANASSTFNLLFGTNSLILLDGERHQQQRRLLTPPFHGERMRSYGELIRTLAEQVTARWNLGTPFQARRSMQRISLGVILKAVFGLHDGTRYLRVCRLLGNLIDASASPLLFGLRLIFPQDAGPMSPMGQLKAQIDAIDELLYAEIRERRERPDPRADDILSLLMAARDEAGQGMGDVELRDELMTLLVAGHETTATAMAWALYWIHRLPQVRERLLAELDSLGSDPDPEAIARLPYLGAVCSETLRIYPVAMVAFARVPRRPVRILDREYPAGTFLIPNIYLAHRRPEAYPDPERFRPERFLERTFSPYEFVPFGGGSRRCIGVAFALYEMKLVLATVLSRVELRLADPRPRLPVRRGLTLAPPEDLHLIPTALRSGHRDLLPAC

SEQ ID NO: 1373 - protein, 469 aa, Streptomyces avermitilis MA-4680
MFQNADEAKKYIADEDVKFVDVRFCDLPGVMQHFTIPAEAFDPAEELAFDGSSIRGFQAIHESDMALRADLSTARVDPFRRDKTVNINFFIHDPITGEQYSRDPRNVAKKAEAYLASTGIADTAYFGPEAEFYVFDSVRFKTAENESFYHIDSEAGAWNTGAIEDNRGYKVRYKGGYFPTPPVDHFADLRAEISLELANSGLQVERQHHEVGTAGQAEINYKFNTLLAAADDLQLFKYIVKNVAWRNGKTATFMPKPIFGDNGSGMHVHQSLWANGDPLFYDEAGYAGLSDTARYYIGGILKHAPSLLAFTNPTVNSYHRLVPGFEAPVNMVYSQRNRSAAMRIPITGSNPKAKRVEFRAPDSSGNPYLAFSALLLAGLDGIKNKVEPAEPIDKDLYELAPEEHASVAQVPTSLPAVLSALEADHEYLLQGNVFTPDLIETWIDYKRTNEIAPLQLRPHPHEFELYFDV

SEQ ID NO: 1374 - protein, 557 aa, Chlamydomonas reinhardtii
  misc_feature (537)..(538): Xaa can be any naturally occurring amino acid
  unsure (1)..(557): unsure at all Xaa locations
MAHDYKLKAHPAIPAPEGPLLVCILDGFGENEYKDEFNAVHVAKTPTVDALRAVPHRFRSIKAHGKAVGLPSDADMGNSEVGHNALGSGQVVDQGARLVDLALETGRMFSDPGWKLISEAFPSHTVHFIGLLSDGGVHSRADQLHGCLRGAVERGAKRVRVHILTDGRDVPDGSSIRFVEELEAVLAELRGKGCDIAIASGGGRMQVTMDRYEADWSMVKRGWDAHVLGKAPHYFKDAKTAVTTLRGSEDAPVSDQYVAPFVIVDEADKPVGTIEDGDAVVLFNFRADRMVEISKAFEYEDGFTAFERERFPKGLRFVGMMQYDGDLKLPANFLVPPPLIEHVSGEYLCKNGLSTFACSETQKFGHVTFFWNGNRSGYLDAKQEQYLEIPSDKIEFNKAPDMKAREITAAGIEALKSGKYKVVRINYANPDMVGHTGDMAATVRACETVDGCVKELLEVVDSLNGRWIVTSDHGNADDMVQRDKKGKPLLGEDGKPLPLTSHTLAPVPFFIGGKGLPDGVVLRDDLPDAGLANVAAXXFNLLGFEAPGIYKPSMVKA

SEQ ID NO: 1375 - protein, 549 aa, Musa balbisiana
MDNDNDNDAYVVATSSLKLSMPDSDLYKDARISPVSLTYYGLCLLEGNYSVKLHFAEIKITNDGYGSLGKRIFDIYIQGNLVWKDFNIRDEANGSGNAIIKSTNVMVTDKLEIHLYWAGNGTQSLPVRGTYGPLISAISVEPNFSLSSGRHTKIIVGIIVSVSCLIFLLLSILWKKGWLGGQTAKDREMRALDLRTGRFTLRQIKMATRNFSASNKIGEGGFGPVYKGLLPDGTIVAVKQLSSKSKQGNREFLNELGMISALQHPNLVKLHGCCIEGNQLLLVYEYMENNSLARALFGSEEYQLKLDWSTRKNICIGIAKGLAYIHEESRLKVVHRDIKATNILLDKDLNAKISDFGLARLDEEENTHISTRIAGTVGYMAPEYATRGYLTEKADVYSFGVVTLELVSGTSVMSFRKEGSMHLLDWVQILREEGKLEKFVDPRLGTDFNMEEAILLINVGLLCINSSPVPRPPMSAVVSMLVEAQTSTVDATPEQIFSTDDFEIQVSGKRYPSSGDSQTKSFLVEGSVHGSTTSSSDLYPLNLDSLYRN

SEQ ID NO: 1376 - protein, 391 aa, Magnetococcus sp. MC-1
MAYQPDRSQYPQRRVDGRLDIDLASGKYLKLWHGPQHPGITGNMSVELTLCGDEIVDAKTHVGYLHRGFEKLMERRTFIQCFPIVCRVCVPEPDFNEYCYAAAVEELAGIECPERARWIRTLILEMGRINSYLMYLGGQSGAFGMGVIGQWTTYIRDLMLDRFEELTGARIYHMFILPGGVRDGLPEGFEQRMEETLRELESTMKDVRDVLFHNAVFKKRSVGVGVIDPAWLEPYGVTGPNARAAGVAKDVRIDQPYLVYPELSYEAIVGKDSDIYTRADVRYRDLLQSVDLIRQILARMPHEGPVMAKLPNVLHWKIPQGETYIRGECSRGEYGYYVVTDGSGYPRRINVRGPSYTHAVALLEHMIINQNISDVAGLMVSLHTYPPEVER

SEQ ID NO: 1377 - protein, 472 aa, Gluconobacter oxydans 621H
MSDTVLNPSPVPSAAVAKAPMVGRMMFAVALAAIAGLMFGLDVGVISGALGFIRDEFHASEFEQSWIVSSMMFGAAVGAVGAGRMSYAFGRRRSLIFSAFLFVAGGLVCALASSVSELIIGRTMLGLAIGIGSFVAPLYISEVSDISRRGSLVSMYQLMITLGILLAFVSNAILSYSGSWRWMLGIMAIPGTFFLIGSFFLPDSPRWLMLRGRHEEALSIMKELRHNPELAHQEIRDIQGQIHDRQRGLAMFLENRNFRRAVLLGIVLQVMQQLTGINVVMYYAPRIFQEVGFGSSGQMWGTAIVGVVNWLATFIAIAFADSWGRRPMLITGFAIMSAGLAVLATIMSGAVGNTDLSHYLAISVLLCFIAGFAFSAGPLVWVLCSEVMPLQGRDFGITCSTVTNWVTNMVVGATFLGLLTTLGASHTFWLYAGLNALFIFMVLFFVPETKGVSLESIETKLNQGVTLRNIGR

SEQ ID NO: 1378 - protein, 355 aa, Lycopersicon esculentum
MGKGGSDENMAAWLLGVNTLKIQPFNLPALGPHDVRVRMKAVGICGSDVHYLKTMRCADFVVKEPMVIGHECAGIIEEVGGEVKTLVPGDRVALEPGISCWRCNLCKEGRYNLCPEMKFFATPPVHGSLANQVVHPADLCFKLPDDISLEEGAMCEPLSVGVHACRRANVGPETNILVLGAGPIGLVTLLAARAFGAPRIVIVDVDDYRLSVAKKLGADDIVKVSINIQDVATDIENIQKAMGGGIDASFDCAGFNKTMSTALGATRPGGKVCLVGMGHHEMTVPLTPAAAREVDVIGIFRYKNTWPLCLEFLRSGKIDVKPLITHRFGFSQEEVEEAFETSARGGDAIKVMFNL

SEQ ID NO: 1379 - protein, 578 aa, Xanthobacter autotrophicus Py2
MSDAFLKDAFVYLLAAGILVPLFHRARIGAVVGFIAAGALIGPHGLGRLADSLPFVRFITISSPERAAPFGELGVVFLLFLLGLEFSAPRLWKLRREVFGVGALQVLFCGVPLALGLALVAVPEPEVALVLGFALALSSTALVSQLLIDQHRSLAPLGQLVIAVLLFQDLMVVPILLAAELLSGPATDVLTLAAMALAKATGAVALILVAGRFVLAPLVAVAASTRSRELIMAITLVVVVGSAAVTHAAGLSSALGAFLAGMALSETAYRHQIEVDLEPFKGLLVGVFFVTVGMSLDFAAVLPRALWVVAGVAALIAVKAACTYGAARLLRVSAPAAAEAALLLSQTGEFAFVVLGLLAAKGVLGAQDAATLVAVVSLSLAATPVLARVAARLGRTLDARLHDALAPVASTASGHVIIGGFGRVGRTIADALDEEGVPYVAVDADPRRVAQARTAGRPVFFGDAGRAEILDRLGAERALAFVATLDAPNAAERMVAAVRQHWPGTAVIARAKDAEHARRLAALGVAGVIPEAAEASLQLMAQLLSSLGLADEAVAARTEQTRARIRDDIERRTGAEGI

SEQ ID NO: 1380 - protein, 431 aa, Francisella tularensis subsp. holarctica
MENKSNSQILFAEAQQYIPGGVNSPVRAFKSVGQEFPRFIKFAKGAYLYDVDWNKYIDYIGSWGPMILGHCDDDVLEAIQCQVKNGLSYGAPCKQEVDLAKKIIELMPNIEQVRFVNSGTEATISAIRLARAYTCRNKIIKFEGCYHGHADEFLVAAGSGALSLGQPNSPGVPEDVVKDTLVASFNDMESIQALFEKYKDEIACIIVEPIAGNMNMIFPQDGFLAKLRAICDQNSSLLIFDEVMTGFRVALGGAQSIYNVKPDLTTLGKVIGGGMPVGAFGGRKEIMQKVSPAGPVYQAGTLSGNPIAMTAGIKTLEKISQPGFFDELGVKAQKLVDGLNEAAKAYDFNFHAKCLGGMFGLFFCSDKIAVNTFVDLGKTNLKMFNQFFAYMLDNGVYLAPSAYEAGFISIAHSDEDIEKTICLAKKFFQEN

SEQ ID NO: 1381 - protein, 312 aa, Candida glabrata CBS 138
MESQQVDVDSIIDRLLEVRGSKPGQQVDLEEHEIRHLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQQAGRKKK

SEQ ID NO: 1382 - protein, 819 aa, Haemophilus somnus 2336
MVNTLPLPFSYNRPENTKDSLKKSIVYKLIFLIARSPEEASQRDWLNATLYAIRDLVTEGWISTARQARKEETRRVYYLSMEFLMGRTLSNALISEGVYHLAKDALAELNVDLEDVLEKEVDPGLGNGGLGRLAACFMDSIATLAIPGMGYGIRYEYGMFQQYIEDGKQVEKPDAWLEKGYPWEFIRPSKRFNIRFGGHIYFEGKKCIWKNAEEITALAYDQMIPGYSNDSAATLRLWSANAGETFNLVSFNRGDYFHAIEEKSSSENVSRVLYPDDSTAAGRELRLRQEYFLVSASLQDIIKRHKRIYNTLDNLADKIAIHLNDTHPALAIPELMYILIDQEGYTWQKAWDMCCQIFSYTCHTLMSEALETWPVEMMAKILPRHLQIIFEINDYFLEYVRTSVTTDNDFIRRISLIEEGNIRKVRMGWLSVVGSHKVNGVAAIHSDLMVSSTFADFYRIYPERFTNVTNGITPRRWIAVANPDLSALFDKYIGTEWRKDLTQLETLKAHIQDPELKKAIPEIKRKNKQRLANYVKQELGIELNSNALFDVQVKRIHEYKRQILNVLHIVARYNEMIANPEKDWTPRVFILAGKAASAYTAAKQTINLINDVANIINNDDRLQGRLKVVFIPNYSVSLAQIIIPAADISEQISLAGTEASGTSNMKFALNGALTLGTLDGANVEILENVGKDNIFIFGNTVEQVEELRRNGYHPFDIYQSDEQLREVIDQINAGRFSPKEPTRYHDLLNSLRSYDYYQSFADFRSYVEMQKAVDEKYKNQEAWVESALQNIVNMSFFSSDRTILEYAEKIWKIEPLKLA

SEQ ID NO: 1383 - protein, 255 aa, Buchnera aphidicola str. APS (Acyrthosiphon pisum)
MKKFFITANWKLNGNIKMISSFFKYLKLYSSSYLEKNTVIIAPPTIYLERVCKNISNMNIFLGSQNVDINLNGAFTGETSILMLRDIGVKYVIIGHSERRFLHHETDDIIAKKFHLIKKSNLTPILCVGETEIEKKHNQTEQVIQRQLNLILKNLGTSAFKNIIIAYEPIWAIGTGVSADPEHVQLIHVFIKNYILKYSSINRNDIIIQYGGSINHTNVKKFIEQPDINGLLIGNSSLSAKEFLEIIKIAHEHYS

SEQ ID NO: 1384 - protein, 473 aa, Synechococcus elongatus PCC 6301
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRSHPYEFALYYDC

SEQ ID NO: 1385 - protein, 184 aa, Francisella tularensis subsp. holarctica
MNITKVKKLLSTGYWSDFYIYPLAAIIFLIYGSKLLNFNLKSIIVLFLIGIILGSFLEYFIHRVIFHHCPIFKELHQLHHDKPIELIGNPTYVSLPVYTICVFVPLCFISNLAYACVIFSAFLFDLLFYFIIHHITHHVRTKKGSILHWYKKYHATHHKNPNVNFSVAFPIWDIVFRTKGKQKD

SEQ ID NO: 1386 - protein, 1041 aa, Oryza sativa
MAGTISRIRLENFMCHSSLHIELGQHVNFITGQNGSGKSAVLTALCIAFGSRAKSTQRAAALKDFIKTDCSYAAIIVDINNQGEDAFKPEVYGDLVRLERRITESSSSMFLKDQHGNKVAHRKDDLIEIIEHFNIDVENPCVIMSQDKSREFLHSGNNKDKFKFFFKATLLQHVNDLLLAIRELLDNADSVVQELEKSIKPAMMELDELQQKIKNMEHIEEIAHEIDNLKKKLAWSWVYDVDRQIEEQTVKLLKLKERIPACQEKIDGHAAMIVKLKEELTDKERNARSLVEKSREVTMMKEKLEDDIAQAVALKIELEREHVRGTNVLKNMNNRVKQLQKQIHDFREQYIQYTQDESSKAENDKCEIQKEINSLHSNVTRLKEEERGLHEKAKSGRVWVTHIRDLQQRQSDKVLSDYNPVSQYATGAIPQVSTFGGQRVRNLLKSIERQERRFNIPPLGPPIGVHVKFINYNKWSFAVECALGRLLDAFIVSCHRDSVILRECAKEVNYHNLQIIIYDFAKPRLNIPDHLLPSTTHPTVLSVIQSENPTVLNVLVDQGSAERTVLVRDYEVGRSVAFDNRIQNLKDVYTSDGYKMFSRGPVQTILPPHRKGNAGRLCTSLGEKIAEMESEIADMERIISQRTRDMKKPNDKREDIELKIKNLKRKRVEEERLLESKKVQLDDIRKTSADINRVTSSDTSELEAEMMQVEVDIEQKELLVQKTNLRLTKALQDENDRRACYKEFIDGVYREVGPSNVLEKEIERVKDKLQTAEQGKAYYEGIMETKVLPDIKIAEAEFEDLQKLQQESFKKASIICSESDVETLGGVAGSSPEQLSATINKLELRFHKESSRYTESIDDLRALHIKKKEKIEDKQQLYAGFRDKLNSCQKALDMRWKKFQRNAALLKRQLTWRFNEHLGKKGISGFINVDYKERLLSVEVRFSQDSSRDTITDTRGLSGGERSFSTLCFTLALHGMTEAPFRAMDEFDVFMDAVSRKISLDTLVDFAVTQGSQWIFITPHDISMVQPGDRIKKQQMAAPRG

SEQ ID NO: 1387 - protein, 94 aa, Brassica napus
RPTRPVSYAVVYGYRFWTAIGLRGACFPLVVNCQAVLLGCLTVCHVGVLCIHLVKRGGCNGIGAWLFNSVLNAVISLLYLKFYVKTRSLSLRKQ

SEQ ID NO: 1388 - protein, 281 aa, Mycobacterium avium subsp. paratuberculosis K-10
MSSRLGPVTDRDRLRAPLDAAALRAELIGTGLGWRRLDVVEQTGSTNADLLARAAAGDDVAGAVLIAEHQTAGRGRHGRGWSATPRAQVTMSVGVSVVDVPAAGWGWLPLATGVAVVDTVAPLLQPAGVAVGLKWPNDVLAGPAGTPGKLAGILAEVSKPVVVIGLGLNVTQSADEIDGPGATSLLDLGVAAPDRTALVSGLLRELGRRIVSWQAARGADWALAADYRARSLTIGTRVRADLPGGKHVEGTASGIDDQGRLCLDSGGQTVVVAAGDVVHLR

SEQ ID NO: 1389 - protein, 137 aa, Zea mays
  misc_feature (45)..(45): Xaa can be any naturally occurring amino acid
  unsure (1)..(137): unsure at all Xaa locations
MSAYCGKYKDELIKSAAYIGTHGKGILAADDFSETMGNRLSSINXDNPEENRRALHKLLFCCPDTIHYISSGILYQDTLYQNTKDGKPFDDVLKEGGILADIKVDKGTIEAAGTGNGNPTHGRDDLDKRCHHYYEGR

SEQ ID NO: 1390 - protein, 260 aa, Glycine max
  misc_feature (217)..(217): Xaa can be any naturally occurring amino acid
  unsure (1)..(260): unsure at all Xaa locations
ENFDKFDRVRYPKIRYAGMLEYDGELKLPSHYLVSPPEIDRTSGEYLVYNGIRTFACSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTPDHGNAEDMVNMGLSGKPTSGNGWRLHILCLPSLGPWAIAIGGPGLXPGVRFRNNVPPGGLATVTATVMNLHGFEAPSDYESTLIEVVDN

SEQ ID NO: 1391 - protein, 312 aa, Mycobacterium avium subsp. paratuberculosis K-10
MAPHDKQHRDWSEADVGDQSGRVVVITGANTGIGYETAAVLAHRGAHVVLAVRDLEKGNAALSRIVAASPNADVTLQQLDLASLASVRSAAEALRAAYPRIDLLINNAGVMWTPKQVTEDGFELQFGTNHLGHFALTGLLLDHLLGVRDSRVVTVSSLGHRLRAAIHFDDLHWERRYDRVAAYGQSKLANLLFTYELQRRLAAAPDAKTIAVAAHPGGSNTELARHLPGIFRPVQAVLGPVLFQSPAMGALPTLRAATDPAVQGGQYYGPDGFLEQRGRPKLVESSAQSHDEQLQRRLWAVSEELTGVHFPV

SEQ ID NO: 1392 - protein, 286 aa, Geobacillus kaustophilus HTA426
MTVIQWFPGHMAKAKREVQEKLKLIDVAFELLDARVPMSSRNPMIDEILGQKPRLILLNKADMADEAVTEQWIRYFHDQGRLALPIDAQSGTGVRQIAAAAKEMVKDKFEKMRAKGIKNPRPVRALIVGIPNVGKSTLINRLAGRHIAKTGDKPGVTKAQQWIKVGKEMELLDTPGILWPKFEDEDVGYKLAVTGAIKDEILNLQDVAVYALRFLSTHYPNRLAERYGLDDIPDDIVALFDTIGRRRGCLTSGGAVDYDKVADIVLYDIRTEKLGRLSFETPASRT

SEQ ID NO: 1393 - protein, 106 aa, Glycine max
  misc_feature (71)..(71): Xaa can be any naturally occurring amino acid
  misc_feature (79)..(79): Xaa can be any naturally occurring amino acid
  misc_feature (88)..(88): Xaa can be any naturally occurring amino acid
  unsure (1)..(106): unsure at all Xaa locations
MSAFVGKYADELIKNAKYIATPGKGILAADESTGTIGKRLASINVENIEANRQALRELLFTAPNALQYLSXVILFEETXYQKTSDGSXFREVFREHVIPSIKVGPG

SEQ ID NO: 1394 - protein, 248 aa, Thermoanaerobacter tengcongensis MB4
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 1395 - protein, 335 aa, Thermoanaerobacter tengcongensis MB4
MGVRVGINGFGRIGRNVFRAALKKNADLEFVAVNDLTDAKTLAHLLKYDSVLGKFEGEVSYTDDSLIVNGKEIKIFKETDPGKLPWGDLGVDIVIESTGRFTNKEDAIKHIHGGAKKVIITAPAKNEDVTIVMGVNEHMYDPANHHVISNASCTTNCLAPIAKVLNDKFRIKKGMMTTVHSYTNDQRILDLPHSDLRRARAAAVSIIPTTTGAAKAIHLVIPELKGKMNGFAMRVPTPNVSVVDLVAEVEIPTTVEEVNAAMKEASETYMKGILGYSEDPLVSVDYKGDDRSSIVDAPLTMVVEGTLVKVVSWYDNEWGYSNRVVDLALYIAERM

SEQ ID NO: 1396 - protein, 1016 aa, Musa balbisiana
MLTSEMMGVAALRVIASKLEKKWDFSVDPCSQTNGWVVPGRSDMPVFTDNVTCDCNRTSNICHVTSIKLKGQNLTGTLPPEFSKLPFLTDIDLTWNYLNGTIPAAWASLPLVHLSLLGNQVSGPIPEEFAKMITLEELVLEGNQLQGPIPAALGKLANLKRLLANGNYLSGELPESLGNLKNLIMFLIDGNQISGKIPNFIGNWTQLQRLDMQGTAMEGPFPPSFSALKSLKELRVSDLKGGIGSFPQLQNMRNMTKLVLRNLSISGELPDYIGEMKALNSLDVSFNNLSGPIPGSYAALTSSLNFMYLSNNNLNGKIPDWILNSAQKFDISYNSFTGSPAPAICQRGRCWCNLTAPFYRTLSCLRRNLPCSGESRNYNLFINCGGPKMRIDDIEYEGDILDLGTSEFYDPESGKWAYSSTGDFVDNQNPKFITANTTALDITKPELYMTARLSPLSLKYYGLCLYKGNYTVNLHFAEIMFTDDETYSSNGRRLFDVSIQGQKVLKDFNIAKEANGTGKEIIKSFTIMVDGTLEIHFYWAGKGTNSVPLRGVYGPLISAISVTPNFKIDTGENKLTIGTILAIVAAACIIVLLILCLIFLYIRRKNSKNNDVQQASYLVDCLKKLTPKPVVELYSMVNSICLLYPYVLMVMIYSPQSSSKLRGLELQTGQFSLRHIKAATKNFHPANKIGEGGFGPVYKGVLPDGSEIAVKQLSSKSKQGNREFVNEIGVISALQHPNLVKLYGCCIEGNQLLLIYEYMENNSLARGLHGPEGYQLRLDWQTRWKICLGIARGLAYLHEESRLKIVHRDIKATNILLDKDLNAKISDFGLAKLNEEENTHISTRIAGTLGYMAPEYAMRGYLTDKADVYSFGVVTLEIVSGMSNTKYRPEEDCVYLLDWAYVCHEKGNLLELVDPALGSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 1397 - protein, 732 aa, Neurospora crassa
MAASLSSASAMASGSAGAEAGASSADASSSINASGTPAASASQAPSAASKAGSPQDGATPPVTQRDKDSLNRVLVDRFVTRDMIHAAALKDSQKALNQDMSNRLARVDQYKAMTSRDSRNRVPPAQLYGQGYNGYGNGVTETGGPVKIIYPSQKPRPGKRTTPPLKFSRKDLKKQAEQHEELVPIRIDVDWDKVKLRDTFTFNLHERLIPVEVFASQLVEDMGLKPPMDKHVHEQVVTQMVEQLQDFYPFVHSEEDALDPELPYSAYKNDDMRILIKLNITIREHTLVDQFEWDINNPMNSPEEFAARMADELSLSGEFTTAIAHCIREQTQLFTRSLYSVGHPFDGRPIEDPDLTAAFLPTPIPCTLRPNQQQKDYAPYLYENTEAELERTETMFSREQRRQKRSVNRRGGPQLPDLKERQRTIRTAIVSSVIPGGVLDIEDSRLFKKTTGPVATTGGPGRGRRIIRDGDLSDSEDSMDSAPDSPAMSVPQAGTARTRGMRGAATAAAQRMANIGRSETPETIVHHHETRMSRRFGREATREETEEPLQQQHIVTLRVHPARLRRIIQGRDSRTKPPAPAPSGSGTPGNQRASSIALPGSMGPPPTTPAAGSQHNLTIKVATPPTSGAGAAAGGDDAIVGAVPALPSPANGEALPPSEIPSQFTPGQGSFVPQLSEWLNKRLEVHQKYPNDSYDCIMRHNAVVMAWDGGSGGDVVVKIVPEKQAQELPPNA

SEQ ID NO: 1398 - protein, 430 aa, Desulfitobacterium hafniense Y51
MGFQDQRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTTRLAEGLQSIAQELGFPIWVNSVGAMFSAFFTDQPVIDFKSACSSDVERFGSFFRGMLERGIYLAPSQYEAVFLSAAHTDADIDYTLEQARDVLKSLG

SEQ ID NO: 1399 - protein, 669 aa, Cryptococcus neoformans var. neoformans B-3501A
MPKTNKGGKGQKNKVYALPTAQKKKGLDVPKFQMKAKAASQAQLAPTSLGALSSNDQDISNSSFDLGNVTFHDVIDTSLTKDSSSKAFMRELRKVIERSDVIIQVLDARDPEGTRSRWVEDEVRKRDMQGKKLLGVLNKIDLVPRANLEAWLKHLRHSFPTMPFKSSTQSQKQHLSQNAVPLAQPSTVPGKQAVLQELPTTSASLGAPALLHLLKQYALSTPHSSLTVGVVGYPNVGKSSLINSLKRSRACAVAAMPGKTRVVQEVALDKGVKILDCPGVVLEDVGSHMEGEEGRRRQAEIMLRNCVKAELVQDPISPVEVILNKVEPAQLQKLYNIPAYDDVRDFLIKMALIRGRLGKGGVPDLEASAVQVLRDWNSGKISYYTTPPKFHPSSAPAPAPVVTPVLAPNEAAGDMEMGGDKVGDAKILTTLSEAFTIEGLFDNLGDDAAWEGEGVVKEEGIAEDADLIAPEPVIPPALVPEQTAPRASLTKRPFMDSEDESDADSDASDSFRPRTTLGPSPATFQSTSSNALHFPAQPQTAQANRLFTAEELAVLPSGLLDRKKVKSLAKKAKKRRAAVERTEGELMAGFMDMDMDEPGAREETEVQMPAFEQKSKKDKRKEKKETQAKQRKEMTKVVAEMEIDEDARKEAEFANFLANMNADGSDEEL

SEQ ID NO: 1400 - protein, 388 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 1401 - protein, 261 aa, Candida glabrata CBS 138
MPQNDYIERHIKQHGRRLDYEERKRKREAREVHKVAEKAQKLTGWKGKQFAKKRYAEKVAMRKKIKAHEQSKAKGSSKPLADNGEALPTYLLDREQTNTAKAISSSIKQKRLEKADKFSVPLPKVRGISEEEMFKVVKTGKSKSKSWKRMITKHTFVGEGFTRRPVKMERIIRPSALRQKKANVTHPELGVTVFLPILGVKKNPQSPMYTQLGVLTKGTIIEVNVSELGMVTSGGKVVWGKYAQITNEPDRDGCVNAILLV

SEQ ID NO: 1402 - protein, 324 aa, Zea mays
MFGFLKQRRQTPSGFSSSSAAEEVTAGIDGSGLVAIVTGASSGIGAETCRVLALRGVRVVMGVRTPSAGERVKEEIVKNVPAAGIDVLQLDKKAEPNRHVSSMSSVKRFADNFNGLNLPLNILINNAGIAFSPFTLSDDGIELQFATNYLGHFLLTNLLLEKMKITAMESGIEGRVVIVASDSYKHTYREGIRFDKLNDASGYKGILAYGQSKLANILRSNELSCRLKEEDAKVVVNSLHPGVVATNITRHLGIIKDILSPIAKLVLRGVEQGAATVCYLALHPQVAGVTGKYFVDFNAVELKPPATDKELSKKLWDFSVSLLQ

SEQ ID NO: 1403 - protein, 273 aa, Ralstonia metallidurans CH34
MLDSLTFGFLGGGNMASALIGGLVARGVPANAIRVVDPFEDARQRLATTLGVQTLAAPDAAFGASNVIVLAVKPQQFKDAVGALAPQLKNSLIISVAAGIRLQDMQRWLGTNRLVRAMPNTPALAGMGMTGLAAAPGLSDEDRAIAKAVAEAVGQCVWVEGDDQIDAVTAISGSGPAYVFYFVEAMERAAIEMGLSAEQGRKLAVETFRGAAALAAESSEPVSTLRERVTSKGGTTYAALTSMDASGIQDAFVRAMLAAAARGREMGAEFGKD

SEQ ID NO: 1404 - protein, 335 aa, Clostridium tetani E88
MVKVAINGFGRIGRNVFKVLIEKYSSELEIVGINDLTDAKTLAHLLKYDSLYGKFNGTVEAKENAIAINGKEIKIFAERDPKNLPWKEEGVDIVLECTGLFTDATKAKAHIEAGAKKVIISAPAKNEDVTIVLGVNEEKYNSEEHNIISNASCTTNCLAPFAKVLDQEFGIVEGLMTTIHSYTNDQKILDAPHKDLRRARAAAESMIPTTTGAAKAVALVLPQLKGKLNGMAVRVPTPTVSMTDLVCTISKEATAEEINAAFKKASETDMKGILGYSEEPLVSVDYRGDARSSIVDGLSTMVMGNRLVKVVSWYDNEWGYSTRLADLAKYVADRL

SEQ ID NO: 1405 - protein, 480 aa, Buchnera aphidicola str. APS (Acyrthosiphon pisum)
MLNRLRRTKIVATLGPSTDINNNLEKIIRSGVNVLRFNFSHGSKDEHKSRANQAREIMTRLNFHIALLGDLQGPKIRISKFIKNNIFLNVGDFFILDANLDQNNGNQERVGIDYKQLPYDLKVGDVLLLDDGRIQLKVIKSTGHEILTKVVIGGILSNNKGINKLGGGLSADALTEKDKKDIILATEINVDYLAISFPRCSNDLKQARKLAKEFGSNAKIIAKIERAEAVLNQNTIEDIILASDAIMIARGDLGVEIGDSELAGIQKKLIRTARQLNRIVITATQMMESMITNPLPTRAEVMDVANAVLDGSDAVMLSAETASGEYPAETVIKMAKICKGAEKVPSINVSRHRIHAKFDDIEEAIAMSAMYVANHLKGITAIITMTESGKTALMTSRITSGLPIFALSKNKETLNLASLYRGVTPIYFNSKNNNFKAANEAIVLLRKRGFLCRGELVIITQGDIMGKIGKTNTSRILKVV

SEQ ID NO: 1406 - protein, 528 aa, Mycobacterium leprae
MDLPVVLIADKLAQSTVAALGDQVEVRWVDGPDRTKLLAAVPEADALLVRSATTVDAEVLAAAPKLKIVARAGVGLDNVDVDAATARGVLVVNAPTSNIHSAAEHALALLLAASRQIAEADASLRAHIWKRSSFSGTEIFGKTVGVVGLGRIGQLVAARIAAFGAHVIAYDPYVAPARAAQLGIELMSFDDLLARADFISVHLPKTPETAGLIDKEALAKTKPGVIIVNAARGGLVDEVALADAVRSGHVRAAGLDVFATEPCTDSPLFELSQVVVTPHLGASTAEAQDRAGTDVAESVRLALAGEFVPDAVNVDGGVVNEEVAPWLDLVCKLGVLVAALSDELPASLSVHVRGELASEDVEILRLSALRGLFSTVIEDAVTFVNAPALAAERGVSAEITTGSESPNHRSVVDVRAVASDGSVVNIAGTLSGPQLVQKIVQVNGRNFDLRAQGMNLVIRYVDQPGALGKIGTLLGAAGVNIQAAQLSEDTEGPGATILLRLDQDVPGDVRSAIVAAVSANKLEVVNLS

SEQ ID NO: 1407 - protein, 205 aa, Zea mays
  misc_feature (185)..(185): Xaa can be any naturally occurring amino acid
  unsure (1)..(205): unsure at all Xaa locations
ASASDRTGTAPIHPSPSSSPVQRNPSHERRLQEALPGRQVPRPLRFSPLTNFGRKTLPTAYLSYHKQGSHHAASGWGAIAAAVPAAAYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRXLIGATDPQKSEPGTIRGDLA

SEQ ID NO: 1408 - protein, 255 aa, Clostridium tetani E88
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 1409 - protein, 416 aa, Cryptococcus neoformans var. neoformans JEC21
MEQRNERMLEELLKLPGNDTCADCHAPAPRWASVNLGIFLCVGCASVHRKLGTHKSRVKSVTLDTWTRDQIATIRSMGNKASNAIYNPNEALHPPPPSYGYDERDSEIEKYIRRKYEQGAFRGGAAARPNGQVEPTSLNRARERDGRLPGGSTGLHLGKENNRNPELNDVIAVNIKKERDLPPLPPSASAQPVFGKNPPRGRPVRSPSNQGISSVGPVWNTAVNGSESTSTQQKVPEANLIDMSNSANSSLPLQVNMSTPTTGVSPSFSHGQSQFLSAQPQSWGSTFSTSPSNGMMMNGSNFSASPQMASPFQSPGFAQQMSFSSQPSLRQHMSPQPTYHQSTVPMASPSFQQTQQFATSPSFQQQLSPQFTQVQQFGQYPMQYNGQMATSPMNMGMGMGTGMAQPTQAYGYFNHM

SEQ ID NO: 1410 - protein, 513 aa, Clostridium tetani E88
MNKKPVMLMILDGFGITNHEDGNAVKMANKPNFDKLLREYPHTQLKASGLNVGLPEGQMGNSEVGHLNIGSGRVIYQELTRITKDINDGVFFENTEINYAIDEAIKNNSSLHLLGLLSDGGVHSHIDHLKAILKLAKDKGLNRVYVHAFLDGRDVPPSSAKEYIINIENYMKELSVGQIATLAGRYYAMDRDKRWERVELAYNALVYGTGELSNSAVEAIEKSYKDNTTDEFVLPTVILKDGKPTGTIKDEDSIIFFNFRPDRARQITRALNDKDFDGFERKRLKLNFITMTQYDKTIENVRIAYKPQSYKNTLGEYVSSLGLNQLRIAETEKYAHVTFFFNGGVETPNKGEDRALIPSPKVATYDLKPEMSAFEVKDEVINRIESNKYDMIILNFANPDMVGHTGVFDAAKTAIEVVDKCVGEISDKILEKEGTVFITADHGNSEQMIDYSTGKPMTAHTTNEVPFVYVSKDAKDKRLKSEGILADIAPTMLTEMGVKIPEEMTGRNLIEGK

SEQ ID NO: 1411 - protein, 225 aa, Lactobacillus plantarum WCFS1
MTELVLVRHGESTANRDNTYTGWSDVPLTAVGIAQAHQAGKRLRATGLQFGAVHTSVLKRAIVTANIMLSEIDQLWLPEYKTWRLNERHYGALRGQNKDVTRQEYGKAQVQQWRRSFYTVPPLLTPAELDHDRRYTKYGAAVEPRGESLKMAYDRIMPYWIDEIAPRLLDGQNQLVVAHGSTLRAMIKYLEHISDTGIDGVEVANGVPICYHLDRQLHVIGKEEY

SEQ ID NO: 1412 - protein, 255 aa, Thermotoga maritima
ITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 1413 - protein, 270 aa, Arabidopsis thaliana
  misc_feature (225)..(225): Xaa can be any naturally occurring amino acid
  misc_feature (235)..(235): Xaa can be any naturally occurring amino acid
  misc_feature (241)..(241): Xaa can be any naturally occurring amino acid
  misc_feature (245)..(245): Xaa can be any naturally occurring amino acid
  misc_feature (247)..(247): Xaa can be any naturally occurring amino acid
  misc_feature (250)..(250): Xaa can be any naturally occurring amino acid
  unsure (1)..(270): unsure at all Xaa locations
VHPRRPPTRPPTRPVDKGLSPLAGSNEESWCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIXASQEGHFLGXGQRANXNWPXFXKYXAEGENRGFPRKECFSKGFNP

SEQ ID NO: 1414 - protein, 84 aa, Triticum aestivum
LASEPGTIRGDFAVDIGRNVIHGSDSIESANKEIALWFPEGPADWQSSQHPWDLREVNMESTSKLGEQEEACHHFVLLAFPKRL

SEQ ID NO: 1415 - protein, 251 aa, Vibrio sp.
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIGYEPVWAIGTGKTATPEIAQEIPAHIRSWLAEQDAAVANKVQILYGGSVKPANSAELFGQADIDGGLVGGASLDAVEFSKVISGASA

SEQ ID NO: 1416 - protein, 225 aa, Oryza sativa (japonica cultivar-group)
MSGGGGGRKAAVTGGEEAEVEALLRAAQDAVMLKLQANSHLVSSSSSATAPNLPPSLDHPAAAAAADPLDADLARRFDALRSHRPPDPKPKQPDAPSAAAAGGMDELEARFAALKGAAGPEKETRVRLEDLGGESDEDEDDEVDKVMRWAMDAARLDVATAGAGKAKSTKKDDDEEEEEKDQTSSSVSSEDEEEEEEEKLEKERERKRKEMMSKNKSKTKWFSLF

SEQ ID NO: 1417 - protein, 275 aa, Geobacillus kaustophilus HTA426
MNGLQDCATLHNGVKMPWVGLGVYKVKEGEEVRSAVRTALEIGYRHVDTAAFYENEEGVGRAIRESGIPREQVFVTTKVWNTDQGYETTLKAFDKSLKKLGFDYVDLYLVHWPVKGKYKETYKALEKLYKDGYVRAIGVSNFHIHHLQDVLADCEIKPMVNQVEYHPRLTQKELLTFCRENGIQLEAWSPLMRGEILSEPTIIDIGRKYGKTPAQVVLRWDLQHGVVTIPKSVTPARIKENADIFDFSLTDEEMKQIDALNLNKRVGPDPDNFNF

SEQ ID NO: 1418 - protein, 348 aa, Pyrococcus furiosus DSM 3638
MSEKMVAIMKTKPEYGAELVEVDVPKPGPGEVLIKILATSICGTDLHIYEWNEWAQTRIRPPQIMGHEVAGEVVEVGPGVEGIEVGDYVSVETHIVCGKCYACKRGQYHVCQNTKIFGVDTDGVFAEYAVVPAQNVWKNPKNIPPEYATLQEPLGNAVDTVLAGPIAGKSVLITGAGPLGLLGIAVAKASGAYPVIVSEPSEFRRNLAKKVGADYVINPFEEDVVKEVMDITDGNGVDVFLEFSGAPKALEQGLQAVTPAGRVSLLGLFPGKVSIDFNNLIIFKALTVYGITGRHLWETWYTVSRLLQSGKLNIDPIITHKYKGFDKYEEAFELMRAGKTGKVVFMLK

SEQ ID NO: 1419 - protein, 453 aa, Bacillus halodurans C-125
MPTNTMPTGPKGNPVLGNTIEFGKDPLQFITRCSQEYGEIVRLRFERERDTFLLNDPKHIQYVFMNKGGEFSKGYQQDPIMGLVFGNGLLTSEGSFWLRQRRLSQPAFHPKRIADYADTMVGYCERMLNTWMDNDTRDINDEMMQLTMAIATKTLFDLDLHKGDTQEASRSLDTVMTAFNEQMTNVFRHVLHLIGLGKLVPPVSRELREAVESLDKMIYSIIEERRKHPGDRGDLLSMLISTYDEDDGSYMTDRQLRDEIITLFLAGHETTANTLSWAFYLLSQHPHVEEKLYQEVSQVLGNRPATLEDMPKLSYAEHVIKETLRVQPTVWLISRRAEKDVTLGDYHISAGSEIMISQWGMHRNPRYFNDPLTFLPERWDNNDNKPSKYVYFPFGGGPRVCIGERFALMEATLIMATIVREFRMELVDELPIKMEPSITLRPKHGVTMKLRKR

SEQ ID NO: 1420 - protein, 277 aa, Alkalilimnicola ehrlichei MLHE-1
MYTGDPPQTRRPVTVGRLQRMKADGQKVVALTAYDYTFAVAEDQAGVDVILVGDSLGMVVQGRDTTVPVTVEEMVYHTRCVTAARPSALVMADMPFMSYATLEDGLRNAARLMQEGGAQMIKLEGAGEQAELVARLARAGIPVCAHLGLQPQLVHKLGGYRVQGRESAAADAMLADAQALEAAGADLLLLECVPAELGRRISQGLEIPVIGIGAGPDCDGQILVLQDILGVTPGRIPRFSKNFMNGAGSIQCALQAYVQAVRSGAFPDAAHSFGGQG

SEQ ID NO: 1421 - protein, 266 aa, Bacteroides thetaiotaomicron
MTKKKLPVRFTGQHFTIDKVLIKDAIRQANISNQDTVLDIGAGKGFLTVHLLKIANNVVAIENDTALVEHLRKLFSDARNVQVVGCDFRNFAVPKFPFKVVSNIPYGITSDIFKILMFENLENFLGGSIVLQFEPTQKLFSRKLYNPYTVFCHTFFDLKLVYEVGPESFLPPPTVKSALLNIKRKHLFFDFKIKAKYLAFISCLLEKPDLSVKTALKSIFRKSQVRTISEKFGLNLNAQIVCLSPSQWLNCFLEMLEVVPEKFHPS

SEQ ID NO: 1422 - protein, 137 aa, Thermus thermophilus HB27
MERTFVMIKPDGVRRGLVGEILARFERKGFRIAALKLMRISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 1423 - protein, 397 aa, Leuconostoc mesenteroides subsp. mesenteroides ATCC 8293
MKTFSNRVNAITASPTLVMNGLAKQMQAEGIDVINLGVGEPDFQTPKNISDAAIEAIQAQKTSFYTPASGLPALKQAIVENVSQRYEAAITTQNVSVTTGAKLSLYVLMQVLLNPGDTVVTAAPEWVSYVEQIKLAGGELIEVHSESSSMKLTISDLDKIKETVKLVIVNSPTNPTGQVYSKQEIQDILDWSNTHGVYVILDEIYGQLVYNGAEFTSGLQLQHLENSAMIIVDGVSKAYSMTGWRIGWTLASSEIISAMNKLLGHMTSNPTVAAQYAAIEALNGEQDTVENMRQAFEQRLNTTFEAINKINGVHVDVKPQGAFYLFPQVDEKLKKLVGVSNTVELSTKILEEAHVALPAGEGFGMPGYLRLSYAKDQDTLNEAVLRLTQFFKKYTKD

SEQ ID NO: 1424 - protein, 150 aa, Glycine max
MAEQTFIMIKPDGVQRGLIGEVISRFEKKGFYLKGLKLQNVEKSFAEQHYADLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 1425 - protein, 257 aa, Glycine max
MPPSSLFSNMHFLFFFLLSSIHLSVQLNHTTTTTNNSTSLFSLSFPLTSLSLSTNTALKMMLRNSLIANTNNNNTQLKSPPSSPYNYKLSFKYSMALIVDLPIGTPPQVQPMVLDTGSQLSWIQCHKKAPAKPPPTASFDPSLSSTFSTLPCTHPVCKPRIPDFTLPTSCDQNRLCHYSYFYADGTYAEGNLVREKFTFSRSLFTPPLILGCATESTDPRGILGMNRGRLYFASQSKITKFSYCVPTRVTRPGYTPT

SEQ ID NO: 1426 - protein, 392 aa, Clostridium perfringens SM101
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNKEELQKIVDVLKDKDVIIISDEIYAELSYDEDHVSIASFPEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 1427 - protein, 274 aa, Francisella tularensis subsp. holarctica
MKICFIGGGNMAAAMIAGMTSHGYKSQDIIVFDRNEHKCLNLIKKYNINTSTSLLNTIKLADILILAIKPQNMFELIKNIRDTVTSTQVIVTVAAGIQTSAYEELFNKEISFARTIPNTPSSLGYGATGIFFNKVIAADKKDLVIDIMQTIGVVTVVEDEKEIDIIAAIASSGPAYYFQFMEHMVEAAIKQGLDKKQAEKLVVQTCLGAAQMALNTNENMSELRKNVTSKKGITYEALNIFEQFNLGGIVDKAIQANIARAQQLAIEFTKLIDN

SEQ ID NO: 1428 - protein, 227 aa, Lactobacillus plantarum WCFS1
MNQDQLKQLVGQKAVEYIQDGMQVGLGTGSTVKFMVDALGERVKNEHLNIVGVSTSDRTAAQAKALGIPMKSVDEVDHLDLTIDGADEIADDFQGVKGGGAALLFEKIVAINSDKVMWIVDESKMVHQLGAFGLPVEVIPYGSQHVFEKMAARGYNPVFRKVNDELVRTDSNNIIIDLHIDPITDPHALAEDLIHMVGVVEHGLFLDMVNTVIVGHANGPEVIEARP

SEQ ID NO: 1429 - protein, 112 aa, Arabidopsis thaliana
  misc_feature (2)..(2): Xaa can be any naturally occurring amino acid
  misc_feature (27)..(28): Xaa can be any naturally occurring amino acid
  misc_feature (31)..(31): Xaa can be any naturally occurring amino acid
  misc_feature (39)..(39): Xaa can be any naturally occurring amino acid
  misc_feature (43)..(44): Xaa can be any naturally occurring amino acid
  misc_feature (47)..(49): Xaa can be any naturally occurring amino acid
  misc_feature (55)..(55): Xaa can be any naturally occurring amino acid
  misc_feature (57)..(58): Xaa can be any naturally occurring amino acid
  misc_feature (63)..(63): Xaa can be any naturally occurring amino acid
  misc_feature (66)..(66): Xaa can be any naturally occurring amino acid
  misc_feature (69)..(69): Xaa can be any naturally occurring amino acid
  misc_feature (76)..(77): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(87): Xaa can be any naturally occurring amino acid
  misc_feature (92)..(94): Xaa can be any naturally occurring amino acid
  misc_feature (96)..(99): Xaa can be any naturally occurring amino acid
  unsure (1)..(112): unsure at all Xaa locations
MXSSMLSSATMVASPAQAIMVAPFNGXXSSXAFPATRKXNNDXXSFXXXGGRVNXLXXWPPIXKEXFLXFFFYFFXXTDSXWGXGXXYFIRXXXFXXXXFSCCFFGGFLLFG

SEQ ID NO: 1430 - protein, 534 aa, Arabidopsis thaliana
MSGNNNNPQKPQGSAPLPFGNPGMASASVPGNQGFAQSHMAANFQAQFQFSQAQALAHAQAQSKVQAQLQAQLQAQGMTMNQAQGSPGIGGLGPSSPSLTTPGSLNMKRFQQKPPMRPPGAPASNNTISPMRTMELTPAARKKKQKLPEKSLQERVAAILPESALYTQLLEFESRVDAALTRKKVDIQEALKNPPCIQKTLRIYVFNSFANQNNTIPGNPNADPPTWTLKIIGRILEDGVDPDQPGFVQKANPLHPKFSSFFKRVTVSLDQRLYPENPLIIWENARSPAPQEGFEIKRKGNQEFAASIRLEMNYVPEKFKLSTALMDVLGIEVETRPRIIAAIWHYVKARKLQNPNDPSFFNCDAALQKVFGEEKLKFTMVSQKISHHLSPPPPIHLEHKIKLSGNNPAVSACYDVLVDVPFPIQRDLNNLLANAEKNKEIEACDEAICAAIRKIHEHRRRRAFFLGFSQSPVEFINALIESQSKDLKVVAGEASRNAERERRSDFFNQPWVEDAVIRYLNRRPAAGNDGPGSW

SEQ ID NO: 1431 - protein, 465 aa, Vibrio cholerae
MKICPVVLSGGVGSRLWPLSREHFPKQCLNLTDLLSSLLQQTLVRTNHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPTRAETGYGYIKAGQDSCVEKFVEKPDLATAQSYLESGDYLWNSGMFLFQASQYLAELKQHRPAMYAAVESAYGNRTEDLDFIRIGTEAFTACPSESIDYAIMEPTQNAKVVPYNGDWSDIGAWDALHDYCEKDSNHNVLVGDVMAESTTNSLVRAESRLVATIGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFSDRYGR

SEQ ID NO: 1432 - protein, 551 aa, Oryza sativa
  misc_feature (500)..(500): Xaa can be any naturally occurring amino acid
  misc_feature (522)..(522): Xaa can be any naturally occurring amino acid
  unsure (1)..(551): unsure at all Xaa locations
MAQVVAAAGTAAAVAAVGRPLVGGGSGADALRPAVRLSFAPRWCGGSAGAARARRESAVTSVISRAPRLDAEVLPVSADDDADVKEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKGPEVRSGDLPQPIMLETGQEFTFTIKRGVGTETCVSVNYDDFVNDVEVGDMLLVDGGMMSLLVKSKTEDSVKCEVIDGAGLKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMDILLSHXRPSGTIFVFTDQERVRQRLGLXQSVCTVQMEFSDDGEKNLVRLGIHGEHGW

SEQ ID NO: 1433 - protein, 454 aa, Medicago truncatula
MDPCPFVRLTIGNLALKIPVASKPARSVVHPSSSPCFCKIKLKNFPLQTALVPFIPHENNSPDSQIQPIAASFHLSKADLDRLTGKSIFAKKLTLKIAIYTGRSGTTCGVNSGRLLGKVSVPLNLTGTLTKATVFHNGWITVGKDDKGGSAQFHLNVKAEPDPRFVFQFDGEPECSPQVFQIQGNISQPVFTCKFSFRNNSGDRNQRSRSMQSEVGASRSWLSSFGSERERTGKERKGWSITVHDLSGSPVAAASMVTPFVASPGSDRVSCSNPGSWLILRPGDGTWKPWGRLEAWRERGGSDGLGYRFELMPDTNGSMSAGGIVIAESTLSLTRGGKFVLDLSSRCGGGGGSNGRATPGNATSPVCSPRGSGDYGYGLWPYCMYRGFVMSASVEGEGRCSKPTVEVSVPHVNCTEDAAAFVALAAAVDLSVDACRLFSQRLRKELCQQMDLVG

SEQ ID NO: 1434 - protein, 316 aa, Malus x domestica
MASQGQGGMDPAVLDDIIKRLTEVRLARPGKQVQLSEAEIKQLCGASREIFLQQPNLLELEAPIKICGDIHGQYSDLLRLFEYGGFPPSANYLFLGDYVDRGKQSLETICLLLAYKIKYPENFFLLRGNHECASINRIYGFYDECKRRFNVRLWKSFTDSFNCLPVAALIDDKILCMHGGLSPDLTNLDQIRNLTRPTAVPDTGLLCDLLWSDPGRDVKGWGMNDRGVSYTFGADKVAEFLTKHDLDLVCRAHQVVEDGYEFFADRQLVTIFSAPNYCGEFDNAGAMMSVDENLMCSFQILKPAEKKAKFMMSTKM

SEQ ID NO: 1435 - protein, 481 aa, Pinus taeda
MADQISLLLVVFTAAVALLHLIYRWWNAQRGQKRTSNEKNQELHLPPGSTGWPLIGETYSYYRSMTSNRPRQFIDDREKRYDSDVFVSHLFGSQAVISSDPQFNKYVLQNEGRFFQAHYPKALKALIGDYGLLSVHGDLQRKLHGIAVNLLRFERLKFDFMEEIQNLVHSTLDRWVDKKEIALQNECHQMVLNLMAKQLLDLSPSKETNEICELFVDYTNAVIAIPIKIPGSTYAKGLKARELLIRKISNMIKERRDHPHIVHKDLLTKLLEEDSISDEIICDFILFLLFAGHETSSRAMTFAIKFLTTCPKALTQMKEEHDAILKAKGGHKKLEWDDYKSMKFTQCVINETLRLGNFGPGVFRETKEDTKVKDCLIPKGWVVFAFLTATHLDEKFHNEALTFNPWRWELDQDVSNNHLFSPFGGGARLCPGSHLARLELALFLHIFITRFRWEALADEHPSYFPLPYLAKGFPMRLYNRE

SEQ ID NO: 1436 - protein, 170 aa, Ashbya gossypii ATCC 10895
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDLKDMDDGDDDDDDDDDDD

SEQ ID NO: 1437 - protein, 487 aa, Pinus taeda
MGSGIMTETLTDSWLVGLLCLVLGFLLLQLYKLVWGASSRAYKLPPGSTGWPLIGETISFFRGINSTAQPRQFIQEREQRYGEIFRSNLFGRSRIVVSVDPEFNKHVLQHEGRQFQANYPKPLRNLIGKYGLLSVHGDLQRKLHGAAVNLLRFERLSVDFMEDIQNLLHITLAKWEAKRDIHLQEECHQLVLNLMAKQLLDLSPSKDTEEICEAFGHFSEALLAVPIKIPGTKYARGFKAREFLIKKIYESIEDRRQHPEAVHNDLLTKLLKEDSFSEEIIADFILFLLFAGHETSSRSMSFAIKFLTDCPRALEELKAEHDALLKRKGNLKNQKLNWDDYQSLKFTQCVIHETLRVGNFGPGVFRETKEDIKTKGGFVIPRGWTVYVFLTGTHLDEKYHSSALKFDPWRWQPHLQDQELLKNPSFMPFGGGARLCPGMHLAKMELALFLHNFVTKFRWEALQDDKISYFPFPRLIKGLPIRLRLRE

SEQ ID NO: 1438 - protein, 491 aa, Listeria monocytogenes str. 4b H7858
MVFLSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVKQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIVISNPETPFGGVKHSGFGRENGHYGMEEYIQVKFINLKYRD

SEQ ID NO: 1439 - protein, 801 aa, Cryptococcus neoformans var. neoformans JEC21
MSPPQGKGVPVPNLGLKHESKKKGHVMQSSLELVFSYSRSQQMHYGSRSAPSFLDDSSFRGDQFDVDDYDEDQNYNDIYDGIERTGEEQFEGRDLSGRLEDLKVAGAISEANEDGSTQEELGQDSHITRRSSDEPAFFHSDSVPISPISQLQPSVNQGAKVNTLLPDGIGPIQGLFLAAMPSPRLAPVLPHPGSLDTSYCTEAGPSSNPRTSKRWNSHSRGDSNPMEIRESAALVSSSPQYHGKGKSAENRPLLDGRPTEGYASIQSQKEIRRKSNRRKRSEDGQSTEGQTLFNATAVLVGIGLLSLPLAFAYAGWIGGTIMLLGFGWLTCYTAKLLARLIRADGRMMGYTDIGLRAFGSWAGAGINLLVHFIVSSCNDGILTTGSSVALVLLFGDTLNVLYPSIPSNVWKLVGFFIIVPTVLLPLRLLSLPSLLSSISSFFLIIVLLVDGFLPSPEPSSASTGSLLHPSPTSLSPEWSRGNWLGGIGLILAGFGGHAVMPSLARDMKRPEKFDGIVNWAFAIATGISFTAGAAGYLMFGETVSDEVTKDLMREKYHYPRILNIVALWMIVINPLTKFGLSSRPLNLTIEGILRISPSPPPSLFSPFDGGLESALGSGAPETSQVNFPKRRDRSSFSTRNDPRTSRRPSALTSPSNSRPFPQSQSQIVAFEQYVSKERKKRWLRMVSRVVITALCVGVAVVLPGFGRVMAFLGSFSAFMICIILPLLFYIRLSPTLLPTCPPSPHSLTFPPTARSQPTSKWASEKFTNAIHWVLVIASTALMIAGTIWAFLPGSGHDELET

SEQ ID NO: 1440 - protein, 932 aa, Brucella melitensis biovar Abortus
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKLVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQARGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 1441 - protein, 431 aa, Xanthomonas oryzae pv. oryzae KACC10331
MECLVPDITGNARGKIIPADKFSHDYGTRLPEGIFATTVTGDFPDDYYALTSPSDSDMHLRPDASTVRMVPWATDPTAQVIHDCYTKEGDPHELAPRNVLRRVLDAYAQVKLQPVVAPELEFFLVQKNTDPDFPLLPPAGRSGRPETARQSYSIDAVNEFDPILDLMYDYCDAMELDVDTLIHESGAAQLEVNFTHADPLSRADQVFLFKRTMREAALRHGVYATFLAKPMETEPGSAMHIHQSLLHADTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIRENLEPTAPISSNGKEQGYDLPRSLGEALDELEGCDALQEMLGQRFVRAYISVKRKEYETFFRVISSWEREFLLLNV

SEQ ID NO: 1442 - protein, 279 aa, Streptococcus pyogenes M1 GAS
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 1443 - protein, 355 aa, Pyrococcus furiosus DSM 3638
MKQKKAWAIVKEVINEADIVVEVVDARDPIGTRNRKLERMVLESGKKLLLVMNKADLVPKDWAEEYKRKSEIPVVFISARERKGTGIFRKELKKLAKEIDKEKVKVALIGYPNVGKSTIINVLKGKHAVGTAPIPGYTKGKQLIRLTKRIWLLDTPGVVPIDDFDELVIKGGFPADKIRDPVKPALKLIKRILETRKEAITEKFGIEKFENEEEILEEIGKRRGLIKAGGEVDIEETARWFLREWQTGRFTLFGKEEKREEEYLPSFHDILEYIKKEKITEPRMILWKFGKKLEEYLGSEKRLGTIQIDEFTVAIATGFKKCPNALKFIEKVTGKTVISAECFGKKWKGIVAILE

SEQ ID NO: 1444 - protein, 400 aa, Leuconostoc mesenteroides subsp. mesenteroides ATCC 8293
MIKSKLEQVGIFNDNLDKVKPSPIHSFDEKVSDIPNILKLTIGEPDFSVPQHIKEAALAAISADDSHYSVSAGKKTLRQAASDFLNDRYGLDFDPAEEIITTVGATEGLYTLLAAILNPDDKVLIPTPAYPVYAEMTRINGGHPVFIDVSEDEFVLTPDHLREIIATEDHIKAIIITNPSNPTGVTYTAEQLKALADVVRETDILIISDEIYSELSYDAPHVSMASILPEQTIVVNGVSKSHAMTGYRIGILAGPAALMKKINMVHGFVIMTPSNPAMAAATEAFKSAESKDDTLWMKEQYKKRRDYLVEKMTKLGFEMATPSGAFYMFAKIPVDLNQNDVEFAYDLVDRQQLAVVPGSGFGPGGAGYVRISYAASLDMLETAMNRLESYCEEKRTVKIL

SEQ ID NO: 1445 - protein, 154 aa, Arabidopsis thaliana
  misc_feature (128)..(129): Xaa can be any naturally occurring amino acid
  misc_feature (131)..(131): Xaa can be any naturally occurring amino acid
  misc_feature (134)..(134): Xaa can be any naturally occurring amino acid
  misc_feature (146)..(147): Xaa can be any naturally occurring amino acid
  misc_feature (151)..(151): Xaa can be any naturally occurring amino acid
  unsure (1)..(154): unsure at all Xaa locations
MSTALINSITYFLSEHPYIVGFRWSNSQSWGSTWSFLFTSISLYIAVSSSLHILLSAVRRSNRSVPLGHIPEIHSLLMSILSATIFAGILLSAAAEPRDGRWGGRRSRPPFLVLWVLWGPVRGSASGXXSXWSXGVFLLRFFPNFXXFLAXLAG

SEQ ID NO: 1446 - protein, 281 aa, Gloeobacter violaceus PCC 7421
MGERTVLNENIRRFYDASSGLWEEVWGEHMHHGHWEVGEADKDRRVAQVDLVVRLLDWAGIDRAESIVDVGCGIGGSSLFLAERFGARVEGITLSPVQCKRAAERAREHHLDGRAHFQVADAHRMPFADGRFDLVWSLESGEHMADKAQFLRECHRVLRPGGRFVFVTWCCRHGALDARDQKWLGAIYRIYHLPYILSIESYTQLLGETGFSGIRTTDWSDRVARFWSLVIDSALEPAVLWKVIAQGPTVIKGALAMQLMRRSYARGLVRFGVFAAQKAEG

SEQ ID NO: 1447 - protein, 929 aa, Salmonella enterica subsp. enterica serovar Paratyphi A str.
MLNAVGAESLNALTGQIVPKDIQLATPPQVGEAATEYAALAELKAIAGRNKRFTSYIGMGYTAVQLPPVIPRNMLENPGWYTAYTPYQPEVSQGRLEALLNFQQVTLDLTGLDMASASLLDEATAAAEAMAMAKRVSKLKNANRFFVAADVHPQTLDVVRTRAKTFGFDVIVDDADKVLDHQDVFGVLLQQVGTTGEIHDYGALISELKARKVIVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQSMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASCLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 1448 - protein, 156 aa, Zea mays
MSSSRMLPTLAPPARVSLLLMSPLAPLASAFPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 1449 - protein, 250 aa, Salmonella enterica subsp. enterica serovar Typhi
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPIKHYYLGNADEIAAKAAAVANQGKAK

SEQ ID NO: 1450 - protein, 258 aa, Musa balbisiana
MDFMSKNGSLLSPSTNTRYQATATSGQREREIVELFRKVQAQLRERAAIKEEKKIEAAQQGQSKKGTVDSVLKLLRRHSGDQKKTTSPGEEFSVDQVERSNTFEDEQNINPFGPSDSKSQESDVRGPLPSARPASNFGRKSPVPRMEFQAVLSAEEDINSAPSKSRGRRKKTGDYECVQAAPAESVVLDGPDELSSDDQLDHSGSDETAEETIESSSTEASPDLGSLKLSELRDLARYRGVKGYSKLKKGELAELLSA

SEQ ID NO: 1451 - protein, 313 aa, Avena sativa
VVVITGASSGLGLAAAKALAETGKWHVVMACRDFLKASKAAKAAGMADGSYTVMHLDLASLDSVRQFVDAFRRAEMPLDVLVCNAAIYRPTARKPTFTAEGVEMSVGVNHLGHFLLARLLLEDLQKSDYPSRRLVIVGSITGNDNTLAGNVPPKANLGDLRGLAGGLTGASGSAMIDGDESFDGAKAYKDSKVCNMLTMQEFHRRYHEDTGITFSSLYPGCIATTGLFREHIPLFRTLFPPFQKFVTKGFVSEAESGKRLAQVVGEPSLTKSGVYWSWNKDSASFENQLSQEASDPEKARKVWELSEKLVGLA

SEQ ID NO: 1452 - protein, 302 aa, Haemophilus influenzae 86-028NP
MMNFTLLTYLADCQTKVRSELEKFSKNLEEDIQQLREIGLDILVDGQDYRLVPMLPLLNPQQISTALFPYGIHYQPIISSTNEWILQNIPSLKKGDLCVAEYQTAGRGRRGRQWLSPFAGQIMFSFYWTFDPKKSIEGLSLVIGLAIAEVLNVQVKWPNDILFDERKLGGILVEIANHKNGMLNLVIGVGINASLSKQTEISQPYAEVCEIDPDVDRQTLLPKLIQHLYTRLNIFEQNGIDEEFQQAWQSYNAFSNSEVKVLTEQGVISGIEQGIDERGHLKVLCGNKIQIFNGGEVSLRKK

SEQ ID NO: 1453 - protein, 518 aa, Pinus taeda
MDVNILTMFVTVSALALACSLWIASYLRNWRKKGVYPPVVGTMLNHAINFERLHDYHTDQAQRYKTFRVVYPTCSYVFTTDPVNVEHILKTNFANYDKGTFNYDIMKDLLGDGIFNVDGDKWRQQRKLASSEFASKVLKDFSSGVFCNNAAKLANILAQAAKLNLSVEMQDLFMRSSLDSICKVVFGIDINSLSSSKAESGPEASFAKAFDVANAMVFHRHMVGSFWKVQRFFNVGSEAILRDNIKMVDDFLYKVIHFRRQEMFSAEKENVRPDILSRYIIISDKETDGKVSDKYLRDVILNFMVAARDTTAIALSWFIYMLCKHQHVQEKLLEEIISSTSVHEDQYSTECNDIASFAQSLTDEALGKMHYLHASLSETLRLYPALPVDGKYVVNEDTLPDGFKVKKGDSVNFLPYAMGRMSYLWGDDAKEFKPERWIQDGIFHPKSPFKFPAFQAGPRTCLGKDFAYLQMKIVAAVLVRFFKFEAVKTKEVRYRTMLTLHMNEDGLNVQVTPRLNSD

SEQ ID NO: 1454 - protein, 285 aa, Saccharophagus degradans 2-40
MSETNLVNDAKIAFIGAGNMAAAIIAGLVKQGVAPANIEVCAPSEGNRARLASEYGVVHSADNNAAAAKADILVLAVKPQMMREVCAQLAEHRNPNCVVLSVAAGITCQSLANWLATPAQPAENIAVVRTMPNTPSHIGLGACGLFASSAVAQTQKDQAQAIMAAVGLAVWVNSEDEINIVTAVSGSGPAYFFLVFEAMIDAAEKMGLDRQTATQLTLQTALGAAKLAQTSEDDAVTLRKKVTSPNGTTERAIASFEQNKLRDTFAAAMQACSDRAQQLATELAK

SEQ ID NO: 1455 - protein, 322 aa, Zea mays
MMMTRAPMGPMEGAAVDEMVRRLVEGGRGGRQVQLSEAEIRQLCVEGKRVLLSQPNLLRIHAPVKICGDIHGQFVDLLRLFDLGGYPPASTYVFLGDYVDRGKQSLETICLLLAYKIRYPENIFLLRGNHEDAKINRVYGFYDECKRRFNVRLWKIFSDCFNCLPIAALIDDKILCMHGGLSPELTSLDQIKDIERPAEIPDYGLLCDLLWSDPSPDGEGWGESDRGVSCTFGADKLVEFLEKNDLDLICRAHQVVEDGYEFFAQRRLVTIFSAPNYCGEFDNVGALLSIDESLMCSFQILKPTDMGPPHARKQIPNKPTRG

SEQ ID NO: 1456 - protein, 399 aa, Fusobacterium nucleatum subsp. nucleatum ATCC 25586
MIYKIEDVLEDIKNGIPLIIVDDENRENEGDLFVAAEKATYESINLMATFARGLTCTPMTSEYAIRLGLDPMTARNTDAKCTAFTVSVDAKEGTTTGISIADRLTTIKKLANKNSVPSDFTKPGHIFPLIAKDKGVLEREGHTEATVDLCKICGLTPVSVICEILKDDGTMARMDDLEIFAKEHNLKIITIADLIKYRKKTEQLMKIDVVANMPTDSGTFKIVGFDNLIDGKEHIALVKGDVAGKENVTVRIHSECFTGDILGSLRCDCGSQLKTAMRRIDKLGEGIILYLRQEGRGIGLLNKLRAYNLQEEGMDTLDANLHLGFGADMRDYAVAAQMLKALGVKSIKLLTNNPLKINGLEEYGIPVVKREEIEIEANKINKVYLKTKKERMGHLLKIK

SEQ ID NO: 1457 - protein, 439 aa, Synechococcus sp. RS9917
MQSLQPSKPADAMGSRTFHDPLHRSIRLDGDQPAEAMVLALVDSRPFQRLRRIRQLGPAFLTFHGAESSRFTHSLGVFHLARQALERLIRRDPSLEAQRAVLYASALLHDLGHGPLSHTGEEMFGLRHETWSARLVRDHPEMRNILDGVGHGTAEAVADLLLHGRAERPVIKALVSSQLDCDRLDYLLRDSYSTGTRYGQLDLERILSALTLAPDGALAIHPKGLMAVEHYLVVRNLMYRSVYNHRLNVVCNWLLEQLIRTARQLGPERVWSDSTMARWLWDPQALDLDSFEANDDLRTGYHLLRWSEEAPPPLAELCQRFLHRRLLKAMPVNQLAAGAQLELLALARQLAEQEGLDPALTCGLRHQQLRGYHPYQGGLRLWDGHHLQALEQCSALVNSLSTPEETAWLIHPGSISQALNKAMLSVDSGPTPPAPRRQP

SEQ ID NO: 1458 - protein, 389 aa, Alkalilimnicola ehrlichei MLHE-1
MFRILTFNNISVKGLERFPRDHFETSSDIAHPDAIMLRSHKLQESEVADTVLAVGRAGAGVNNIPVEAMSRRGVPVFNAPGANANAVKELTIAGLFLAARNICQAWDFARALEGSDQQINAEVEAGKKRFTGFELPGRTLGVIGLGAIGVEVANAAMALGMKVVGYDPQITVHRAWQLSSQVEQAHSVDELMSRADVVTIHAPLNEATRGLINGSRLAAAHPGLTVLNFARSEVVDEQAILEALDRDHLRAYICDFPSNALKGRGNVIALPHLGASTVESQENCAVMVADQLREYLETGNIRNAVNFPEVVMPRGGKGNRLCVVNANVPNMLGRISTALAEAGLNIDDMYNKSHEELAYTVVDVEGAIPESVVQAIAEVEGVLRVRVIE

SEQ ID NO: 1459 - protein, 652 aa, Oryza sativa
MEDYGFEYSDDEPEEQDVDIENQYYNSKGMVETDPEGALAGFDQVVRMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYTKALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQKWCMKIISNMELWYILVLFVQLKSCALNRADPMLFLTEVNLLSYSVQDALSSIVLSMFCMELNFPEKDVEQLLVSLILDNRIQGHIDQVNKLLERGDREIPSHRQVEYSAEEHLPNGVQQSWVREIAGCLGCTALGTCLHVLLWWMLGFCPELNLSANSNPSETILASMARNFWFCWHCRTSKFWYGRENVWFRVKYAPGTRHTANIVPLPSSDSVANQSLSNQNEGKESPFLSYTTDQQALNLQREHTTLSDNVINLSEGSYRPLAPSSHLGHPVYTIFYVDDNI

SEQ ID NO: 1460 - protein, 333 aa, Azoarcus sp. EbN1
MRRVTLTQFLIEQQRAGRTSPDLRLLIEVVARAVKAIAVNVSKGALADLLGEAGTDNVQGEAQKKLDVIANEILLQANEWGGHLAAMASEEVEEVHQIPFDYPKGGYLLLFDPLDGSSNIDVNISVGTIFSVLRFPEGIQEPNEQCFLQPGREQVAAGYALYGPSTLLILTVGNGVHGFTLDREMGSFVYTHPFMTVPVDTQEYAINASNARHWEPPVQRYVAELQQGRTGPRGKDFNMRWVASMVADVHRVLTRGGIFMYPLDEKCRDQGGKLRLMYEANPMAMIVEQAGGSATTGRQRILDVQPAKLHQRVPVILGSTHEVERVTAYHREG

SEQ ID NO: 1461 - protein, 310 aa, Streptococcus pyogenes MGAS10394
MNWLITSQPYKELNMKAATYLSTGNLQLIDKPKPVIIKPTDAIVQVVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTPIQLKCY

SEQ ID NO: 1462 - protein, 822 aa, Aspergillus nidulans FGSC A4
MSAACMLIQPRDLCSQKHELVRHVETTLARSLYNCDELAAYSGTALAFRDRLIIEWNKTQQRQTLNDQKRVYYLSLEFLMGRTLDNAMLNVGMKDVAREGLSDLGFRIEDVVSQEHDAALGNGGLGRLAACLLDSLATLNYPAWGYGLRYRYGIFKQEIVDGYQVEIPDYWLDFNPWEFPRHEITVDIQFYGWVRTYEDENGKTVHSWQDGETVQAVAYDVPIPGYGTRTTNNLRLWSSKAASGEFDFQKFNAGDYESAVADQQRAETISAVLYPNDNLDRGKELRLKQQYFWCAASLHDIVRRFKKTGRPWSEFSDQVAIQLNDTHPTLAIVELHRILIDIEGLDWDVSWEIVTNTFGYTNHTVLPEALEKWSVPLLQNLLPRHMQLIFEINLYFLQFVEKKFPDDREILSRVSIIEESHPKMVRMAHVAVIGSHKVNGVAELHSDLIQSTIFRDFVAIYGPDKFTNVTNGVTPRRWLHQANPRLSDLIASKLGGYDFLTDLTLLDQLEDYADDKDFQREWVEIKTSNKLRLAKHIKETTGYSVNPNSLFDVQVKRIHEYKRQQLNIFGVINRYLKIKSMSGEEKKKVQPRVSIFGGKAAPGYWMAKTIIHLINEVSVVVNNDPDVGDLLKVIFIEDYNVSKAEIICPASDISEHISTAGTEASGTSNMKFVLNGGLIIGTCDGANIEITREIGEQNIFLFGNLAEDVEEIRHKHMYSGFTLDPQLARVFDAIRSGTFGEASHYSALLASIAEHGDYYLVSDDFNSYIKTQEMVDEAFKDREEWVSKSITSVARMGFFSTDRVINEYAESIWNIEPLPVRD

SEQ ID NO: 1463 - protein, 222 aa, Glycine max
  misc_feature (214)..(214): Xaa can be any naturally occurring amino acid
  unsure (1)..(222): unsure at all Xaa locations
MGDFNLALVIVAIVVCVIVFLFNVYLLVNFQHPDDVNQAYFPKFVVVLGLSVAAISILMLPADVANRQACRHAIYNGACNLTLPMKDLWLAIYILDAVLVFFVIPFAMFYYEGDQDKSVGKRIKSALLWMVTTAIVCALVLGILYGLIGKVDFTVRHLSSSTSQFPSTWDFNSGQQCIGNTHQCSAFTASPSSEKTWTMRTTFPEYVVALATIXGSVLFAIF

SEQ ID NO: 1464 - protein, 458 aa, Pseudomonas fluorescens PfO-1
MSVPLRAVQLNEANAFLKKHPEVLYVDLLIADMNGVVRGKRIERTSLHKVYEKGINLPASLFALDINGSTVESTGLGLDIGDADRICYPIPGTLSIEPWQKRPTAQLLMTMHELEGEPFFADPREVLANVVRKFDALGLTICAAFELEFYLIDQDNVNGRPQSPRSPVSGKRPVSTQVYLIDDLDEYVDCLQDILEGAKEQGIPADAIVKESAPAQFEVNLHHVSDPIKACDYAVLLKRLVKNIAYDHEMDTTFMAKPYPGQAGNGLHVHISILDKEGNNIFASEDPEQNAALRHAIGGVLETLPAQMAFLCPNVNSYRRFGAQFYVPNSPSWGIDNRTVAVRVPTGSPDAVRIEHRVAGADANPYLLMASVLAGIHHGLTNEIEPGAPVEGNSYEQNEQSLPNNLRDALRELDDSEVMARYIDPMYIDVFVACKESELAEFENSISDLEYNWYLHTV

SEQ ID NO: 1465 - protein, 587 aa, Bacillus sp.
MLKEAIYHRPKNNYAYAYSKDTLHIRLRTKKNDLTQVELLYADPYNWNEDGWLYEQKTMRLEASDHLFDYWIIDVTVPYRRLRYGFKLTSEDETLYYTEKGFYETAPTDDTAYYFCFPFINPVDIFQAPEWVKKTVWYQIFPERFANGDSSINPASTLPWGSTEATPTNFFGGDFEGILNHLDYLVDLGINGIYFTPIFKAKSNHKYDTIDYMEIDPQFGDKETFRKLVNACHEKGIKIMLDAVFNHSGYYFEAFQDVLKHQEQSKYKDWFHIRDFPVTPGPKPNYDTFGFVEYMPKLNTENQEVKDYLLKVARYWIEEFNIDGWRLDVANEVDHQFWRDFRREVKTINPDVYILGEIWHDSMPWLQGDQFDAVMNYPFTVAALDYIAKDKINAEEFAHQLTDVLCSYPANIHEVTFNLLGSHDTARVLTVCKDNKEKTKLLYLLLLSSKGSPCIFYGEEIGMAGENDPGCRDCMIWEEDQQDLEFKAFIKKCIELRKTEPAFSSEASFEIVEANTESNHLIYARELDGERIYFVINPTEQPITVTLPIDPTGQQIKDAWTDKSIEAVDNKVTMDISATGFGVIKVI

SEQ ID NO: 1466 - protein, 336 aa, Porphyra yezoensis
MVVKIGINGGGRIGRLVLRAALEKGGVEVVAINDPFIALDYMAYMFKYDSTHGPYKGKVEVVDGKLVIDGFTITMFGMRDPAEIPWKDVGAEYIVESTGVFTTTDKAKAHLVGGAKKVVISAPSADAPMFVCGVNEKKYTPDLSIVSNASCTTNCLAPLAKVLHEKYGILEGLMTTVHATTATQKTVDGPSHKDWRGGRGAGANVIPSSTGAAKAVGKVIPELNGKLTGMAFRVPTPDVSVVDLTVRLQKPTTYDDIKATMKAASEDDLAGILGYTEDAVVSTDFVHDNRSSIFDASAGIMLNETFVKLVAWYDNEWGYSNRVVDLITHMSKVDSA

SEQ ID NO: 1467 - protein, 949 aa, Roseovarius nubinhibens ISM
MAFEPTDYLPYDFANRRHIGPSPEEMQEMLQVVGAGDLDDLIDQTVPKSIRQEVPLNFGKPKSERELMHFMRLTASKNKVMVNMIGQGYYGTVTPPAIQRNILENPAWYTAYTPYQPEISQGRLEALLNFQTMISDLTGLEVANASLLDEATACAEAMTMAQRVSKSKAKAFFVDRDCHPQNIAVIQTRAEPLGIEVIVGNPDKMEASEVFGAIFQYPGTYGHVRDFTDYIAALHEHKAIAVMSADPLALTLLKEPGEMGADIAVGSTQRFGVPMGYGGPHAAYMACKDAYKRSMPGRIIGVSIDAHGNRAYRLSLQTREQHIRREKAMSNVCTAQALLAVMASMYAVFHGPKGLKAIAQRIHRKTVRLAKGLEEAGFKVDPQVFFDTITVDVGPLQAAVLKSAVDEGINLRRVGESRVGISLDEATRPKNIEAVWRAFGITRADEDFTPEYRVPENMHRTSAYLTHPIFHMNRAETEMMRYMRRLADRDLALDRAMIPLGSCTMKLNSAAEMMPVSWREFSRLHPYCPVDQAEGYKVMIDDLSAKLCEITGYDAISMQPNSGAQGEYAGLLTIAAYHRAQGEGHRNVCLIPMSAHGTNPASAQMVGWKVVPVKSAETGDIDLADFRAKAEQYAETLAGTMITYPSTHGVFEEHVKEITAITHEHGGQVYIDGANMNAMVGLARPGDIGGDVSHLNLHKTFCIPHGGGGPGMGPIGVKAHLAPYLPGHPSTGGGEGPVSAAPFGSPSILPISWAYTLLMGGEGLTQATRVAILNANYIAKRLEGAYEVLYRGRNDRVAHECIIDTRPFEESAGVTVDDIAKRLIDNGFHAPTMSFPVPGTLMVEPTESETKAELDRFCDAMLAIREEIRDIEEGRIDAANNPLKHAPHTVEDLVGEWDRPYSREQACFPAGAFRVDKYWPPVNRVDNVYGDRNLVCTCPPMEEYAEAAE

SEQ ID NO: 1468 - protein, 180 aa, Rhodomonas salina
GAYTGECSADQIVDIGCKWVILGHSERRQYFKEDNEILRTKLEYALSKGLKVMYCIGESLDERNANKTIEVLKSQIEPVKDLMKPESVVIAYEPIWAIGTGVTATPQQAQDTHKELRAYISEACGAATAEAIRIQYGGSANAKNAPELSACPDIDGFLVGGASLKPEFGDIIKAIAAAKK

SEQ ID NO: 1469 - protein, 329 aa, Crocosphaera watsonii WH 8501
MGKKYHVYGVGNALVDMEFRVTPELLQELQIDKGVMTLVDESRQGEIIAKFNGNLCKQSGGGSAANTMVALSQLGASGFYSCKVAKDEAGFFYLEDLQNCGLDTNVHDEKEVDGTTGKCLVMVTPDADRTMNTFLGISGSLSETELVPGAIADSEYLYMEGYLVTSPTAKAAAIKAREIAQESGVKTTFSLSDPNMVSFFKEGLLEIIGEQIEFIFANESEALKMADTEDFSEAVNYLKSLSQGFAITRGSQGSVVFDGQELIEITPYPVEAVDTVGAGDMYAGAFLYGVTHGMSYAQAGDLASRASSRIVTCYGPRLETETLKQLLNS

SEQ ID NO: 1470 - protein, 388 aa, Zea mays
MALHAAAPACAVFCRLPSPSPSHAGGRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTALAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLIHSNLKLLLVTEGPDGCRYYSKDFSGRVGGLKVSAVDTTGAGDAFVAGVLSQLATDFSLLQDEGRLREALKFANVCGALTVTQRGAIPALPTRQQVLDALTNFVA

SEQ ID NO: 1471 - protein, 362 aa, Vibrio cholerae
FTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTTTFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGYDGI

SEQ ID NO: 1472 - protein, 109 aa, Oryza sativa (japonica cultivar-group)
MAGKLYQLMSRMHLARSRSSSSSAATAAAAAADVPRGHFAVYVGERRKRFVIPTAYLKHPSFVLLLKRVEEEFGFDCHRCGGLTIPCATEGDFASFVAEAIASDDHHHH

SEQ ID NO: 1473 - protein, 1717 aa, Magnaporthe grisea 70-15
MAPAPPPLPTRFPCWCRAVYSWGGESKRDLGFIEGDLIECLNAGDGSWWTGRLRRDRRMVGVFPSNFVELLPDNFRPMSRSTSPLPQNNTPSPKDTPQKSRTFRKPFEAYAKAPHYTTAKQPETYKESPTHSRDASATSVAARAPSPAPPRAHHQSSHHQSSHRAVSPAPTHRYDDMRRAASPAPSHRYDDIRRAASPAPTQRYNDMRRAASPAPSHRYDDMRRAASPAPLQRYEGMRRAASPAPLQRYEEMRRAVSPGGFDAFGSRAPSPAPSDIAYKPYRPSVGSFDSAQQLNLQDGPESPPPPAPPPHRHVPRHNSNMSYDSQNGAGLERHVSNLSYDNRQAGLSRHGSNVQYDHQQPEIEGSRHGSNVPYGLRTTGYHTPRAPSPCPPSPGLGRGGMTPSPLREAMDGVMEQLGALGLPPQDPSPEPTTFDPWSPESFDMVHQQSRRRNNKKEQLRPQTSMGIARADSGYETYSGGSSQGGSQENTLNNVGHDPDELGLPQLSNYVERMETRLRNMHNQSSSRVDDEMAPPPPPKSQAYERPKSSMGGSIHGSSGHSGSQPKLRHRKSAYDVGRQVLGRTFTTKTNSTSTSSGNQSTTTQSTSHSLMSGASAGGISATSAGSLARKNQHRRAQSAMSMREPELDRPETPFTGVTYHSSHASDAQVTRPKSQVAYHNDDPMANIGGLGGLTTPKTKKSNFFKKILESAKTGVASTRGSIATAGAGSMNSPRGRSTPNGFIGIAGGLAGPGAGRDTAREMGLGAGVDWVQIRRDVNRSNTLSRNEGSERRERCQMMDYPALDPVDELYGSIDGDEGADGMAVAEPMNYAAINLSQVDKNSRFISGLPPTTTSITLATTYVCRPYRSDVQRLRAIFTWVAEKICWEEDFEGQIDTRRSIASKRGCAEEYAVLVYEMCAAVGIHCEVVRGYLKSPGEVPEMGLMPRSNHWWNAVLVDNEWRMIDACLASPSNPQRGLYSSAGSGVADAFWFLTRPTEICWTHIPEHHGQQHICPPVAHEILLNLPCASPPYFRNGLHLVDYNTSLTRIEDLEMVHVKFTVPEDVEVAAEVEVRAFSRDADGDIFESGDVVKKRALAQADWVGGEKRYTVKALLPGDEGTGVLKVYAGKRGLMHSIKDIPHPVAFAVPIMHTGENPPYEFVTRHPTPHAQRHDIYVVQPQCQRLALNNTFVFAIRQHPSSLGTGSAMTPSSNPGGASPIPFARPGSAMSMTSSSAAGSMPSSASTNGSGVVSGKKPAKLAIQTPGGKILRLMRKEERRNGAVGVGGRTAGSDEDASDGGTWETIIKCSEKGVWRGLVLADRTARWCVFAEWAGDGRLRPATIMTSEQQPPSPPTASQKRHAFSWFTDANYLSINQLKTLPEPKSDFTGKTVIVTGGNSGLGREAARYFARLGAAKVILACRDTAKGEVARADIEVSTRSSRPPSAAGVRLAVEVWQVDMSSGSSVHDFCARVERELPRLDSLVLNAGVAIGAFVECEGGWESSVAINVIGTFLMAVLCLPIMRRTAAQHNVAPTIAVVASEAHVFASFAERKRQGLIFDAFKSAADMNEDRYNVTKLLDVLLARELAARLGPDSPVVVNALNPGLCQSELFRHCPFPLSALLRLGLMILGRKTEVGSRTLVAAAAAGRETHGKYMDSCELANESAFVRSDEGRASGVRVFDELMGIMEGLAPGARGNLNASTTTSMATAPASTAQASS

SEQ ID NO: 1474 - protein, 471 aa, Escherichia coli
MLLPVIMAGGTGSRLWPMSRELYPKQFLRLFGQNSMLQETITRLSGLEVHEPMVICNEEHRFLVAEQLRQLNKLSSNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAGAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRTEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGSYLGEDDIIRIKDQYGRC

SEQ ID NO: 1475 - protein, 361 aa, Schizosaccharomyces pombe
MGGTINAAIKQKFENEIFDLACFGENQVLLGFSNGRVSSYQYDVAQISLVEQWSTKRHKKSCRNISVNESGTEFISVGSDGVLKIADTSTGRVSSKWIVDKNKEISPYSVVQWIENDMVFATGDDNGCVSVWDKRTEGGIIHTHNDHIDYISSISPFEERYFVATSGDGVLSVIDARNFKKPILSEEQDEEMTCGAFTRDQHSKKKFAVGTASGVITLFTKGDWGDHTDRILSPIRSHDFSIETITRADSDSLYVGGSDGCIRLLHILPNKYERIIGQHSSRSTVDAVDVTTEGNFLVSCSGTELAFWPVDQKEGDESSSSDNLDSDEDSSSDSEFSSPKKKKKVGNQGKKPLGTDFFDGL

SEQ ID NO: 1476 - protein, 296 aa, Escherichia coli
MSYYHHHHHHLESTSLYKKAGLANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 1477 - protein, 315 aa, Oryza sativa
MGPGSNNSFPAEKRVAVVTGGNKGLGLEICKQLAANGVTVVLTARSEERGAGAAAALRQLGLSEVLFHQFDVSEPSSAAGLADFIKHKFGKLDILVNNAGILGVTFDFGNLDLNKAIEGKSANETLEWLMQHTVETAENAEECLKINYHGNKKTIQALLPLLQSSPDGRIVTVSSVFGQLSFFSGEKLKEELNDFSKLSEERIDELAELFVRDFKDGELESRGWPARADAFAAYKTSKALQHAYTRVLARKHASSSSSPLRVNCVHPGYVKTDMTLGTGELTVEEGAAGPVALALSPPGGATGVFFIQTEPASFV

SEQ ID NO: 1478 - protein, 558 aa, Salmonella enterica subsp. enterica serovar Paratyphi A str.
MHHATPLITTIVGGLVLAFILGMIANKLRISPLVGYLLAGVLAGPFTPGFVADTKLAPELAELGVILLMFGVGLHFSLKDLMAVKSIAIPGAVAQIAVATLLGMALSAVLGWSLMTGIVFGLCLSTASTVVLLRALEERQLLDSQRGQIAIGWLIVEDLVMVLTLVLLPAVAGMVEKGDVGIASLAVDMGITIGKVVAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLVLIQQPLAVLATLAIIVFGKSIAAFFLVRMFGHSPRTALTIAASLAQIGEFAFILAGLGMALNLLPQAGQNLVLASAILSIMLNPVLFTLLEKYLAKTETLEEQTLEEAIEEEKQIPVDICNHALLVGFGRVGSLLGEKLLAAGIPLVVIETSRTRVDELRERGIRAVLGNAANEEIMNLAHLDCARWLLLTIPNGYEAGEIVASAREKSPDIEIIARAHYDDEVKYITERGANQVVMGEREIARAMLELLETPPAGEVVAS

SEQ ID NO: 1479 - protein, 249 aa, Mycobacterium avium subsp. paratuberculosis K-10
MGETATLVLLRHGESEWNSLNLFTGWVDVGLTDKGRAEAVRSGELLAEQGLLPDALYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGRG

SEQ ID NO: 1480 - protein, 242 aa, Xanthobacter autotrophicus Py2
METNEIIALVSGANRGIGLAIAAGLARRKGVNVLLGCRDLDRGKTASLPLLAEGLRVRPVQLDATDEASVSSLAHFIENEYGRLDALVNNAGIGLDYDPSLSVVERIQKTLDVNVVGALRLTEAMVPLLAKSTRPRIVNVSSELSSFGLRADPDWAYRDFRLPTYAASKAALNSLTLSYAQQLKDKGFKVNAICPGYTATEATNFAGTRTPEQAAVIAVKFALLDNEGPNGIFVNEVQELPW

SEQ ID NO: 1481 - protein, 392 aa, Gloeobacter violaceus PCC 7421
MVPPVKHRLSERALAVVPSLIRDASRYCDELGALNLAQGLPDFAAPAFLKEAAQRAIAADRNQYCDPWGLAQLREAIAAKCTRDNALAVDPATQVTVCCGATEGINLALMALLDPGDEVVVFSPFYENYRPNLATVEAKPRYVPLSAPDWRVDEAVLERAFAGTAPRAVIVNNPANPTGKVWSRQELELVARYCERHDAYAITDEIYEYILYDGAEHISLASLAGMAERTVTVSGLSKTFCVTGWRLGYVIASEPLTAAIRRLHDFLTICAPAPMQHAAVAALEAPADYYADLRRLYQAKRDRLVTALYRSGFEPVRPAGAYYVWTDAGVLGAKNALAAAGRLAVEAGIAAVPGDCFLPPGHPNCNLRFCYAKSDETLAAAVERLDRWSGHG

SEQ ID NO: 1482 - protein, 247 aa, Candida albicans SC5314
MSIVSLTGIEVLNNPAKFTDPYEFQITFECLEPLKEDLEWKLTYVGSSDSLDHDQELDSILVGPVPVGINSFLFKADAPSPELIPASELVSVTVIILSCSYNDKEFVRVGYYVNNEYDTEELRENPPAKVAIDHVVRNILAEKPRVTRFNIVWDNEEGADEYPPEQPEDEEEEEEEEEEGEEEEEDEDEEDDDDDEDLNGDAVVDLEKEEISTPRDNDEDIEIDIASESEVEEGGVEEEAKVNTPKD

SEQ ID NO: 1483 - protein, 474 aa, Crocosphaera watsonii WH 8501
MAETPQEVLKMIQDNNIQIIDLKFIDLPGIWQHCSFYHNQIDEDSFDAGVPFDGSSIRGWKAINESDMCMVPDPKTAWIDPFYEEPTLSLICSIKEPRTGEWYSRDPRTIAKKAVEYLQSTGIGDTAFFGPEAEFFVFDDVRFDQTENKAYYSVDSVEGRWNTGREEEGGNLAYKPGYKQGYFPVSPTDTLQDMRTEMLLTMAKCGVPIEKHHHEVATGGQNELGFRFATLIDAADYLLTYKYVIKNVAKKYGKTVTFMPKPLFNDNGSGMHVHQSIWKGGQPLFWEEGTYADLSKLATHYIGGILKHAPALLAFSNPTTNSYKRLVPGFEAPVNLVYSQGNRSASIRIPLTGSNPKAKRLEFRCPDATSNPYLAFAAMLCAGIDGIKNKIEPAEPLDVDFYELSPEELSKIPSTPGSLEQALECLGKDHAFLTDGGVFTEDFITNWIEYKLDNEVNPLRLRPHPYEFALYYDV

SEQ ID NO: 1484 - protein, 123 aa, Desulfovibrio gigas
MAKNNILIVDDSKTVRNLVAFILKKEGYKVTAAENGLDGLEKLYSMEQVDLIISDINMPKMDGFTFIRHVREQVLYRDLPIVVLSTEGQEKDIQQGLQLGANLYMVKPAQPEKLLRNVKMLLG

SEQ ID NO: 1485 - protein, 278 aa, Mycobacterium sp. MCS
MAGRTIVITGASDGVGAAAAKRLSRSGENVVVVGRSPQKTAAVADALEADSFVADFSDLAQVRDLAQRLLDAYPRIDVLANNAGGMMNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 1486 - protein, 471 aa, Gluconobacter oxydans 621H
MTTSPAPDHTPTHAGAISEEGYHKDLGRRHVQMIAIGGAIGTGLFLGAGSRLQVAGPSLAIIYAICGVFSFLILRALGELVMYRPTSGSFVTYAREFLGERAAYMAGWLSFLNWAMTGIVDITAVALYMHYWAVFLPVPQWAFALAALAIVGTMNMIGVRYFGEMEFWFSLIKVVALALFLIAGATILGTRMPVAGHTTGFHLITENGGIFPHGLFSALMLLQGVVFAYSGIELLGTAAGECEDAREILPRAINSVIWRIALFYVGSVILLVCLLPWTEYHAGTSPFVTFFQALGIPGIGTIMNIVVLTAALSSLNSGLYSTGRVLRALALGGSGPKALGKLNRSSVPYVGILTTLGVYLVGVMLNYLIPSRVFEIVLNFSALGIISTWGFILLCQLRLRAAINRGDIAPTGFNMPGAPYTTWATLGFLGFVLIMMAFDYPDGTITIGAIPLIGAILIGGWRLLDRGRRHG

SEQ ID NO: 1487 - protein, 721 aa, Zea mays
  misc_feature (286)..(286): Xaa can be any naturally occurring amino acid
  unsure (1)..(721): unsure at all Xaa locations
MAVPTTTLSHRRISSYSLVASTAALLLVFHHHVPSTTAQPLPWQLCNDTSGNFTDKSAYQANINQLATALTNNASSSPSLFAAGAAGSAPDVAYALALCRGDTNASSCARCVAASFKTAQQLCAFKRGATLYDDPCILRYADWDFLTNTTDNRGLYIAWSYDNVSAAVAPAFDAASARLVNATSDYAATDPVRRFGTGEEPFDDAKYPKIYSLAQCTPDMTVADCRACLGGVYRRFAPTYFGGKHGGRVFGVRCSLRFETYHFFSGNPLLQIPGPPGAPPPAAPAXDMTPPATGQGGGGHKNRTRLVLAIALPLAAATAILALAVACLYYRSRRRTTAQRDSSGKPCSPSPDDIDKSIDSLLFDLPALRAATNNFAESNKLGEGGFGAVYKGILSEGQQVAVKRLSLGSTQGLTELKTELVLVARLQHKNLVRLIGVCLEEDEKLLVYEYMPNRSLDTILFGTFPLLAYLPKALSVRAIDSQKSKELDWWKRLEIVSGVARGLQYLHEESQLKIVHRDLKPSNVLLDSAYTPKISDFGLAKLFHMDQSQGATSHIAGTYGYMAPEYAMHGQYSVKSDVFSFGVLILEMVTGRKNSNSDQSVDLLSLVWEHWSSGTIQELLDPFLMSHRAPPDQMAKLVNIGLLCVQDSPADRPLMSSVNVMLSSDTISLQAPSRPTFCIQETEDHSRPYSDAYKRALKLQSSTDRAAMSPNEVTLTELEPR

SEQ ID NO: 1488 - protein, 355 aa, Rhodococcus sp. RHA1
MEDESPMDSCRPDTAEQRVRNALTAIAAGRPVVVIDAADREGEGDLIFAAALATTELVAFTVRHTSGFVCVALPGDECDRLGLPAMHHSNDDRFDTAYRITVDMRGTGTGISAASRAATIAALASPDSLASDFVRPGHVVPLMARPGGVLDRPGLTEAAVDLTRLAGVPAAGALCEIVSQDRPVDMARGPELERFAKEHDLVLLSIADLIHYRQRTEPQVRRGAVTSLPTDFGRFRAVGYVGAHDGAEHMALVVDPTGGRQFEEVPVHVHTECLSGDVFRSTACGCRQELEKAMFQFCAEGCGVVLYLRPPGGPRACGIFATERNEGVNSSAMQAVADWILADLASTFPAADVSA

SEQ ID NO: 1489 - protein, 156 aa, Triticum aestivum
NKFVQKSRLVPVRNSRDIVDPRVRPRVRISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 1490 - protein, 748 aa, Zea mays
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLLARLIDGFGIGLAVTLVPLYISETAPTDIRGLLNTLPQFSGSGGMFLSYCMVFGMSLMPKPDWRLMLGVLSIPSLIYFGLTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMAASQGKPLVDPMVTLFGSVHEKMPEIMGSMRSTLFPNFGSMFSVADQQQVKADWDAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMRLMDMSGRRFLLLATIPVLIVALLVLVVSNIVDVGDVAHAALSTASVIVYFCFFVMGFGPVPNILCAEIFPTTVRGVCIAICALAFWVGDIIVTYTLPVMLNVVGLAGVFGVYAVVCVLALAFVFIKVPETKGMPLEVITEFFSVGAKQAKEEEEEEEAREG

SEQ ID NO: 1491 - protein, 331 aa, Ustilago maydis 521
MADNTTLEVDLDNVIDRLLEVRGSRPGKPVHLEEYEIKYLCLKARDIFINQPILLELEAPIKICGDIHGQYYDLLRLFEYGGFPPEANYLFLGDYVDRGKQSLETICLLLAYKIKYPENFFILRGNHECASINRIYGFYDECKRRFNIKLWKTFTDCFNCLPIAAIIDEKIFTMHGGLSPDLQSMEQIRRVMRPTDVPDTGLLCDLLWSDPDKDISGWSENDRGVSFTFGPDVVSRFLQKHDMDLICRAHQVVEDGYEFFAKRQLVTLFSAPNYCGEFDNAGAMMSVDETLLCSFQILKPAEKKQKYAYGGINMGRPVTPPRKQKKKSDGK

SEQ ID NO: 1492 - protein, 423 aa, Mesorhizobium sp. HN8A1
VMFDGSSIAGWKAINESDMVLMPDPDTVHMDPFFAHSTMVILCDILDPVSGESYNRDPRGTAKKAEAYMKSEGIGDQIFVGPEAEFFVFDDVKYKADPYNTGFKLDSTELPSNDDTDYDTGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSG

SEQ ID NO: 1493 - protein, 147 aa, Glycine max
MEQAGKQGIMVTSQSQNPIEQIQARFKELETGFRLWLSKQSLPVEAAVVTTTSAAQGAAIGAFMGTLTADASSTFPTPPPNASLNPQAMASLKQAQALAGGPLVQARNFAVMTGVNAGISCVLKRIRGKEDVQSSMAAAFGSGPCFH

SEQ ID NO: 1494 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 1495 - protein, 283 aa, Silicibacter sp. TM1040
MRKGLTFLQGVVFATAFGLAAPAFAELNANTVVATVNGEDITVGNMIVARAKLPAQYQSLPDDLLFKALLDQLIQQTVLKQQLHGDIPEYVRLSVEHEQRSLLASDVIEAVMEGAQTEDAIRDAYDARYSSDDGGDEFNASHILLESEEAALEIKSQLDEGADFAALAKESSTGPSGPNGGALGWFENGRMVPEFEAAISDMRSGEVSGPVQTQFGWHIIKLNDRRKLEAPEYEDVRDEIAQELAQQAVEDRISQLTATATINRPEIENLEPSVLRDMSLIEN

SEQ ID NO: 1496 - protein, 298 aa, Mycobacterium avium subsp. paratuberculosis K-10
MSAMLSGMARIAIIGGGSIGEALLSGLLRAGRQVKDLVVVERVPERAKYLADTYSVLITSVADAVENASFVVVAVKPADVESVMSEIARAAGQAESDTAEQVFVTVAAGVTIGYFESRLPAGTPVVRAMPNAAVLVGAGVTALAKGRFVTAPQLEGVSALFDSVGGVLSVPESQMDAVTALSGSGPAYFFLLVEALVDAGVAAGLSREVAADLTAQTMAGSAAMLLERMDADRRLGEAETPGLRVDATATQLRATVTSPGGTTAAGLRELERGGLRAAVDAAVQAAKMRSEQLRITSE

SEQ ID NO: 1497 - protein, 310 aa, Amaranthus tricolor
  misc_feature (197)..(197): Xaa can be any naturally occurring amino acid
  unsure (1)..(310): unsure at all Xaa locations
NEYIDYVGSWGPAIIGHADDEVLAALAETMKKGTSFGAPCLLENNLAEMVISAVPSIEMVRFVNSGTEACMGVLRLARAFTGKQKIIKFEGCYHGHADPFLVTAGSGVATLGLPDSPGVPKSATSDTLTSPYNDLETIKGLFEANKGEIAAVILEPVVGNSGFIPPNPGFLEFLREITKENDTLLIFDEVMTGFRLXYGGAQEYFKITPDLTTLGKVIGGGLPVGAYGGRRDIMEMVAPAGPMYQAGTLSGNPLAMTAGIHTLKRLMQPGSYEYLDKITSELTQGIIAAGKKTGHAICGGYISGMFGFFF

SEQ ID NO: 1498 - protein, 192 aa, Arabidopsis thaliana
  misc_feature (137)..(137): Xaa can be any naturally occurring amino acid
  misc_feature (142)..(142): Xaa can be any naturally occurring amino acid
  misc_feature (144)..(144): Xaa can be any naturally occurring amino acid
  misc_feature (149)..(149): Xaa can be any naturally occurring amino acid
  misc_feature (151)..(151): Xaa can be any naturally occurring amino acid
  misc_feature (159)..(159): Xaa can be any naturally occurring amino acid
  misc_feature (162)..(162): Xaa can be any naturally occurring amino acid
  misc_feature (165)..(165): Xaa can be any naturally occurring amino acid
  misc_feature (168)..(168): Xaa can be any naturally occurring amino acid
  misc_feature (173)..(173): Xaa can be any naturally occurring amino acid
  unsure (1)..(192): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAXVLKEXDXCKKEXPXAFIRIIGXDNXRQXMHXFIGYXPQLELIPWISAPILALILL

SEQ ID NO: 1499 - protein, 544 aa, Zea mays
MGKKAWLTAVKRAFRSPSKDDSSSPARKASRLREDADGEDDKGKRERRRWLFRRSSSPSPAPAPPAPAPAAVTEEQRHAIALAVATAATAEAAVATAQAAAEVVRLTRPGGHAAAPSFARRDHHAAVAIQTAFRGYLARRALRALRGLVKLQALVRGHNVRKQANMTLRCMQALVRVQARVRDRRMRLSQESVLSMSGGGGGAGAAPCGSSKSSYSVDTSAFWDPKYAHDYADRRSVERSRDGSSFAADDWDDRPRTIEEIQAMLQTRKDAALKRERALSYAFSHQIRRNPAAPSADMDVDVDVDGQPRWAERWMASRASFDTSRSSVRGAAAAAPGRASMEQHREPVKTLEMDTARPFSYSTPRRHAGASSPMHRAQQNQHHPAVATPSPVKARPPIQVRSASPRVDHHHRGTGGGGGSYTPSLLHSQRHAAAVPNYMAATESAKARVRSQSAPRQRPTTPERERDRGAKKRLSFPGQLQHQVLAAEYAQSLRSPSFKSAAGRFSSEQRSTVSSSCADSLGGGCGGDVGSPSSSAADLRRWLR

SEQ ID NO: 1500 - protein, 639 aa, Zea mays
MPWRRASLGVVTSSLLVRLPVALSRLAGRRRQTSSSSSTRRPGPGHAMPEKEAQAAAFCGEAVIAEFESLTRDAAAVQRDTLRRILADNACAEYLRCRGLAGRTDAASFRACVPLATHADIEPYIARIADGDTSPVLTAKPITSISLSSGTTQGKRKYLPFNQELAKSTMQIYRTSYAFRNRAFPVEDGKALQFIYGSRQFTTKGGLTATTATTNVYRSEEFMPTMRAIQSQVCSPEAGDLRADFAQSLYCHLLCGLLYADEVRIVSATFAHSIVLAFQTFERVWEELCADIRAGALSPARVAAPAVRGAVEALLAGPDPARADEVARRCAGLSNWYGVIPALFPNARYVHGIMTGTMEHYVKKLRHYAGGLPLVAAEYGASEGWVGANVEPETPPESATFTVLPNIAYFEFIPLKAATGHGGGTAGDTCYAEAEPEPVGLTEVTVGEHYEVVVTTFAGLYRYRLGDVVQVAGFYNSTPKLKFVCRRNLLLSINIDKSSEQDLQLAVDSAAKVLAAEKLEVVDYSSHAEVSRDPGHYVVFWELNADAGDDVLQSCCDELDRAFADPGYVGSRRARGIGPLELRVLQRGTFQKVLRHYLSLGAPVSQFKSPRCVGRANNSGVLQILSANVVKAFFSAAYD

SEQ ID NO: 1501 - protein, 400 aa, Pseudomonas putida KT2440
MRAVSYHGANDVRVDSVPDPILQDADDIILRVTATAICGSDLHLYRGKIPETEQGDIFGHEFMGIVEEVGRDVTTLQVGDRVVIPFVIACGSCFFCQQDLFAACETTNTGRGSIINKKGIPPGAALFGYSHLYGGIPGGQADYVRVPKGNVGPFKVPTTLADDKVLFLSDILPTAWQAVINAEIGEGSSVAIYGAGPVGLLSAACARMLGAHTVFMVDDNDYRLAYAQEAYGVIPINFEKDDDPADSIIRQTPGMRGVDAVIDAVGFEAKGSTTETVMTALKLEGSSGKALRQSIAAVRRGGVVSVPGVYAGFIHGFMFGDAFDKGLTFKMGQTHVQKYLPELLEHIEAGRLQPELIVTHRLALEEAAMGYKMFDQKQDNCRKVILVPGAAPGTLGPDHL

SEQ ID NO: 1502 - protein, 408 aa, Magnetococcus sp. MC-1
MSDFNSITEILEDFRQGKMVILVDDENRENEGDLIVAAEFCDAPAVNFMTKHGRGLICLSLTQARVEKLQLPLMVVDNDAKFKTAFTVSIEAKVGVTTGISAQDRARTIEAAIADTSGPEDISRPGHVFPLVAKDGGVLVRAGHTEASVDLARLSGLKPAAVICEILKDDGTMARVPDLIPLAKQMGIKLGTIADLIAYRRQTEQLVHRAVETRLPSAYGGEWKLVAYTNDVDQHQHVALVKGNVDDGSPVLVRVHSECLTGDMFGSLRCDCGPQLQAAMEQIGQEGRGVIVYLRQEGRGIGLINKMHAYNLQDEGQDTVEANEALGFSADLRDYGIGAQILKDLGVTHMKLMTNNPKKIVGLTGYGLDVVDRVPLEIKSGMTNERYLRAKKHKLGHMLRQFPESNES

SEQ ID NO: 1503 - protein, 267 aa, Chromobacterium violaceum ATCC 12472
MRITFIGGGNMAGAIIGGLARQGGHRIHVVEHQQDKLDQLAAGFGCSGSQALPERFAADEVVVLAVKPQQLRELCLALAPVLNGALVVSIAAGIRLDALARWLGSRRIVRVMPNTPAMVGKGVSGLYADAAVSAADRDAAETVMRAAGLTVWLADEAGIDDITCVSGSGPAYVFYFIESMIEAAAKAGFGEDKARELVLATFDGAVELARQSPLPVAELRRNVMSKGGTTERAIARFEAEGVKAAIVAGAMDCRDRSIEMGRELSQE

SEQ ID NO: 1504 - protein, 978 aa, Candida glabrata CBS 138
MTRFNFAIGHDEDGTTDLGKVATDTTTTTGSSIPVRSSMDSDSFSHDEDAELSRSMDDSQDAREVKSMNSEYSSDDGSKDRTKKEINSAEYSADIQPLQFKMSRRRTTQFDGTESSKASRKANASGNGSDPIKTLRFDEGSLSSSPTAIASDATRASLQRDTFAKVREHIQRGSVGNSGLTRSDFNPFAFIDREQFETYLKEPRYIRIFKKRSRSSKQFRRLFLAQELKTTDEFDDIEAMSASLLSQPDGLKPNTSITNATLNGNNFHDNINDPNHDMHSDKTFSGTACPVLPTSGHLEPAKNTKAIWSTKFSIDGKYMATGSRDGVLRLWKVLSTPVERWGLDSSIDSAHLTSAKSLRLQQNQHGSSHGGPLGSPAMRRDTFDNIDAKENSSNLYAPVFQPTPVRTYKEHLHDVLDMDWSKNNFLISASMDKTAKLWHPSKMRSLKSFQHPDFVTCVKFHPTDDRFFISGCLDQKCRLWSILDDEVSFEFNCRDLVTSLTLTPGDGTYTIVGTFNGYIHVLQTKGLEHITSFHVTAKKTHENTHEVLCPSNDSKVRHGPRVTGLQCFNSLIDNSLRLVVTSSDSRIRVFDLTRRKLIEILRGFQCGSSQHKAQISVYRNQPIVINSSDDHWVYGWRLKSSDPVEINKKAKKHGMSRSGSIRGLFSKSISRSSSQGSEDRQSLRNTLKLSSLLPIPHSSHSDGVMKNSDYFSFHAHNAPVTTVTMAPEETSKTLSLSNDPICELSLEFFEPSDEVDIIKLKDTQKGGHDNIPATKTPVTTSLAKPTPVEVIGSILISTDSNGLIRVFRADMSKSIRARVLQKLQKYNREMGKQYGSTDSLVSENDKSRPNLGTVGHQPSTNSTSFLSSTGSTNTTTVGSGSKASITRNHSFRSLKAFKSPTANFSNTALGATMNRAPRESISSVRSDSTSNTMTPMSFPGLKCHVCDGTKFEPLTRSSGSQDKSYFCVDCKTLLNNFR

SEQ ID NO: 1505 - protein, 318 aa, Vibrio fischeri ES114
MKEHTKKLEILRLLSDGHFHSGEELGEQLNISRAAISKHINVIQSWGLEIYKVKGKGYSLSTPIELLQQELVSHNKLPKPEVLGVVDSTNQYLLNNMTSLECGQSCIAEYQSAGRGRRGRSWVSPFGGNIYLSLYWRLDDGLAATMGLSLAVGIAVVEALENLGCSGLKLKWPNDIYWNNRKLGGVLIELSAQSGGAAHVVIGIGINVDLSERFTSEIDQPWVDLKTILGQNHIRNKLANTLLVSLEETMKAFECFGLSHFIERWNRYDNFKGQEISLQLGNGTVTGVCNGIDAQGALLLINADGLTAYNGGEISIKK

SEQ ID NO: 1506 - protein, 498 aa, Debaryomyces hansenii CBS767
MDYLESQIKQIKSLNKDENIITYKTISHGGFLTYDGIDVNGKRIANEITAETDKLTSNGNGVKKFSILGYSLGGLISRYAIGVLYYEGYFEKVLPVNFITFCTPHVGAIKPYRSFLAKMFNGFLSYFLAHSGAQMFLKDKQPVKSEYGGNNDLNLPLLVWMAEPSSTFYIALSKFKHRMVYANAIGDKRAGFFTAAIATMDPFSSMVDRNVSAYDFEYVKGYEPTVIDFTKPISFSRIDETNTTPVYPIWSIIVKWVKLLVGIILVTPLWGLWFLYKTISERIKLNKRVSLFFNETSLLYLYSYPDHIFDDITSEDETPQPKNEKSELELNDKDGPHESFIYSLEKELGEQVRDQTDIFVDSIFDAANSQSYEEYEYSISSRKRKRRNKDKPAPKSDNEFSSTINEMENLNDSSDPLLSQSKLVTLKGKKIDDFRLKLSSNELYIIQKLNKLDWEKYPVIIRKTALTHSAAIVRQDEPAFEEGKTVVRHFVEQAFKLE

SEQ ID NO: 1507 - protein, 195 aa, Arabidopsis thaliana
RRIPGRPPRRPSNTGRTSMTLSHATMDASPGQATMVAPFNGLKSSDAFPATRKVNNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 1508 - protein, 326 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDILVENGIVPGIKVDKGLAPLANSNNEQWAMGLDGLDTRCAEYYKTGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNPPNPTLGQVSFLLTPVPCRTPC

SEQ ID NO: 1509 - protein, 519 aa, Populus tremula x Populus tremuloides
MAGGAFAPTSGGKEYPGKFTFRVFFTCLFAATGGLIFGYDLGISGGVTSMDVFLKDFFPDVYQKESSVKPSDDQYCKFDSQILTLFTSSLYLAALVSSIGASMATRTYGRRPTMMTSGLLFAAGAIVNGLAKNVVMLIVGRLLLGFGIGCANQSVPIYLSEVAPYKYRGALNMMFQLFITIGILIANSLNYAFARLIGGDMAWRLSLGGAIVPGLIILLGSCFLPDTPNSEIERGNYERAKDLLLKLRDVDNVDEEFNDLVEASEKAKLVKHAWLNIFKRKYRPQLVFAFCIPMFQQLTGMNVIVFYAPVLFKTIGFGSNASLLSSLITGFVNMVATFVSIFTVDKLGRRKLFLMGGTQMLICQVVITIAIAMKFGVSGNPGVISGTYAGAVVAFICVYVAGFAWSWGPLGWLVPSEIFPLEVRSAAQSINVSVNMIFTFVIAQIFTAMLCHLKFGLFICFAVCVVIMSIFIYKLLPETKGVPIEEMTIVWRNHPHWSKYFDEDDAQFEASKPKDIASA

SEQ ID NO: 1510 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 1511 - protein, 399 aa, Oryza sativa (japonica cultivar-group)
MSFSRLLTPRILLDTTAVFPPSSSVVAPSLSRQLRCTRTGGSPPAPPHRLVARRAMSNGAAEPAIYGGGGGAQQAASSAAARRVTLATLRGKHRRGEPISMVTAYDYPSGVHVDAAGFDICLVGDSAAMVAHGHDNTLPISLDLMIEHCRAVARGAARTFLVGDLPFGSYEASTAQAVGSAVRVMKEGGVNSIKLEGSAPSRISAARAIVDAGIAVMGHIGLTPQSVSALGGFRPQGKTVESAVKVVEAALALQEAGCFAVVLECVPAPVAAAATSALTIPTIGIGAGPFCSGQVLVYHDLLGTFQTSHAKVSPKFCKQYGNIGDVINRALSKYKQEVETQSFPGPSHTPYKLAATDVDAFLNALKMKGLNVAADAAADAVEYTDEKEINGTPQLKVYA

SEQ ID NO: 1512 - protein, 420 aa, Arabidopsis thaliana
MALSSLLRSAATSAAAPRVELYPSSSYNHSQVTSSLGFSHSLTSSRFSGAAVSTGKYSAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 1513 - protein, 488 aa, Arabidopsis thaliana
MPVWPLVGMLPSLISAVRSNIYEWLSDVLISQNGTFRFRGPWFSTLNCVVTCDPRNVEHLLKTRFSIYPKGSYFRETMQDLLGDGIFNTDDGTWQRQRKAASVEFHSAKFRQLTSQSLHELVHNRLLPVLETSGKIDLQDILLRLTFDNVCMIAFGVDPGCLSPKLPEIPFAKAFEDATEATVVRFVMPKFVWKLMRSLNLGTEKKLKESINGVDDFAEEVIRTRKKEMSLETEIAKRPDLLTIFMGLRDENGQKFSDKFLRDICVNFILAGRDTSSVALSWFFWLIEKNPEVEEKIMMGICKILEQRVDHGDTKKNMEYEPVFRPEEIKKMDYLQAALSETLRLYPSVPVDHKEVLEDDVFPDGTKLKKGEKVIYAIYAMGRMETIWGKDCREFKPERWLRDGRYMSESAYKFTAFNGGPRLCLGKDFAYYQMRYVAAAIIYRYKVRVDDKGGHKVEPKMALTMYMKHGLKVNMVKRSVSEIDHYYC

SEQ ID NO: 1514 - protein, 136 aa, Arabidopsis thaliana
  misc_feature (2)..(2): Xaa can be any naturally occurring amino acid
  misc_feature (28)..(28): Xaa can be any naturally occurring amino acid
  misc_feature (97)..(97): Xaa can be any naturally occurring amino acid
  misc_feature (100)..(100): Xaa can be any naturally occurring amino acid
  misc_feature (106)..(106): Xaa can be any naturally occurring amino acid
  misc_feature (109)..(109): Xaa can be any naturally occurring amino acid
  misc_feature (111)..(113): Xaa can be any naturally occurring amino acid
  misc_feature (118)..(118): Xaa can be any naturally occurring amino acid
  misc_feature (125)..(125): Xaa can be any naturally occurring amino acid
  misc_feature (129)..(129): Xaa can be any naturally occurring amino acid
  misc_feature (131)..(132): Xaa can be any naturally occurring amino acid
  misc_feature (134)..(134): Xaa can be any naturally occurring amino acid
  unsure (1)..(136): unsure at all Xaa locations
MXSSMLSSTAVVTSPAQATMVAPFTGLXSSASFPVTRKANNDITSITSNGGRVSCMRVWPPIGKKKFETLSYLPDLSDVELAKEVDYLLRNRWIPCXEFXLEHGFXYRXTXXXPVTFXGRSWPIXEVSXFXXTXSR

SEQ ID NO: 1515 - protein, 233 aa, Thermoplasma acidophilum
MGQVFLQSRRIAEYEVDLLGEPGTVLEIGPGHGVLTKILVERGFKITAVEKDRYIFGELQSLRAANLNLINMDFLDMAPGSYDYIIGNIPYSISSPIVFKLYEFEFRRSVIMVQKEFAEKIAFPDDMSRLYVNAHVRYNVELKRYVSRKNFNPQPEVDSAILVLEKKKYEEPYPLEFLDGVLVQMFSKKRKKLSNIFDICPEDLADKRPSNLTVSEILGLARLLFDSGSSAHR

SEQ ID NO: 1516 - protein, 462 aa, Streptomyces avermitilis MA-4680
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 1517 - protein, 527 aa, Glycine max
MQSSPLLLEEPIRMASILEPSKPSFFPAMTKIVGTLGPKSRSVDVISQCLEAGMSVARFDFSWGDPEYHQETLENLRAAIKSTKKLCAVMLDTVGPELQVVNKTEHPISLQADTLVVLTPDQNKEATSNLLPVNFSGLSKAVKNGDTIFIGQYLFTGSETTSVWLEVSEVNGDDVTCVIKNSATLAGSLYTLHVSQIHIDLPTLDNKDKEVISTWGAQNNIDFLSLSYTRHAEDVRHAREFLSKLGNLKQTQIFAKIENIEGLTHFDEILREADGIILSRGNLGIDLPPEKVFLFQKAAIYKCNMAGKPAVVTRVVDTMTDNLRPTRAEATDVANAVLDGSDAIVLGAETLRGLYPVETISTVGKICAEAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDE

SEQ ID NO: 1518 - protein, 130 aa, Brassica napus
  misc_feature (39)..(39): Xaa can be any naturally occurring amino acid
  misc_feature (68)..(68): Xaa can be any naturally occurring amino acid
  misc_feature (118)..(118): Xaa can be any naturally occurring amino acid
  unsure (1)..(130): unsure at all Xaa locations
GGTSIHETYYEILSVKEDASYDQIRNSYRFGILQSQPDXLNNSPGWSSNDKFPKIQKGLEVLSGGKLXLVKKTNLRSSKQDGGTTADEISIEDMSVEINGQDMEIFYQCRCGDYFSVXSSELESMGFELL

SEQ ID NO: 1519 - protein, 472 aa, Pseudomonas fluorescens PfO-1
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALHAASAAK

SEQ ID NO: 1520 - protein, 175 aa, Triticum aestivum
MAPTVMASSATSVAPFQGLKSTAGLPVSRRSNGASLGSVSNGGRIRCMQVWPIEGIKKFDTLSYLPPLSTEALLKQVDYLIRSKWVPCLEYSKVGFIFREHNASPGYYDGRYWTMWKLPMFGCTDATQVINEVEEVKKEYPDAYVRIIGFDNMRQVQCVSFIAFKPPGCEESGKV

SEQ ID NO: 1521 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 1522 - protein, 163 aa, Triticum aestivum
  misc_feature (95)..(119): Xaa can be any naturally occurring amino acid
  unsure (1)..(163): unsure at all Xaa locations
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVXXXXXXXXXXXXXXXXXXXXXXXXXEVEEVKKEYPDAYVRIIGFDNMRQVQCVSFIAFKPPGCEESGKA

SEQ ID NO: 1523 - protein, 711 aa, Myxococcus xanthus DK 1622
MTVATREHTRTLRAAESLGKDLGRGLARMDPADMKRLGAHVGDIVTLSGKRRSAAKVMPSYPDARGRGILQIDGVTRANTGVQLDEPVKLTLAPARHAEKVVLAPLEFTPAQRDLAYIGTLLDGLPVVKGDRVRALLFGSRTADFRVVETTPVGAVVIHPNTLLEVAKAPEKEKVTHERARAVSYEDVGGLKRELGRIREIVELPLRYPEVFERLGIDAPKGVLLYGPPGCGKTLIARAVAHETAAAFFTITGPEIMHKFYGESEAHLRQIFDEAQRRAPAIIFVDEIDAIAPRRENVQGEVEKRVVAQLLSLMDGLAQRRHVIVLAATNIPNVLDPALRRPGRFDREIAISIPDRTARKEILAIHSRGMPLAEDVDLDHLAAVTHGFVGADLQALCREAAMLCLRRLIPHIDFASAEIPYDELIQVQVTMADFQAALHEVGPSAIREVFVETPDVGWKDVGGLGQLKQRLIEAVEWPLRYPEEFARAKVRPPKGVLLSGPPGCGKTLMAKAAAHESQVNFISVKGPALLSKFVGESERGVRETFQKARQAAPCIIFFDEIDSLVPTRSAGGMDERVTERVVSQFLAEMDGIEELTGVLVLAATNRADLLDPALLRPGRFDLLVDVPLPDREARRDIFQVHLRDKPVEKDLDLGGLAARSESFSGADIQAVCNQAAWEAVRHVISGKGKRLVITSESLLKAIRGHKEARRP

SEQ ID NO: 1524 - protein, 241 aa, Triticum aestivum
  misc_feature (117)..(117): Xaa can be any naturally occurring amino acid
  unsure (1)..(241): unsure at all Xaa locations
RREREREREREREREREREREREREREREREKNWNYAISYGVASTSPLSPSFNFSLELARNTQLIASFYQHLVVQRRIKNPFEDDQVVGITNYIDLGLELATGIDKSKPAESGNSSXLFQLGASWQANKNFLLKGKLGPSKSSVALAFKSWWRPSFTFSVTAENDHSKGTTSYGFGIRVEDLRKPSYERADPNYVMMSTNKEHLAPAALREFGQRPMFQADVDSGNFDHLPTELRPMSKII

SEQ ID NO: 1525 - protein, 335 aa, Debaryomyces hansenii CBS767
MLAPSLSWAEAKQFLSIFWPPKPTFIPAEYPDLAGKVVIVTGGNTGVGYQTAKLMSGVCNAKVYILSRNEAKTKLAIDNIQMEIKREQNKDVNLRFIKLDLSDLPTIKQTANDFLKEEDRLDIIIHNAGVMTPPMGSKTAQDYDLQWGTNVLGPFLLQKLLDPLFIETSKKNPTNLSRVVWASSTAHLSAPDKGGIYWDDVNFEDPSKKYSNGEIYGQSKAGVIINAIQWSKRYSNENIVSISLCPGGLKTDLQRHLPGFVRSVLNLLLYDAVFGAYTEMFAAVSPEVTSENNNHRMILSFGRFGIIRKDIEEGANGENGEKYWNYAEKQVSKYL

SEQ ID NO: 1526 - protein, 562 aa, Bacillus sp. DG0303
MQHPWWKKAVVYQIYPKSFNDTNGDGIGDLAGIIEKLDYLKQLGVDVIKLKPIYKSPQRDNGYDISDYFQIHDEYGTMEDFDRLLEEVHRRGMKLIMDMVVNHTSTEHEWFKQARTSKDNPYRHFYIWRDPKPDGSAPTNWQSKFGGSAWEYDEKTGQYYLHLFDVTQADLNWENEELRRRIYDMMHFWFQKGVDGFRLDVVNLLSKDQRFLDDDGSMPPGDGRKFYTDGPRIHEFLHEMNREVFSKYDVMTVGEMSSTTIDHCIKYTNPERRELNMVFNFHHLKVDYPNGEKWAVADFDFLALKRILSEWQVEMHKGGGWNALFWCNHDQPRIVSRYGDDGKYHKESAKMLATVIHMMQGTPYIYQGEEIGMTDPKFERIDDYRDVESLNMYHILREQGKSEQEVLEILKRKSRDNSRTPMQWDDSENAGFTTGKPWIRVAPNYQQINVKKALEDPTSVFYHYQRLIQLRKQYDIITTGDYQLLLEDHPDIFAYLRNGENEKLLVVNNFYGRETTFILPDDVDVNGYASEILISNYDDSPSDFRKITLRPYESIVYYLTKS

SEQ ID NO: 1527 - protein, 350 aa, Glycine max
MQAASSGIGYGLKYQARCISDVKADTDHTSFLAGTLSLKEENEVHLIRLSSSGTELFCEGLFSHPNEIWDLVSCPFDQRIFSTVYSNGETYGAAIWQIPELYGELNSPQLERITSLDTDSGKIKCILWWPSGRHDKLISINEENLYLWNLDVSKKTAQVQSQDSAGMLHKLSGGAWDPHDVSSVAATCESYLQFWDVRTMKKTMSIECSHVCSVDYHPQKQHILVTAEHESGIHIWDLRKPKVPIQELPGHTHWTWTVKCNPEYDGMILSAGTDSTVNLWLASTNHDELTTERQVDSSARWVDPLLNTYSDYEDSIYGLTWSSREPWIFASLSYDGRVVVESVKPFISKK

SEQ ID NO: 1528 - protein, 473 aa, Xanthomonas smithii subsp. citri
MQHPRAFACLGDRVTDLLVRTSVEEGDAHVCFLRAHKRCRAVRAGQSIECGGVEQEHEIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 1529 - protein, 444 aa, Bifidobacterium longum NCC2705
MQKFSNMPLSEVASAAVPAARRVAVPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 1530 - protein, 433 aa, Glycine max
MGMERVQCAYASLDEAFEIGKEAYQGQQYSQIYFARLHLMRTLLYSLVPHWKPNFPVCTVLGLEEGKECVIVGTLYKHMKLKPCILDEYSKERSVVPLVKPHNFIHPDDHLVLEDESGRVKLSGSIILPSEYVTGIVVALLGKETGAGDFLVQDVLDAGLPPQIEFPLKPREDKYVVLVSGLSVGSSSSNPLQFQLLIDHITGHLGDEKEQSIASQIVRVVFAGNLVEIPRRLLNGQNLASKDLSRMAEPIKELDILLSQIAAGLPLDIMPGPSDPANFSLPQQSLHRCLFPGSSAYNTFRSCTNPHCFEVDNVRFLGTSGQNVDDLEKYSEAKDKLEFMERTLRWRHLAPTAPNTLGCYPYTDKDPFFIESCPHVYFVGNQDKFETRVIKGSEGQLVRLICVPKFSETGVAVMLNLRDLDCHALSFGTQFSS

SEQ ID NO: 1531 - protein, 120 aa, Brassica napus
MEEDNHEKQLDDGGSSSLFKTCFNALNALSGIGILSVPYSLARGGWLSLSLLLLLAATAFYTSLLITKCMNADRTIKTYPDIGERAFGRPGRIIVSVFMHLELYLVTTGFLILEGDNLHN

SEQ ID NO: 1532 - protein, 494 aa, Streptomyces avermitilis MA-4680
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 1533 - protein, 469 aa, Mesorhizobium loti MAFF303099
MTTAKDIMKQIKDNDVKFVDLRFTDPKGKLQHVTMDVVEVEEDMFADGVMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGLDGIKNKIHPGQPMDKDLYDLPPKELKKIPTVCGSLREALQSLDKDRGFLKAGGVFDDDQIDSYIELKMAEVMRFEMTPHPVEYDMYYSV

SEQ ID NO: 1534 - protein, 141 aa, Xanthomonas campestris pv. vesicatoria str. 85-10
MALERTLSIIKPDAVAKNVIGEIYSRFEKAGLKVVAAKYKQLSRREAEGFYAVHRERPFFNALVEFMISGPVMIQALEGENAVAAHRDLLGATNPKDAAPGTIRADFADSIDANAAHGSDSVENAANEVAYFFAATEVVSR

SEQ ID NO: 1535 - protein, 249 aa, Brassica napus
  misc_feature (223)..(223): Xaa can be any naturally occurring amino acid
  misc_feature (244)..(244): Xaa can be any naturally occurring amino acid
  unsure (1)..(249): unsure at all Xaa locations
MANHHRLLRGVGSPAIRIRLTGFVATIALSLFALSFLFASESNNDSPDLLLPGVGSIRRSMLDIKPDPLKPRLLQIRKQADDHRSLALAYASYARELKLENSKLVRIFADLSRNYTDLINKPSYRALHDSDGSSSIDESTLRQFEKEVKERIKMTRQVIAEAKESFDNQLKIQKLKDTIFAVNEQLTNAKKQGAFSSLIAAKSIPKGLHCLAMRLMEERIAHXEKYTDEGKDKPGELEDPSLYXHYAIF

SEQ ID NO: 1536 - protein, 489 aa, Burkholderia sp. 383
MSTVQETLALKDPSLFRQQAYVNGEWQGATNGETFEVRNPATGGLLGTVPAMGTAETRHAIEAANAAWPAWRKKTAKERAVVLRKWHDLMMEHADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGEMTSNPIVRKLSFTGSTPVGRLLMSQCAATVKKVSLELGGNAPFIVFDDADLDAAVQGAIASKYRNSGQTCVCTNRFYVHEAVYDQFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 1537 - protein, 282 aa, Streptococcus pyogenes MGAS10394
MAMIQWFPGHMSKARRQVQENVKHVDFVTILVDARLPLSSQNPMLTKIVGDKPKLMILNKADLADATRTKEWKAYYESQGIKTLAINSKEQSTVKKVTEAAKELMADKIQRLRERGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTHYPSRLTKRFKNIPLEEEAPEIIMTLTRQLGFKDDYDRFYTLFVKEVRDGKLGQYTLDQVGDMDVD

SEQ ID NO: 1538 - protein, 461 aa, Escherichia coli
  misc_feature (193)..(193): Xaa can be any naturally occurring amino acid
  unsure (1)..(461): unsure at all Xaa locations
MADNKPELQRGLEARHIELIALGGTIGVGLFMGAASTLKWAGPSVLLAYIIAGLFVFFIMRSMGEMLFLEPVTVAFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGXFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 1539 - protein, 515 aa, Exiguobacterium sibiricum 255-15
MKKRPVALIILDGFGMRDEEFGNAVTAANKPNFDRYWEQYPHTLLNAKGEYVGLPEGQMGNSEVGHLNIGAGRVVYQSLSRINNAIKDRSFFSRQAMNDAAGHVKKYGSALHIFGLVSDGGIHSHINHLYAVLEFAKLHEIEKVYLHAFTDGRDCDPQSGAGFLRDAQAKMDELNVGQFASVSGRYYAMDRDNRWERVKKVYDVITFADGPTTKDPIAMVEASYKTDVTDEFIEPTVVVQEDGTPVAPIHDNDAIMFFNYRPDRAIQLAKTYKEKTGFTGFELPDNVPKNLLLVSMTKYSDAIDTDIVFPPEDIKNTLGETLSKQGLKQLRIAETEKYPHVTFFFNGQREEPYEGEDRILIPSPKVATYDLKPEMSVYEVTEALVDAINSDKHDAIILNFANPDMVGHSGMLEPTKKAIEAVDKCLGQVVDLIISKGGAAIITADHGNADKVLNADGSKMTAHTTEPVPCIVTVEDVELLKPLTGVLADLAPTVLDLLGADQPAEMTGKSIVLKK

SEQ ID NO: 1540 - protein, 287 aa, Zea mays
MAAPPVQPVPTAAAAAAAVNGDAFRLGFVGAGNLAESIARGVAASGVLPASAIRTAPHRRPERGEAFASFGACLLQTNAHVVDDSDVIVISVKPQIVKQVLLQLRPRLSEKKLLVSIAAGIKMQDLQDWSGQRRIIRVMPNTPSAVGQAASVMCLGEMATQDDENRVRKLFSAIGKVWTAEEKYFDAVTGLSGSGPAYIFLAIEAMADGGVAAGLPRDLALGLASQTVLGAATMVSQTGKHPGQLKDQVTSPAGTTIAGIQELEKGAFRGTLISAVVAAAKRCRELS

SEQ ID NO: 1541 - protein, 97 aa, Arabidopsis thaliana
RSSAHASAPKLWINLFSPSKVLRRSYRAAKMDPCHSLIHTDDVPATPKANNDITYITSNGGRANCMQEWPPIGKKKYETVYNLTDLTESELANDVDY

SEQ ID NO: 1542 - protein, 412 aa, Triticum aestivum
MSCLGWLNRRKGSGSGRRGSSASAPATTMTTMTTTTTTTTTTGSAVSTSRSDDSGAGRPTSKSTGSASSQRSISSLYEERGHGQLRAFEYDDLRAATNDFGRAQSLGEGGFGGVYKGFVRPLDPRADRIAVAVKRLNTRGLQGHKQWLAEVQFLGVLEHPNLVKLLGYCAVDGERGAQRLLVYEYMPNKSLEDHLFSRIHPALSWNRRLQIILGAAEGLAYLHEGLELQVIYRDFKASNVLLDKDFQAKLSDFGLAREGPTEGNTHVSTAAVGTHGYAAPEYIEKGHLTAKSDVWGFGVVLYELLTGRRSLDRNRPQGEQKLIEWVVQFPPDSRNFRMIMDPKLRGEYSSKAAREIAKLAQSCLLKNPKERPAMSEIVEVLRRAVQTEQAYVDKAPVAGNGKRVNVAPPSRR

SEQ ID NO: 1543 - protein, 174 aa, Triticum aestivum
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 1544 - protein, 141 aa, Azoarcus sp. EbN1
MAIERTLSIIKPDAVAKNVIGKIYQRFEDAGLKIIASKMVHLSEREAGQFYAVHKERPFFKDLVSFMISGPVMIQVLEGESAIATNRDLMGATDPKKADAGTIRADFAESIDANAVHGSDAPETAAVEIAFFFPGMNVYTR

SEQ ID NO: 1545 - protein, 389 aa, Xanthomonas campestris pv. vesicatoria str. 85-10
MRALCWNGINDLRVETVPDPVLVNPRDVILKVGLTTTCGSDLHFIDGYLPTMREGDVIGHEFMGTVVEVGNAVKNVRVGQRVVVPSFISCGGCWHCERKEFSLCDNTNPNWEMQEPLLGHATAGIYGYTHAFGGYAGSHATYIRVPHADVGCFEVPDGVSDEDALFLSDAGPTGFMGADFCNIQPGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPRLLDLAQAGRLKSGFLLTHKMPLEDAVRGYDMFKHKHDGCVRAGFVP

SEQ ID NO: 1546 - protein, 866 aa, Thermosynechococcus elongatus BP-1
MNNPATPDGYPVHSVSQTNPAAKDEHCDLYIESDRTGMTVQTLKRAFVDNLHYIQGKDAMFATPYDYFMALAYTVRDRLLHRRIKTAQTYFEQDAKVVYYLSAEFLIGRLLLNNLINVGLYEQTKQAMADFGLDLNELMDREPEPGLGNGGLGRLAACFLDSLATLEIPAVGYGIRYEFGIFEQIITNGWQHEVPDNWLRFGNPWEIARPDYNVEVKFGGHTEAYTDAQGHYRVRWIPSTTVFGTPYDTPIPGYGKNTVNTLRLWSARAAQDFNLQVFNAGDYTQAVSEKTFSENISKVLYPNDNTPQGKELRLRQQYFFVSCSLQDIIRLYLRRHTSFDAFPDKVAIQLNDTHPAIGVAELMRLLVDEYQLGWEKAWDITQRTFAYTNHTLLAEALERWSVDLFGQLLPRHLEIIYEINYRFLNEIRLRYPGNTARLARMSLIEESYPKQVRMAHLACVGSHTVNGVAELHTELIKEELLRDFYEMYPHKFQNKTNGITPRRWLLMSNPPLASLITETLKSDRWITHLEDLRGLEPYATDPAFQAKWQQVKQANKERLAEYIWRNNQIEVDPYSLFDIQVKRIHEYKRQHLAVLHIITLYEQIKANPNIDLQPRTFIFGGKAAPGYFMAKMIIKLINSVADMVNHDSDVNGRLKVVFLSNYSVSLGEMVYPAADLSEQISTAGKEASGTGNMKFALNGALTIGTLDGANVEIRQEVGAENFFLFGLTAQEVMSLKAEGYNPHEYYNSNPMLKKVIDSLISDYFNPREPGLFEPIVNSLLNEDQYMLLADYQSYVDCQQRVAQAFRDKSHWTQMSILNVARMGKFSSDRTIAEYCKDIWHVEPVPVSLDTCRPAFRPSRISQASGL

SEQ ID NO: 1547 - protein, 250 aa, Exiguobacterium sibiricum 255-15
MRKPIIAGNWKMNLTLKDAVAFAEEVKGTVPASSKVDAAVCAPSVFLAHLTEATAGTDLKIGAQNMYDQESGAFTGEISPVMLKELGVTYVVLGHSERREYFGETDAFINSKTKKAFEHGLVPIVCVGETLEEREGGKFESVIREQTTNSLKGLTVDQVKNLVVAYEPVWAIGTGKSATEQDAQDSCKFVRDVIAAEFGTEAAEAVRIQYGGSVKPDNIKEYMAQPDIDGALVGGASLETGSFLKLLEAI

SEQ ID NO: 1548 - protein, 570 aa, Medicago truncatula
MHFHIPYLSNTMTKSSNINFTSSNSSSSSSSSSPLAAANFNFNMIYSISLSLLQDIQILEILIAITLFIIIHSLRQKNHHGLPIWPFLGMLPSLINGLRTNLYEWITDILNKQNGTFRFKGPSFSSLNCIVTSDPRNLEHLLKTKFINFPKGTYFRNMVRDLLGDGIFSADDEIWQKQRKTASIEFHSTKFRNLTTDSLFELVHSRLLPVLDESVDKRAVTDLQDILLRLTFDNVCMIAFGVDPGCLSQKLPEIPFAKAFEDATEATVLRFVMPTCAWKFMRLLNLGVERKLKKSIKGVDEFAMNVIRTRKKELSLEVDEKKQRSDLLTVFMKMKDENGSAYSDKFLRDICVNFILAGRDTSSVALSWFFWLLDQNHEVEEKILEEICKVVSQRNDIKKEEFENSLIFRPEEIKKMDYLHACLSETLRLYPSVPVDHKEVVEDDTFPDGTILKKGTKVIYAIYAMGRMESIWGKDCREFKPERWLKDGRFMSESAYKFTAFNGGPRLCLGKDFAYYQMKYVAASIIYRYHVKVVENHPVEPKIALTMYMKHGIKVNLYRRDAAEIQKHLI

SEQ ID NO: 1549 - protein, 664 aa, Coccidioides immitis RS
MSVTTVLHPVQHPSIGSLKQQPQMNLPSSDGTLDKFPALDDESHRTPADADVPLSASNFRYSPEPFWLPRKNGTLSHGFPSSRKQRPRKSISEAIGSFKKRSASVSVNAQELAEALKAPVSYRLIGLCIVWYMTSALTNTSSKEILNALPKPITLTIVQFGFVSTCCLLLSYLASVFPTLRSTVPALKNGIRYPTLEVISTALPLALFQLAGHILSSMATSQIPVSLVHTIKGLSPLFTVLAYRVLFRIRYARATYLSLVPLTMGVMLACSAGFSTNFFGILCAFCAALVFVSQNIFSKKLFNESSRIEAEGQALTGRKLDKLNLLCYCSGLAFFLTAPIWFFSEGYPLLMDLLQDGAIDLTEKKGSLDHGPLILEFIFNGMSHFAQNILAFVLLSMISPVSYSVASLIKRVFVVVVAIVWFGNATTPIQAFGIGLTFVGLYLYDRNSHEDAADRRANADHFHIKKTILPLSVRNTNNNNKGWSSNGYAFPPIKEGSPENTKGYISASTGNFKKDDSGPNGRPRKSSAVRPWMPPGTKQESTWQPGDSAKTHPHNYVDGRLLKCILKSEDVATVDWKFQRKPIENNTNRRNDVVLVTRNPPSLPIIPFSSLSPFSSLSYFSPCDIFSSLQDAAAIVPCGGPLEEMVQTQLLPHIRNDCPSSSGG

SEQ ID NO: 1550 - protein, 328 aa, Clostridium perfringens SM101
MSVKESVLKILEENRERSISGEELAKHLSVSRAAIWKTIKSLRGEGYNISAVTNRGYQLTKDNDLISAEGIKIFLNPKYRENYIRVYKTIDSTNQEAKKLLMDNDIPHGTILIAEEQTAGRGRFQRKFFSPFNKGIYMSVILRPNIELSKAIHITTSAAISVCRAIETLTKKRPKIKWVNDIFLDDKKICGILTEATGNFESGRVENVVVGIGVNFKNDSKDFPEDIKNIAGSIFGGEKPTITRNQLIAEILNELFELCENLEDKSIMTEYRILSSVLGKEVSFLKNNKLNKGLAIDITDEGALVVKYENGEIDYLNSGEISVKTLNK

SEQ ID NO: 1551 - protein, 417 aa, Legionella pneumophila str. Lens
MIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHSEREIEKKNHNRQGSLLDFLWDFTERFPHCVDEYETLLTDNRIWKQRTVDIGVVSPENALQWGFTGPMLRGSGIAWDLRKKQSYAAYDRVEFDIPVGKTGDCYDRYLVRVEELRQSNRIIRQCIEWLRKHPGPVKVDDYKVSPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 1552 - protein, 416 aa, Gluconobacter oxydans 621H
METQFSLPKNKIRILLLEGIHESAAAHFAAEGYTEVTRVKGALEGDALKEALQGVHMVGIRSRTQLTREVLEGADRLMAIGCFCIGTNQVDLNAARMLGIPVFNAPFSNTRSVAELVMGEIVMLLRRIPSRSEACHKGGWDKSATNAWEVRGKTLGIVGYGSIGSQLSVLAEAFGMRVLYFDVMPRLPHGNAIAVSTLHDLLAQSDIVSLHVPQTPETDLLIGETEIRAMKPNSILLNNARGNVVELEALAVALKDGHLMGAGVDVFPVEPKKAGEEFKTPLQGLENVILTPHIGGSTMEAQERIGVEVARKLVDYSDVGSTIGSVNFPSVQLPERPRGTRFMHVHANRPGIMRQINDLFASQNCNVTAQYLQTDGEVGYVVVEAESEGPDMDTKLLDGLKALDGTLRARLLYQRA

SEQ ID NO: 1553 - protein, 517 aa, Streptococcus oralis
MDSNGDGIGDLPGITSKLDYLAKLGITAIWLSPVYDSPMDDNGYDIADYQAIAAIFGTMEDMDQLITEAKKRDIRIIMDLVVNHTSDEHAWFVEACENPDSPERDYYIWRDEPNDLESIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHICLQYQEGQPKWHYQKELNVGKLKEIFNKWQTELGVEDGWNSLFWNNHDLPRIVSIWGNDQEYREKPAKAFAILLHLMRGTPYIYQGEEIGMTNYPFETLDQVEDIESLNYAREALEKGVPMEEIMDSIRVIGRDNARTPMQWDESKNAGFSTGQPWLAVNPNYEEINVQEALANPDSIFYTYQKLVQIRKENSWLIRADFELLDTADKVFAYIRKDGDRRFLVVANLSNEKQNFSVEGRVKSILIENTVTQETVEKQTLAPWDAFCVEVTD

SEQ ID NO: 1554 - protein, 245 aa, Ipomoea nil
MAAASASTNTLTLKAAISSSAKLPSTSPAVLKFQPFKRTNPLISKSLGLTASTAAAASKRSVTVKSQSAPAGKVQELCVYEINERDRGSPAYLRLSQKSVNTLGDLVPFSNKLYTGDLQKRVGITAGLCILIKHEEEKKGDRYEAIYSFYFGDYGHIAVQGQYLTYEDTYLAVTGGSGIFEGVSGQVKLQQLIFPFKLFYTFYLKGIPDLPAELCGAPVPPSPAVEPSPAAKACEPGSTIGNFTD

SEQ ID NO: 1555 - protein, 1106 aa, Robiginitalea biformata HTCC2501
MSKGIKIDDEKHWYKDAIIYELHIKAFFDSNGDGIGDFQGLIQKLDYLEDLGVTAIWVLPFYPSPLRDDGYDIADYYNINPSYGKLRDFKRFIREAHNRGLKVITELVINHTSDQHPWFQRARKAPPGSRHRDYYVWSDDPGKYKDVRIIFTDTEPSNWTWDPEAKAYFWHRFFSHQPDLNFDSPDVQQEVFDIMDFWCELGVDGFRLDAVPYLFEREGTNCENLPQTHEFLKKLRAHIDSKYDNKLFLAEANMWPEDSAAYFGKGDECHMNYHFPIMPRMFMALKMEDRYPIIDIIDQTPEIPPTCQWAIFLRNHDELTLEMVTDEERDYMYKVYTKDPQAKINVGIRHRLAPLLENNRSKIELMNVLLFSLPGTPVIYYGDEIGMGDNFYLGDRDGVRTPMQWTGDRNAGFSTANPHKLYLPTIIDPEYKYEAVNVESQQINSSSLLWWMKRIIGMRKRYKAFGRGNIEFLAPANAKIIAFIRAYEGEQILVLCNLSRFAQAADLELGTFEGHTPVEVFSRNRFPRIGREPYLFTLAPFGYYWLSLEQDERLVEAGPPPRLKADKWSGLMSKPLRKKLQEEVLPRYLDNADWYAGRNRIRQSLEIRNSAALPLRGLPSRWLVVKTSYNDGLPEHYQLLVAWIPEARREALRDLPDAAILAEMQLGSEPGVLIDAIYEEPFRMALLQWVRQGKRFETDGGELHFSRGKRKFPAPSDPMKSRILPSGQTFSSLQYDDRYHLKLYRRLDDTLNPDLELAHFLSEETTYEHVPDYLGAVTFSAAGRTTLALGLAQELDPSQGTAWEYTRDAFHMFFERALAAGEETKFKPPKGGLTDPLRFEDLPELLKDLMGSALPERIVQLGERTAGLHRALASQPGREGFEHEAFSLHYQRSVYSSLQGLTRDAFDKLRKSLKRLPEEIQEEAREVLGLKNDVLQCFKRIFSHKMEAVKIRTHGDFHLDQVLWTGRDFLIRNFEGEPMRPFSERRLKRSPLRDVAAMIRSLHYAVYGALHESDLLGGEGNEIQEYWAQIWNRASTRLYLSGYLKSLDGPGFIPEDPDDYRILLETFLLEKAVYELGYELEHRPDWVLIPLRGIRSVLREAGFLSS

SEQ ID NO: 1556 - protein, 479 aa, Streptococcus mitis
MDDNGYDIADYQAIAAIFGTMEDMDQLIAEAKKRDIRIIMDLVVNHTSDEHAWFVEACENPDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKNLLTVGETWGATPEIAKLYSDPKGQELSMVFQFEHICLQYQEGQPKWHYQKELNVGKLKEIFNKWQTELGVEDGWNSLFWNNHDLPRIVSIWGNDQEYREKSAQAFAILLHLMRGTPYIYQGEEIGMTNYPFETLDQVEDIESLNYAREALEKGVPIEEIMDSIRVIGRDNARTPMQWDESKNAGFSTGQPWLAVNPNYQEINVQEALANPDSIFYIYQKLVQIRKENSWLIRADFELLDTVDKVFAYIRKDRDRRFLVVANLSNEKQNFSVEGRVKSILIENTTAKEAVEKQTLAPWDAFCVELTD

SEQ ID NO: 1557 - protein, 404 aa, Haemophilus influenzae 86-028NP
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 1558 - protein, 194 aa, Chlamydomonas sp. HS-5
MDESNATCGKRLDSIGVENTEENRRAYRDLLLSTPGLGQYISGAILFEETLYQSTKDGKTFVQVMNDQGIVPGIKVDKGLVPLVNSNGESWCMGLDGLDKRCAEYYKAGARFAKWRSVISIPAGPSIIAQRDCPTAWPATPPLPSPLAWCPSSSPRCCWTVTRTLTRLWRLPRTSGLRLSSTWPTTRSCSRVSC

SEQ ID NO: 1559 - protein, 288 aa, Mycoplasma genitalium G37
MIDHLKRTKIIATCGPALTKSLVSLKMLDDNEYAAIKKVAYANIEAIIKSGVSVIRLNFSHGTHEEQQVRIKIVRDVAKAMNIPVSIMLDTNGPEIRIVETKKEGLKITKDSEVIINTMSKMIASDNQFAVSDASGKYNMVNDVNIGQKILVDDGKLTLVVTRVDKQHNQVICVAKNDHTVFTKKRLNLPNAQYSIPFLSEKDLKDIDFGLSQGIDYIAASFVNTVADIKQLRDYLKLKNASGVKIIAKIESNHALNNIDKIIKASDGIMVARGDLGLEIPYYQVPYW

SEQ ID NO: 1560 - protein, 637 aa, Methanosarcina acetivorans C2A
MPIEDVLLDLKHKIEKNLPAGVTITDVEFEGPQLVLYTEEPRKFADDGNIIRNLAKELRTRIAMRPDPRVLATPEDSISIIEEVVPKESVISSYYFDPDSGEVIIEAEKPGLVIGKHGATLREITKQIGWIPKVVRTPPIKSRTVKNIREFMRNNLKERKEILKTVGRKIHRECTSKDQWVRVTALGGCKEVGRSCFLLSTPESRILIDCGVNVGSDENMTPYLYVPEVFPLNQIDAVIVTHAHLDHQGLVPLLFKYGYEGPVYCTPPTRDLMVLLQLDYIDVAAKEGKKIPYESGMVAKTLKHTIPLDYEEVTDIAPDIKLTFHNAGHILGSAISHFHIGDGLHNVVFTGDYKYEKTRLFDPAVNKFPRVETVISEATYGNSNAFQPALKDAEKHLQMVVKNTVERGGIALIPAFAVGRSQEVMIVLEESIRKGLIPEVPVYLDGMIWEATAIHATHPEYLNNDLRKLIFQKGQNPFLSECFKPVDSHETRQKIIQNPHPCVILSTSGMMNGGPVMDYFRTFAEDPRNTLVFVGYQADGTVGRRIQKGWKEIPMTGKNGSTEILKMNMEVQVVDGFSGHSDRRQLMEYIKRMQPRPERVFTEHGDEKACVDLASSVYKKLKIETRALTNLETVRLL

SEQ ID NO: 1561 - protein, 252 aa, Pisum sativum
MASMSSLKMISSLKLSHSTSTSPLQTQKQLVSSSLSHSFLTKKFNISTTRQFSTSSKNTTTTAFFFNNQKEHQQSSKPGKVQELFVYEMNERGRGSPAYLKLSQKSMNSLGDLVPFSNKLYSGNLEKRIGITAGLCILIQHVPEKKGDRYEAIYSFYFGDYGHISVQGAYLTYQDTYLAVTGGSGIFEGVHGKVKLQQIVFPFKLFYTFYLKGIPDLPDELLGNPVEPSPNVEPSPAAKATQPHASLSNFTN

SEQ ID NO: 1562 - protein, 517 aa, Streptococcus thermophilus CNRZ1066
MLIRRKSDNKYKGVLYIMNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGKYPVESVRTMATINKNAQTLLKEYGRLNSSTFDRSSKTEVVASAVKDATNSMNIKLIVALTESGNTARLISKYRPEADILAITFDELTQKSLMLNWGVIPVVTETPSSTDDMFEVAERVALESGLVESGDNIVIVAGVPVGSGNTNTMRIRTVK

SEQ ID NO: 1563 - protein, 249 aa, Legionella pneumophila str. Lens
MRQKIVAGNWKMNGQIQQVTELVSQIEKLIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 1564 - protein, 379 aa, Xanthomonas oryzae pv. oryzae KACC10331
MNFAPVPALLEELRAGRMVVIVDDEDRENEGDLIMAAELVTPSDINFMVTHARGLVCLSLTGERCAQLGLAPMVRNNTAQFQTNFTVSIEAAEGVTTGISAYDRAHTVRTAVRPDAKPQDLSQPGHIFPLISQPGGVLTRAGHTEAASDLSMLAGLEPAGVLVEVLNPDGSMARRPQLEVFAREHGLKMGSIADLIAYRLANEHTVERVDERDITTEFGPFKLVTYRDRIAHDLHFALVRGSADPHTPTLVRVQVENPLADLLHWQRDDFGVAATDALRAIAAEGQGVMVVLSAPRDSESLLARLRQQPEAAANAKDVSQWRRHGAGAQILAELGLGKLRVLGTSRRQVGVAGFGLEVVEYLECHAGEGVRSVPPSAVS

SEQ ID NO: 1565 - protein, 960 aa, Synechococcus sp. CC9605
MHSTLTSPFAQRHIGPSEAEQLRMLNALGYSDLQEFIADVVPADILDSKPPVEALPEGCGEAEALQQLKQLSETNTLRRSLIGLGYYGTATPALIQRHVFENPAWYTAYTPYQAEIAQGRLEALLNFQTLISELTGLPIANASLLDEATAAAEAMSLSFGVCRRPEATRFLVDANVLPQTWAVLQTRAEPLGISLECIDPATAPIDASVFGVLLQLPGADGCLWDPSAVIQAAHAAGALATVAIDPLAQTLMAPVGSLGADIAVGSAQRLGVPMGFGGPHAAFFATVEAYKRQIPGRLVGQSKDAEGRSALRLALQTREQHIRRDKATSNICTAQVLLAVMASFYAVHHGPDGLQAIAQRIVGLRSQLEQGLRALGYPLQLADRFDTVTVHCVLAPAVHRAAAVAGFNLRVLPDGAAPADATGFGISLDELSDQQELQALLALLAEACGQVPPQLEAAQPPSLSLPQRSQPWLSQSVFHQYRSESELLRYIQRLVSRDLSLVHGMIPLGSCTMKLNAAAELQPVSWPAFAALHPFSPADQAQGYRRLADDLEQWLAALTGFAAVSLQPNAGSQGEYAGLLVIRAWHHSRGEAHRDICLIPTSAHGTNPASAVMAGLKVVAVACDDEGNIDQQDLAAKAAEHADRLAALMVTYPSTHGVFETGIREICAVVHRHGGQVYLDGANLNAQVGLCRPGAFGADVCHLNLHKTFCIPHGGGGPGVGPIGVAAHLEPFLPGHPLQAGAASAIGPVSAAALGSASILPISWMYLRMMGAEALRQASALALLSANYLAHRLDASYPVLFRGSTGRVAHECILDLRPLKRDAGIDVDDIAKRLMDYGFHAPTVSWPVAGTVMVEPTESESLAELDRFADALVAIREEIRAIEAGTSDPQNNPLKRAPHTLAAVTADTWDRPYSRQQAAFPMEEQQESKIWPAVARIDNAFGDRNLVCTCPSVESVAVAV

SEQ ID NO: 1566 - protein, 230 aa, Streptococcus thermophilus CNRZ1066
MVKLVFARHGESEWNKANLFTGWADVDLSEKGTQQAIDAGKLIKEAGIEFDKAYTSVLKRAIKTTNLALEASDQLWVPVEKSWRLNERHYGGLTGKNKAEAAEQFGDEQVHIWRRSYDVLPPKMDRDDEYSAHKDRRYASLDDSVIPDAENLKVTLERALPFWEDKIAPALKDGKNVFVGAHGNSIRALVKHIKKLSDDEIMDVEIPNFPPLVFEFDEKLNVVSEYYLGK

SEQ ID NO: 1567 - protein, 311 aa, Nitrosomonas europaea ATCC 19718
MSKIVVSTSSFGFDHNPAIQQLRAQGFTITGNPYQRKLTEDEIITLLGNDTVALLAGVEPLTEHVLTSASALRVIARCGTGMDNVDLEAARRLNIQVSNTPEAPAQAVAELTLGLMLDCLRQINRIDRSVRQGEWPRSQGRLLAARTVGIVGLGHIGRRVAKLCQAFGAQVIAHDPHLQLAPDGVELVALTTLLEQADLVTLHLPYSPAVHYLIDAEAIDRMKPGTILINAARGGLVDETALCAALNTGHLEAAALDSFEQEPYHGPLCECKQAILTSHIGSLARETRQRMEIEAAENLKQGLIEAGLIDE

SEQ ID NO: 1568 - protein, 308 aa, Bifidobacterium longum NCC2705
MNDTIPATGHLLGAADIRRIAADAGISPTKKFGQNFVIDPGTVRRIVREAGVTAADHVMEVGPGLGSLTLAILETGATMTAVEIDPPLAERLPGTVAEFMPEATSRLTVVNRDALTVTPENVPDFSDDASFTLVANLPYNVATPILLTLLERFDNLGSFLVMVQKEVADRLAAKPGSKIYGTPSVKLAWYGTAERVGTIGRNVFWPAPNVDSALVRFTRYQADDPAAPGASNSTADGGTQRELVFRLIDAAFGQRRKTLHAALKTIAPSEAFSIAGIDPTRRGETLTIAEFTALAKAIESCGDGDEAQ

SEQ ID NO: 1569 - protein, 239 aa, Thermococcus kodakarensis KOD1
MRLMRDSAVKRRILAAIEDGPVSGEKLAEGLGISRVAVWKHIRELKRLGYKIEASHAGYFLRERPDVPYPWELPVKAYYLEETSSTMDVAWKLAERGRDFFVIAGSQKSGRGRKGSRWLSPPGGLWFSLVASPELSLSEAGKMSKAAREVIAEYLQGKGIPAEVSENGVFVHGKKIAGVLVEVAGELDAIRFAVVGVGINVKNPVPEGATSMALELGDVSLLGTARELLPKLLDNLKAF

SEQ ID NO: 1570 - protein, 455 aa, Sulfolobus solfataricus P2
MYKHPWLPNLDLTDEMLKEIGVNSLDDLFNDIPAEIKINRLLKVAKDKPLSEYEIEKEIYEKVKKNVELEAPPFIGAGICPHYIPNAVKFIIGRSEFYTSYTPYQPEISQGILQALFEYQSLMAELLEMDVVNASMYDWGSALAEAVLMANRINGKKTVLVPENANPFHKEVMRTWIQGKGIKIEEVKYDKNSGEVDIEDLEKKSSSNDVSAIYVQQPNFFGIFESNIEHIIDVAKHKKALSIIGVNPLSLGLIKPPGSYEADIVVGDGQELGLPLNFGGPLMGIFAVRWDMGLVRQMPGRIVGITRDVNNNMGFTLILQTREQFIKREKATSNITTNEALLALANAVYLSLLGKEGIRELAEEIYFRSHYAAKRLTEIDNVIMPFTSDFFEEFVIKFPIEYNIINDKLKERKLQGGLKLSIHTSLFCVTEVHDKKSIDLLVSTIQEAIKSVETS

SEQ ID NO: 1571 - protein, 137 aa, Streptomyces avermitilis MA-4680
MSQRTLVLLKPDAVRRGLTGEIISRIERKAGWAITALELRTLDQDTLEQHYGEHKGKPFYEPLVEFMASGPVVALVVEGERVIEGVRALAGPTDPIAAAPGSIRGDYGVIVRENLIHASDSEESAERELKIFFPGRV

SEQ ID NO: 1572 - protein, 393 aa, Zea mays
  misc_feature (166)..(166): Xaa can be any naturally occurring amino acid
  unsure (1)..(393): unsure at all Xaa locations
MASSNVSTVYISVIDDVISKVREDFITYGVGDAVLNELQALWEMKMLHCGAISGNIERTKAAAASAGGTSGTTPPVHDLNVPYEATSEEYATPTADMLFPPTPLQTPIQTPLPGTDTGMYNIPTGPSDYAPSPISDIRNGMTINGADPKAGRPSPYMPPPSPWMNXRPLGVDVNVAYVEGREDPDRGVQPQPLTQDFLTMSSGKRKRDEYPALLPSGSFVPQQDGTADQIVEFVVSKENANQHWSSIINKLETPTKTVTPVIPQCDGIQDDYNDQFFFPGVPTEDYNTPGESAEYRAPTPAVGTPKPRNDAGDDNDDDDDDEEPPLNEDDDDDDDLDDLEEGEDEPNTQHLVLAQFDKVTRTKNRWKCTLKDGIMHLNGRDVLFNKATGEFDF

SEQ ID NO: 1573 - protein, 361 aa, Zea mays
ILVGDELVIDGGMATFEVTEKIGNDLRSKLSFWRNGKIVQRNFGLPTLSTKDWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 1574 - protein, 243 aa, Gluconobacter oxydans 621H
MSWRFEYHETLGSTSDLCKARAEAGEPEHLAVQAFSQTSGRGTRGRTWTDPGGNLAISLLFRPADPAAFIAALPFVVAVALFETAIHFCPVVTGPSRFMLKWPNDLLMDGRKMAGVLIETGGPQGNPWVVVGIGANLRQAPEIPGRRLAALSEVTDPPSAEAFGKVLVAQIEHWTALREREGFAPVRAAWLARAHPVGTPLAVQRCETYITGSFSGLDAQGRLLLALPHGETIPVVTGDILLD

SEQ ID NO: 1575 - protein, 489 aa, Clostridium perfringens ATCC 13124
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKSGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 1576 - protein, 571 aa, Burkholderia vietnamiensis G4
MPHDVSLIALLAAGFGLAMVFGYLASLLRMPPLVGYLLAGIVIGPGTPGFVGDLSLAQQLAEVGVMLLMFGVGLHFSLRDLLAVRKIALPGAVVQITVATLLGGALALAWGWSVGAALVFGLALSVASTVVLLRALEGRGLVETVNGRIAVGWLVVEDLVMVLVLVLLPPVAGLLGGTPPGDAQAAGGGVWSTLGVTMLKVAAFIALMLVVGKRVFPRILWLVARTGSRELFTLCMIAAAVGIAFGAAKLFDVSFALGAFFAGMMMRESEFSRRAADETLPLRDAFSVLFFISVGMLFDPKVLIEQPLHVIEVAAIVLIGKTLAAVALVIAFRYPLNTALTVGAGLAQIGEFSFILAGLGRALGLLSAEGQSLILAVALISIAMNTLLFAMIDPALAWIRKHSAFARRLEARDDPLAALPMSTPQTHLTGQVVIVGYGKVGTRIAHALDERGIAYVVVEQNRELVEKLRADGVAAVSGDAIEPVVLVQAHIARAGMLVVTLPDVFDVRQIVEISRTLNPALEVVLCTNSSDEAGLLSSEGVGTVFMSESELARAMTEHVLGRMARPAAVAH

SEQ ID NO: 1577 - protein, 389 aa, Haloferax volcanii DS2
MPTRSARFPVDERDGRPAAVKWTIHIASHLCPQGPYLTAYVKSAVYRGPGDVRIEEKPEPELQQPTDAVIRVTHTAICGSDLWFYRGHEEHEEGSGVGHEPMGIVEEVGEDVTSVQPGDRVLVPFAYSCGECEFCRKGIHTACVDGGFFGPHGDETGGAQAEKVRVLHADGTVVRVPERYADDEETLKSLLPLTDVMSTGHHAAVLADLEAGDTAVVIGDGAVGLCGVLAAKRIGAERIIAVGHHEDRLEVARELGATDTVSSRGQEAVEEVLELTHGGANHVLECVGAASALETAAQVARPGGSIGAVGVPHVESADFLQPIFYKNLSFSAGGAPVRNYIEELMDDVLQGTLDPSPILTKTVDLDGVPEGYQAMDDREAIKVMVKVDE

SEQ ID NO: 1578 - protein, 108 aa, Chromobacterium violaceum ATCC 12472
MLREITAPALAAQLADPQAARPVLLDVREGWEYQLAHIEGSVHIPMNLIPIRMSELPDDAPIVAICHHGMRSAQVALFLQNAGFDDVINLQGGIDAWSVQVDPAVARY

SEQ ID NO: 1579 - protein, 526 aa, Helicobacter hepaticus ATCC 51449
MKYKIVVCDHIHQKGLDLLTAQSDVQMENLASLPKDELLTKIKEADVVITRSSTDVDEAFLASSGQIRAVVRAGVGVDNVDIEGCSRKGIVVMNVPTANTIAAVELTMAHLINAVRNFPGANTQLKHERKWKREDWYGIELKGKKLGIIGFGNIGSRVGIRARAFEMEVLAYDPYILPSKATDLGVAYATNFEDILSCDIITIHTPKNAETKNMITAKQIAQMKDGVILINCARGGLYNEKDLYDALSVGKIKWAGIDVFDKEPAINNALLDLPNVYVTPHIGANTLESQEQIAIQAAQAAIEAARGSSYPNALNLPVKESELPSMVKPYLELIQKLAFLAVQANKGVITSIHIEAQGEISAYGDSLQTFALVGALNASLGDKINYVNAPFVAKERGIDVKMTLKQESETYKNHIYITLSTQNESITLSGAVFEDRHLRLTSINHFQFDIEPKGKMIFFKNTDVPGVIGLVGSILGNHQVNISDFRLARQNKEAMAVILVDSEVSNEVIGQLENIPACLSIKIVNV

SEQ ID NO: 1580 - protein, 269 aa, Clostridium perfringens ATCC 13124
MLYSLILAGGKGTRLYPLSRSSNPKQFLSIHNNGKSFLSNTVDRIRPIIHKDNIYVVTNQEYEDKIRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADALITKMRCRSKFFRIVCIHVYPPRLNKLVVLATSYFFIMFLYILVSVITLNNKEISITITENKNI

SEQ ID NO: 1581 - protein, 476 aa, Arabidopsis thaliana
MASLTLRCDSTHLLPSRDVVKGTKPFGTSLVYPRIISKKFNVRMRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 1582 - protein, 151 aa, Triticum aestivum
  misc_feature (28)..(28): Xaa can be any naturally occurring amino acid
  unsure (1)..(151): unsure at all Xaa locations
MRDPWTRCGLVFRLLQAAFAAAALAVMXSTDDFSSVTTFRYLVAAASVQCLWSLVVAILDAYAIVVKRFFRTARAVIILALGDWVTGTLIFSAACGSAAITTLLSNDFGACSVNPCGSFMNATAMAFLSWLARAPAFIGNLWTAVHRIQKS

SEQ ID NO: 1583 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 1584 - protein, 410 aa, Shigella flexneri 2a str. 301
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 1585 - protein, 527 aa, Methylococcus capsulatus str. Bath
MVIDRLTASLQSLGTPEFGNEKAQAGAVGPALLCPVIPEDWGDAAEAAAAQGCRWAGGWGEARGESWVVNALLEKSGDYLLLRTVLPPGRTGLPSHTPHFPGAARPERHTRDLLGLKFIGHPDDRRWVRHQAWGEREFPLRPDFPLAGQPPAVTAPDRSYGFASAHGPEVNEIPVGPVHAGIIEPGHFRFLALGETVLNLEERLGYVHKGIEKLAVGRDPEGLARLAGRVSGDTTVGHAWAACQAMEHAAGVAPPERALWLRAIFIERERVANHLNDIGAICNDTAFAFGHSQFSRLRELWLRDNLRWFGHRLLMDRIVPGGVAVDLPAEATSAMPAAMAALRSELEELKPILDESTIFQDRVVGAGVLSERIVRELGCLGYVARACGIGRDVRERAPHAPYDRLGVKAVTRGDGDVAARLYVRYEELLASLDILDQCLRRIEPGPLRADWRTPPANAEGLGLVEGWRGEIATYVRFDGAGSIVRFFPRDPSVFNWPALEKLILGNIVPDFPLCNKSVNGSYSGHDL

SEQ ID NO: 1586 - protein, 651 aa, Arabidopsis thaliana
MATTSSDRLIAGLTASIGSIESRYANPAQSVSLICRNQINGAPPIVLRSSRRSRLWLIEAIPPAKSWNGSNDGDEDIKKSDTRNYAIGGTGGHAVAGKDDRTMEIVIAAATTAALGVGNRVLYKLALIPLKQYPFFLAQLSTFGYVAVYFSILYFRYRAGIVTKEMLSVPKLPFLIVGVLESLALAAGMAAACSGSGAAHSFKDTGILWSLLMVFSFLLQGADTVMKEVIFLDSKKRLKGASLDLFVVNSYGSIFQVICIALLLPFLSKLWGIPFNQLPSYIRDGGACFLNIGSRITGCEGAPLLPVMFVMMNMAYNISLLRLIKISSAVVSSLASTVSEPIMFRVTGTLSAASSPAVAAASFSAALRLSITPTLAIASPPHLRWFSKFSRQFLGGRISSLRPRIPSPCPIRLSGFPALKMRASFSSGSSGSSASREILVQHLLVKNNDVELFAELQKKFLDGEEMSDLAAEYSICPSKKDGGILGWVKLGQMVPEFEEAAFKAELNQVVRCRTQFGLHLLQVLSEREPVKDIQVEELHSKMQDPVFMDEAQLIDVREPNEIEIASLPGFKVFPLRQFGTWAPDITSKLNPEKDTFVLLVRAGFIMGVPADCFGSMQVANWLQSQGFKSVYNITGGIQAYSLKVDPSIPTY

SEQ ID NO: 1587 - protein, 150 aa, Haloarcula argentinensis
ERTFVMVKPDGVQRGLIGDIVSRFEDRGLKMVGGKFMQIDQELAEEHYGEHEDKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 1588 - protein, 465 aa, Xanthomonas campestris pv. vesicatoria str. 85-10
MPESSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVVTILVFIVLGGAAVIGLLPLADGSPAPGLRHLRAEGWFAHGALPILMTMVAVNFAFSGTELIGVAAGETAQPARAIPLAIRTTLVRLVVLFVGTVLVLAALLPAKQAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQLLRDGAALETLAYRAPWYPWTPILGFSLCLLACIGLAFDPQQRIALWCGVPFVALCYGAYALTQWLAARRLHA

SEQ ID NO: 1589 - protein, 298 aa, Streptococcus pyogenes MGAS10394
MIIKRREYMRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIKQFKNPDLPIKVVANLPYYITTPILMHLIESKIPFQEFVVMMQREVADRISAEPNTKAYGSLSIAVQYYMTAKVAFIVPRTVFVPAPNVDSAILKMVRRDQPLIEIKDEDFFFRVSRLSFVHRRKTLWNNLTSHFGKSEDIKTKLEKGLALADIKPSIRGEALSIQDFGKLADALKEVGL

SEQ ID NO: 1590 - protein, 489 aa, Methanosarcina acetivorans C2A
MNINVNINGRENMQIPDHKTKIVCTIGPASFSEEVLRKLVLAGMNVARINFSHGDFESHGKVIRRVRKVAEELDRTVAILADLPGPKIRVGKLKKEPLMLHKGNRITLTTDETSGSEDRIPVNYKQLPESVSPGSLIYLSDGFIQLLCLEISGKDVVCEVMVGGQLYSHKGLNLPGAKIYLDSVTEHDFKILEFALNEEVDAVSISFVEKAEDIRKVRNFASTMGKPVYVVSKIERSQAVQNIEEILEETDALMVARGDLGVEIPIQEVPSVQKELIRSAKLLSIPVITATHMLASMTDNIRPTRAEATDVANAILDGTDAVMLSEETAVGNYPVETVEMMAKIAKTTENWRSRTKWGLDTMLKGITAQKMSVDEVIALQVHEALQKLPVAVVLTPTRSGATPRRLSRFKPEPWILAFTRFPKTCSSLALSYGVYPIIVKEVSENWETETTEKAKELGFAKSGELVVFTQGPASGKPGGTNMLKILTLD

SEQ ID NO: 1591 - protein, 656 aa, Azoarcus sp. EbN1
MHNTLELVLLLLAACVVVVAVFRSLSLPPVLGYLLVGAGVGPHALDLVEASDGASHLAEFGVVFLMFSIGLEFSLPRLFAMKRIVFGLGAAQVLGSLLFTMLAGAIFGLEWGASFALGATLAMSSTAILSKLLSDRLELDRPHGRETIGVLLFQDIAVVPLLILIPALSQPAGELAGTLGIAALKAAVLLALVLVAGQRVMRWWFTVVARRRSGELFMLNVLLITLGLAWLSAAVGLSLALGAFLAGMLISETEYRYQVEEDIKPFRDVLLGLFFVTVGMFLDVGLIMANFAAVLGLLVGLLVFKGVIVFAASRAFGSSSGTALRTALWLCAGGEFGFVLISHIDDVSLIPEALLQVTVAALVLSMLVAPLIVQLSDRLVLRFVASEWLQRSMELTRVAAQTMNTSKHIIVCGYGRSGQYMARFMEQENVSYVALDLDPERVREAGAAGDTVVYGDAARHETLMAAGIMRASALVISFGEVEAALRVMHRAHLLRPDLPIVVRASDEKDMARLSHAGATEVVPEAFESSIILASHALALIGVPLNRIVRRIRDIRNQRYALMRGFFHGASDAADGPDANQARLRSVTLPGGARAVGMTIGAIGLGEIGVGVSAVRRRNIRGLSPGPETQLEEGDVVVLIGIQADLEQAERRLLGGA

SEQ ID NO: 1592 - protein, 98 aa, Brassica napus
  misc_feature (96)..(96): Xaa can be any naturally occurring amino acid
  unsure (1)..(98): unsure at all Xaa locations
KQLSFTRQHLLVLLELIKCVFILFLQAFPANEITSSFSKRLKIKKKSSSELKYQENLKLKERTDLEKEIASLRETFDEQNVRNQRLKRIKLDLNSXRV

SEQ ID NO: 1593 - protein, 150 aa, Haloarcula japonica
ERTFVMVKPDGVQRGLIGDIVSRFEDRGLKMVGGKFMQIDQELAEEHYGEHADKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 1594 - protein, 193 aa, Arabidopsis thaliana
  misc_feature (101)..(101): Xaa can be any naturally occurring amino acid
  misc_feature (105)..(105): Xaa can be any naturally occurring amino acid
  misc_feature (119)..(119): Xaa can be any naturally occurring amino acid
  misc_feature (130)..(130): Xaa can be any naturally occurring amino acid
  misc_feature (135)..(135): Xaa can be any naturally occurring amino acid
  misc_feature (138)..(138): Xaa can be any naturally occurring amino acid
  misc_feature (143)..(143): Xaa can be any naturally occurring amino acid
  misc_feature (148)..(149): Xaa can be any naturally occurring amino acid
  misc_feature (152)..(153): Xaa can be any naturally occurring amino acid
  misc_feature (157)..(157): Xaa can be any naturally occurring amino acid
  misc_feature (161)..(162): Xaa can be any naturally occurring amino acid
  misc_feature (164)..(164): Xaa can be any naturally occurring amino acid
  misc_feature (172)..(172): Xaa can be any naturally occurring amino acid
  misc_feature (176)..(177): Xaa can be any naturally occurring amino acid
  unsure (1)..(193): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFEXEHGXFVYREHGNTSGYYXWTGTWTMWEGXICSGXTDXPFKVXKEGLXXKKXXPGAXIRVXXFXKTRKANEXVYLXXAPSLLVNPFWLLDPFF

SEQ ID NO: 1595 - protein, 410 aa, Hordeum vulgare subsp. vulgare
MAAMWSPIIGLLLLLLPLGPSSAINFPLEGNVYPVGHFYATLNIGEPAKPYFLDVDTGSNLTWLECHPPVHGCKGCHPRPPHPYYTPADGKLKVVCGSPLCVAVRRDVPGIPECSRNDPHRCHYEIQYVTGKSEGDLATDIISVNGRDKKRIAFGCGYKQEEPPDSPPSPVNGILGLGMGKAGFAAQLKGLKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTFSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 1596 - protein, 470 aa, Coccidioides immitis RS
MATGARDIFNPNELSHQVSRSLSFSAQSPPSSYGTSGTPFASRVPAPFPLKQLKPFATEDIKILLLENVNKTGRDILKEQGYQVEFYKSSLPEDQLIEKIRDVHVIGIRSKTKLTAKVLSEARNLIVIGCFCIGTNQVDLQFAADHGIAVFNSPFSNSRSVAELVIGEIIALARQLCDRSAEMHSGMWQKVSNKCWEVRGKTLGIVGYGHIGSQLSVLAEAMGMSVIYYDVLNLMAMGTARQVATLDELLASADFVTLHVPELPETKNMISGSQLEKMKDGSYLINASRGSVVDIPALVQAMRSGKVAGAALDVYPSEPAGNGDYFNKDLNTWAEDLRSLKNLILTPHIGGSTEEAQSAIGIEVANALVRYVNEGTTLGAVNMPEVTLRSLTIEEPNHARVIFIHRNVPGVLRKVNEVLANHNVDKQMTDSRGDVAYLMADISDVNSSDIKELYQQLESLSSRIMTRVLF

SEQ ID NO: 1597 - protein, 278 aa, Ralstonia eutropha JMP134
MLDTLTFGFLGGGNMATALISGLIARGVPAGSIRVVDPFPDAQQRLVRDLRVHVAGAPDAAFGGSDVLVLAVKPQQFREAAASLLPHLPATGAGNLIISVAAGIRLQDMERWLGGRTRLVRAMPNTPALSGMGMTGLAAPAGLSQHDRAIASAVAEAVGKSAWVDGDEQIDAVTAISGSGPAYVFYFIEAMERAATELGLTTQQGRELAVQTFLGAATLAGQSTEPVATLRERVTSKGGTTYAALTAMESAGIGDAFVRAMQAAAARGKEMGEEFGKD

SEQ ID NO: 1598 - protein, 150 aa, Haloarcula quadrata
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 1599 - protein, 245 aa, Spiroplasma citri
MRKPIIIGNWKMHKTINETIDFLKQVDHVCHDLKLDAGIAIPFVNLAVAKQHAHNLIIAAQNCHYEDFGAFTGEISVEMLENLKITHVIIGHSERREMFNETNETVNLKAKKILATGMVPIICCGETLQQYENNETQQIVETQIEKALQGIDFEDAKTIVIAYEPIWAIGTGKTATAEIAQNVCAIIRTKIASLYDEVVANVIRIQYGGSVKPENIQELLAQPDIDGALVGGASLEPKTFLGLVK

SEQ ID NO: 1600 - protein, 176 aa, Triticum aestivum
  misc_feature (105)..(105): Xaa can be any naturally occurring amino acid
  unsure (1)..(176): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASXPGYYDGRYWTMWKLPMFGCTDATQVINEVEEVKKEYPDAYVRIIGFDNMRQVQCVSFIAFKPPGCEESGKA

SEQ ID NO: 1601 - protein, 468 aa, Pseudoalteromonas tunicata D2
MSQSVLQFIKDNDVKFIDLRFTDTKGKEQHVSIPHHQVDEDFFEDGKMFDGSSIAGWKGINESDMVLMPDASSVKLDPFTEEVTLIVRCDVVEPGTLIGYTRDPRSVAKRAEEYMRSTGIADTVLFGPEPEFFVFDDVKYKTDMSGSMFKIDSKQAAWNSDKEYEGGNTGHRPGVKGGYFPVAPVDDFQDWRSATCLVLEEMGHVVEAHHHEVATAGQNEIATRFNTMVTKADEIQEMKYVIHNMAHLYGKTATFMPKPIVGDNGSGMHCHQSLAKDGVNLFAGDKYAGLSEEAIYYIGGIIKHAKAINAFANPATNSYKRLVPHFEAPVMLAYSARNRSASIRIPVVPSAKGRRIEVRFPDPAANPYLAFSAMLMAGLDGIKNKIHPGDAMDKDLYDLPAEEAAEIPQVAGSLQEALDCLSADREFLTQGGVFTDDLIDAYIDLKTKEVQKLNTSTHPVEFEMYYSC

SEQ ID NO: 1602 - protein, 348 aa, Pyrococcus horikoshii
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (65)..(65): Xaa can be any naturally occurring amino acid
  misc_feature (229)..(229): Xaa can be any naturally occurring amino acid
  misc_feature (335)..(335): Xaa can be any naturally occurring amino acid
  misc_feature (346)..(346): Xaa can be any naturally occurring amino acid
  unsure (1)..(348): unsure at all Xaa locations
XSEKXVAIXKTKPGYGAELVEVDVPKPGPGEVLIKVLATSICGTDLHIYEWNEWAQSRIKPPQIXGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVXDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELXRAGKTGKVVFXLK

SEQ ID NO: 1603 - protein, 483 aa, Pseudomonas syringae pv. tomato str. DC3000
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 1604 - protein, 302 aa, Synechococcus sp. CC9605
MGWSAADIPNQQGRIALITGANSGLGLETARALKRCGATVVLACRSPRKAELAKQELLQERDGGAVDLVDLDLADMTSVERAAATVGERYGCLDLLINNAGVMAPPRRTTAQGHELQFGVNHLGHMALTQALLPLMQNRPDPRVVTVTSGAQYFGKIRWDDPSWSKGYDRYGAYGQSKLANVMFALELDARLHKKGSPIRSLAAHPGIARTELQPTAIANVGNRFEALAYRLMDPLFQSAGMGALPQLHAATAATAQGGEHYGPEQFGGLRGAPALCRVAPAASQPAERQRLWSLSEELLSA

SEQ ID NO: 1605 - protein, 880 aa, Cochliobolus carbonum
MSAAIDNEDLEELSISMPSQRRGAAQTSTTKAQDPAPPPPTALGTAVHETKSKDTKASQRLGQYTIVRTLGEGSFGKVKLATHQVSGQKVALKIINRKRLVTRDMAGRIEREIQYLQLLRHPHIIKLYTVITTPTEIIMVLEYAGGELFDYIVNHGKLQEAQARKFFQQIVCAVEYCHRHKIVHRDLKPENLLLDHDSNVKIADFGLSNIMTDGNFLKTSCGSPNYAAPEVISGKLYAGPEVDVWSCGVILYVLLVGRLPFDDEYIPTLFKKIAAGQYSTPSYLSPGATSLIRKMLMVNPVHRITIPELRQDPWFTTDLPAYLEPPAQEFFDSGADPNKAIDPKALAPLADAPRVQALHENVVTKLGKTMGYAKHDVQDALARDEPSAIKDAYLIVRENEMMRENPLLTNQDGVPVWNHQSPPAHDSYMEKFRPQSLNAVSRPQFIPPAPSDHERARQGSNASSQLASIRSPVSTIAILPSSLTEYHKAYMKGHPRPTNKISESEALPPTPEQTEEQRQISARRLKPNFRTMPEAGRTKPEPMTSLPTKKPRATKWQFGIRSRNQPAEAMLAIFKALKAMGADWEVPKIRRAGGRSGSRSRSTSQAPEDRKSKSRNHSQDSISSHSSDEDQGSRKGSPRREPLSVRNNGTSEQEARGRQKKHYNHTNDWGYHVPEDPWVIHARFLKEGMFPPGVAHPSSTHSSRVDLANDSSGARRRSSTNTSTSSAGHGVEGMTPSERAGSVSEDHVNPDEAVYIYMSIQLYSIDRDFFVVDFKCAGYERLVTNLVREIKASIPLSGSHQPPPHHQDGWDDEQGVWRRLDENEPLPEDLAKKLNEGGTEILRERTELVGAGRQEGEKIVTSPFPFLDVASTLILQLSGE

SEQ ID NO: 1606 - protein, 506 aa, Burkholderia vietnamiensis G4
MIRTLRQVPDPALPRILPVILAGGSGTRLWPLSREQFPKQLIELTSNESPLSATARRLNGIANASLDDTLLLVCSEQHRTLSAAQVTDRAAPARILLEPAPRNTAPALTLAALDASAFADDPVLAVMPADHVIVDVGAFQDAIARAARYAEEGAIVTLGVLPRRAETGYGYIQVGAPRNGCHGSQGGYSIGRFVEKPDEALAERYLQSGDYWWNSGIFVTRASVWLKAIRALAPAIHASCEAAWRAGIAEDPFFRIDAAAFDACPSDSIDYAVMERLPEHGELGIEGIVVPLAAGWSDVGTWDAIWEIMPKDDHGNVARGPIVFEDTQDSFVRSEGRLVACVGMRDVVVIETPDAVLVANKHDVQRVKNIVARLKNDRRPQAIEHRKVQRPWGHYDSIDLGERFQVKRIVVEPGKRLSLQMHYHRAEHWIVVRGTARVTRGSETFLLSENESTYIAVGEVHRLENPGRIPLEIIEVQSGDYLGEDDIVRFDDQYGRPVDALPAEQA

SEQ ID NO: 1607 - protein, 76 aa, Brassica napus
  misc_feature (17)..(17): Xaa can be any naturally occurring amino acid
  unsure (1)..(76): unsure at all Xaa locations
TQGVQQDMGPLRADETXDWAAGKKAFCGRGPSDGFERRERGPGGGFFDSQSKADEVDSWVSSKPRFVRSSSSNVTS

SEQ ID NO: 1608 - protein, 252 aa, Oryza sativa (japonica cultivar-group)
MAEHKAAKSKSKSKSGGHGHDAAAASKKSKGGKAKANNAAAAAPATSLDALFRPCGDVKGLRFGAQLVTRALTVRRAAPLELPHLLRVADERQREAPLAFAPTTTAYIPTNFAILAHHAWHTLTLGLGTRNSKAAVFVFESAAMKAAADAAWPQVVPLGDAGRRLIRAAPGAPEMARFKFRKGCVTFYVYAARTAGARGFARADELRAVVEAVAKLKDFLDHTAMLALPGQRSIDVAAAADAAAAAPVGVVH

SEQ ID NO: 1609 - protein, 491 aa, Magnetococcus sp. MC-1
MSVIFESSTPGRINPQHATPLEADEQQAALADLPEALLRQSPTGLPEVSELEVVRHYTKLSQKNYSIDTHFYPLGSCTMKYNPRAANKVAMLPGFLGRHPLDDPHYATGLLHTLFELQEMLREITGMAAISLAPMAGAQGEFAGVAMIRAYHDARGDSARREILVPDASHGTNPATATMCGYVTREVPTNAQGDVDIEALKSMVGPQTAGLMLTNPSTLGVFERSVGLIARIIHDAGGLLYYDGANLNAIAGRVRPGEMGFDAIHINVHKTFATPHGGGGPGAGPVGVSARLQPFLPIPRIVKQGASYALLESADCPQSIGRMGAFGGNIGVLLRAHAYLCMIGRQGVRRVGEYATLNANYLLARLTAAGFKPAYAERRATHEFIITLKAEADAYGLTALNMAKRLLDYGFYAPTIYFPLLVPECLLIEPTETESPEQLDAFVAAMVAIRKEAQESPEFVKNAPYTTPVRRLDETRAARKPDLIWRGPLEQ

SEQ ID NO: 1610 - protein, 461 aa, Magnetococcus sp. MC-1
MPFIPHTEDDVRLMLDTIGVESIDALFDEIPAELNTHPILESVPKPQSEAATLRLQSARAREGDGRLNFIGAGAYEHHIPAAVWELVTRGEFYSAYTPYQAEASQGILQTIYEFQSMMAGLMGMDLSNASLYDGATALAEAVLMAVRANPAPRGSTPRVIMPATVHPAYREVVQTMVRHQGIELVEPSFCAKRGGVAVSALNLYADEPVQALVIAQPNFFGQLEDVDFLTNWAHKRGALVIGVVNPVAMALLKPPAAWGEKGADIACGEGQPLGVPLSFGGPYLGFLSCRQALARQMPGRIVGRTLDQEGKEGFVLTLQAREQHIRRAKATSNICTNQGLLSIAATIHMAMLGPEGLKNVALTCHRRTQQLWQRLALLEGVERCFEGPFFHEVAIKLSKPAEEVLTCLSGVNIAGGYAVGRRYPGMENVLLVCCTETKERSDLDHYADALGLIMSEQGSAA

SEQ ID NO: 1611 - protein, 93 aa, Brassica napus
MEDDYKTPRFTIGRQSSMAPEKIPEPSIHSEEEVLEDGEEIDGGVRLMYLCNEGDVEGIKELLDSGIDANYRDIDDRTALHVAACQGLKDVVE

SEQ ID NO: 1612 - protein, 270 aa, Burkholderia sp. 383
MAGPGRVLLDAPQLPSLPTARSMYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 1613 - protein, 627 aa, Oryza sativa (japonica cultivar-group)
MLPRRRAGPLRLLRLLLVLVVAFAAVVAFCPAAAAAAGEGVGVVEEEEVRVGEAAAAVARGEGDDAVVAAAVAGGEVAGEAGAGLGEGAAAANATGKEGSLAEMIDRALEKEFPESEGEQGGGEKDPGSFNNTVAEKQGVLETVARRVTKKNETKDNKSFPFKEVFLDRPEQEDVPTLIDRKDNVFIISNPKSKYPVLQLDLRLISDLVVVIVSATFGGIAFACLGQPVITGYLLAGSIIGPGGFSFVSEMVQVETVAQFGVIFLLFALGLEFSTAKLRVVRAVAVVGGLLQIILFMLLCGISATLCGGKTKEGVFVGVLLSMSSTAVVLKFLMERNSINALHGQVTVGTLILQDCAVGLLFALLPILSGASGLLQGVASMAKSLVVLITFLTILSILSRTGVPWFLKLMISLSSQTNELYQLAAVAFCLLFAWCSDKLGLSLELGSFAAGVMISTTDLAQHTLEQIEPIRNFFAALFLASIGMLINVHFLWNHVDILLAAVILVITVKTFIVAVVVKGFGYSNKTSLLVGMSLAQIGEFAFVLLSRASSIHLIEGKLYLLLLGTTALSLVTTPLLFKMIPAVVHLGVLLRWFSVDSNQVELGLKSDGLRIDSGKRINLIVQGSHDS

SEQ ID NO: 1614 - protein, 150 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 1615 - protein, 150 aa, Haloarcula vallismortis
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDAPWLYE

SEQ ID NO: 1616 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQD

SEQ ID NO: 1617 - protein, 465 aa, Prochlorococcus marinus str. MIT 9313
MTSSTDSNLTLIPSPGDKVEITCLDLDRHGNGLARWNNWVVIVNDLLPGESAQIEFVRRHRNQFLARKVQTIETVASRRPPPCKIAKECGGCSIQHLSDHGQTLLKQGHLRQILLRLGQLDHKIEPIMTDYNRALGYRNRALIPLYRNSEGQLHMGYYRRGSHQIIDLNRCPVLDRGIDQYLASIKDDLQQQNWPADSDLSSGEGLRHLGIRIGQKTKQVLITLVSSTTQLSGLHQQAKEWYSRWPEVRGITLNIQRQRNNLVLGQETILLAGDLEIEEHFYNLSLLLSTTTFFQVNTLQAERIVSKLIEWLSTASLDINIIDAYCGIGTISLPIAATGYHVIGLELHAEAITQANKNALRNSLDNVSFLCGDVSLLLAKKLQRNDVLVLDPPRKGLDQMVIKTILSIQPERVAYLSCDPATLARDLKQLIVPNGPYQIDELQPIDFFPQTMHIECLALLTRISS

SEQ ID NO: 1618 - protein, 375 aa, Arabidopsis thaliana
LTYLSSLVAGKPKPTSVPVASGNQLHIGNYVVRAKLGTPPQLMFMVLDTSNDAVWLPCSGCSGCSNASTSFNTNSSSTYSTVSCSTAQCTQARGLTCPSSSPQPSVCSFNQSYGGDSSFSASLVQDTLTLAPDVIPNFSFGCINSASGNSLPPQGLMGLGRGPMSLVSQTTSLYSGVFSYCLPSFRSFYFSGSLKLGLLGQPKSIRYTPLLRNPRRPSLYYVNLTGVSVGSVQVPVDPVYLTFDANSGAGTIIDSGTVITRFAQPVYEAIRDEFRKQVNVSSFSTLGAFDTCFSADNENVAPKITLHMTSLDLKLPMENTLIHSSAGTLTCLSMAGIRQNANAVLNVIANLQQQNLRILFDVPNSRIGIAPEPCN

SEQ ID NO: 1619 - protein, 150 aa, Schizosaccharomyces pombe
NWVNHKGAWVIHIVLIAALRLIFHAIPSVSRELAWTLTNLTYMAGSFIMFHWVTGTPFEFNGGAYDRLTMWEQLDEGNQYTPARKYLLVLPIILFLMSTHYTHYNGWMFLVNIWALFMVLIPKLPAVHRKRIFGIQKLSLRDDDNDSIPR

SEQ ID NO: 1620 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKILGNQVKKAVEGLSDDQLKEVVIAYEPIWAIGTGKSSTSEDANEMCAHVRQTLADLSSQE

SEQ ID NO: 1621 - protein, 122 aa, Vibrio fischeri ES114
MKILIVDDFSTMRRIVKNLLRDLGFNNTQEADDGLTALPLLKKGGFDFVVTDWNMPGMQGIDLLKTIRADDELKHLPVLMITAEAKREQIIEAAQAGVNGYIVKPFTAATLKEKLDKIFERL

SEQ ID NO: 1622 - protein, 570 aa, Oryza sativa
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 1623 - protein, 343 aa, Rhodopseudomonas palustris CGA009
MDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 1624 - protein, 324 aa, Mentha x piperita
MGDEVVVDHATTKRYALVTGANRGIGFEICRQLASKGIMVILASRNEKRGIEARERLIKELGSEFGNYVIFHQLDVADPASLDALVNFIKTKFGSLDILVNNAGINGVEVEGDVSVYTEYVEAELKTMLEAGHGGVQGEAFHPQGNGRFVETLESAKECIETNYYGAKRITQALIPLLQLSRSPRIVNVSSSLGSLVLHPNEWAKGVFSSEDNSLTEEKVEEVLHEFLKDFKEAKLQENHWPHHFAAYKVSKAAMNAYTRIIAKKYPSFCINSVCPGFTRTEISYGLGQFSVAESTEALVKLALLPDGGPSGCFFTRDEAFCLY

SEQ ID NO: 1625 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGECKVFYYKMKGDYHRYLAEFSSGDAREKATNSSLEAYKTASEIATTELPPTHPIRLFLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 1626 - protein, 398 aa, Glycine max
MGKNEFLTPKAIANRIKAKGLQKLRWYCQMCQKQCRDENGFKCHCMSEGHQRQMQIFGQNPHRIVEGYSEEFETTFLEHMKRSHRFSRVAATVVYNEYINDRHHVHMNSTQWATLTEFVKYLGRTGKCKVEETPKGWFITYIDRDSETLFKERMKNKRIKADMVDEEKQEKEIRRQIEKAEQMMQPATSEADQPSQVEPLRELNMEDGIKIGFSLGSSLAKPVVKEKHEASRVVFDEGEEEKYNERNPRNNLKRKESGGGKSALDEMMREEEKKKEKINRKDYWLHEGIVVKVMSKVLAEKGYYKQKGVVRKVIDKYVGEIEMLESKHVLRVDQAELETVIPQVGGRVKIVNGAYRGSIAKLLGVDTDNFCAKVHIEKGVYDGRVLKAVEYEDICKVA

SEQ ID NO: 1627 - protein, 963 aa, Dechloromonas aromatica RCB
MPLNLPLSALEQHDEFIGRHIGPCSTEMATMLTAIGADSLEQLIDQTVPAAIRLPADLPLPAPRREHEALADLKAMASKNVVNKSCIGMGYYDTLTPKVILRNVMENPGWYTAYTPYQAEIAQGRLEALMNFQQMVIDLTGLEIANASLLDEATAAAEAMTMARRVSKSKSNRFLVDANCFPQSIDVVKTRAAYFGFELVIGNIDAHKDGDFFGALLQYPGDNGEVRDLTDVIAGLKAKGTTVAVASDLMALVLLKSPGAMGADIALGSSQRFGIPMGFGGPHAAFFATREAFVRSMPGRIIGISKDARGNTAYRMALQTREQHIRREKANSNICTSQVLLANMAGMYVVYHGAEGLRTIAGRIHRLTAILAEGLKRASVNLLTKQFYDTVHFDLGARAESVYNDALAAGYNLRRVSAGVLGISFDETTTRDDVATLFKLIAQTTLDVATIDAQVAAADSALPDSLIRSDAVLQHPVFNTHHTEHEMLRYLKSLQNKDLALDHSMISLGSCTMKLNATSEMIPVTWPEFGGIHPFAPRDQAVGYLEMITSLTEWLKTVTGFDAICMQPNSGAQGEYAGLVAIDRFHASRGEEHRNVCLIPKSAHGTNPATAQMANMKVVVVDCDENGNVDVADLKAKAEEHKDDLACLMITYPSTHGVFEEAIRDICAIVHANGGQVYMDGANLNAQVGLTSPGFIGADVSHMNLHKTFAIPHGGGGPGMGPIGLKAHLAPFMADHVVQPTGDANRVNAGQGAVSAAPFGSASILTISWMYLAMLGGAGVKKATQVAILNANYVAKQLNAHYPVLYVGKNGRVAHECILDIRPIKAATGIAEIDIAKRLMDYGFHAPTVSFPVAGTIMVEPTESESKAELDRFIGAMIAIREEIRQIENGVWTADNNPLKNAPHSQADVMDAEWKHPYSRQQAVFPLPWVAANKFWPSVNRIDDVYGDRNLNCACPPMEAYAD

SEQ ID NO: 1628 - protein, 556 aa, Mycobacterium tuberculosis H37Rv
MPDDIAAADPTDTQPHLRRDLANRHIQLIAIGGAIGTGLFMGSGRTISLAGPAVMVVYGIIGFFVFFVLRAMGELLLSNLNYKSFVDFAADLRGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 1629 - protein, 1057 aa, Arabidopsis thaliana
MAASLVRSCCSRASRAITTVRFMSNVPEDTVYGGPKPQNSNQRVTLTQLRQKHRKGEPITMVTAYDYPSAVHIDTAGIDVCLVGDSAAMVVHGYDTTLPISLEEMLVHCRAVARGAKRPLLVGDLPFGTYESSTNQAVDTAVRVLKEGGMDAIKLEGGSPSRITAAKSIVEAGIAVMGHVGLTPQAISVLGGFRPQGKNIASAVKVVETAMALQEAGCFSVVLECVPPPVAAAATSALNIPTIGIGAGPFCSGQVLVYHDLLGMMQHPHHAKVTPKFCKQYAQVGEVINKALLEYKEEVSKHLFPGPSHSPYKISSSDLDGFLSELQKLGLDKAASDAAASAEKMDHSDSPSSHESLSALVVSSSSASPLVFSQITRRLGSYSLAISFFEYLDAKSQSLKRREESLSLALQSVIEFAGSEPDPRDKLLRLYEIAKEKNIPLTIVATKLLIRWFGRMGMVNQSVLVYERLDSNMKNSQVRNVVVDVLLRNGLVDDAFKVLDEMLQKESVFPPNRITADIVLHEVWKERLLTEEKIIALISRFSSHGVSPNSVWLTRFISSLCKNARANTAWDILSDLMKNKTPLEAPPFNALLSCLGRNMDISRMNDLVLKMDEVKIRPDVVTLGILINTLCKSRRVDEALEVFEQMRGKRTDDGNVIKADSIHFNTLIDGLCKVGRLKEAEELLVRMKLEERCVPNAVTYNCLIDGYCRAGKLETAKEVVSRMKEDEIKPNVVTVNTIVGGMCRHHGLNMAVVFFMDMEKEGVKGNVVTYMTLIHACCSVSNVEKAMYWYEKMLEAGCSPDAKIYYALISGLCQVRRDHDAIRVVEKLKEGGFSLDLLAYNMLIGLFCDKNNAEKVYEMLTDMEKEGKKPDSITYNTLISFFGKHKDFESVERMMEQMREDGLDPTVTTYGAVIDAYCSVGELDEALKLFKDMGLHSKVNPNTVIYNILINAFSKLGNFGQALSLKEEMKMKMVRPNVETYNALFKCLNEKTQGETLLKLMDEMVEQSCEPNQITMEILMERLSGSDELVKLRKFMQGYSVASPTEKASPFDVFSLG

SEQ ID NO: 1630 - protein, 418 aa, Bordetella bronchiseptica RB50
MAEIKNYTLNFGPQHPAAHGVLRLVLELDGEVIQRADPHIGLLHRATEKLAEHKTFIQALPYMDRLDYVSMMCNEHAYVMAIEKLLGIEAPLRAQYIRVMFDEITRVLNHLMSLGSHALDVGAMAVFLYAFREREDLMDCYEAVSGARMHAAYYRPGGVYRDLPDTMPQYGDSSKYRGEKEVRAMNDARSGSLLDFIEDFTNRFPGCVDEYETLLTDNRIWKQRLVGIGVVDPDRAKALGFTGPMLRGSGVAWDLRKTQPYEVYDLMDFDVPVGVNGDCYDRYLVRVAEMRESNRIIRQCVEWLRNNPGPVMIENHKIAPPSRTAMKSNMEELIHHFKLFSEGFHVPPGEAYAAVEHPKGEFGIYLVADGANKPYRLKIRAPGFAHLQSLDEMARGHMIADAVTIIGTQDIVFGEIDR

SEQ ID NO: 1631 - protein, 90 aa, Glycine max
MSSTSRAWTWTVAASVGVVEALKDQGICRWNSVMRSAQQHAKHNMRSLSQTKKLSSQPSAMASAKLKDEKAKKSEESLRTVMYLSCWGPN

SEQ ID NO: 1632 - protein, 480 aa, Campylobacter jejuni RM1221
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVENIDDQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGTDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQITYYLQ

SEQ ID NO: 1633 - protein, 139 aa, Candida albicans SC5314
MRFTPILRQIPKLKLSEVLVKAGDGVPTGLAGIYKHPNPRPALVTLYNETLKTLKENFPADSVYRQSTEALTQNRLMIVESEEIVENIENQIGGGLIEEIVIQAADELSLASQLGGLKVWEELEEKPLDDQWVYFGKKI

SEQ ID NO: 1634 - protein, 466 aa, Caulobacter crescentus CB15
MGPAHEARDDGGGGGGMIAELAKSLSDLLTAERARFTVEHPRSVAMAKAAGAHWRGGAPMHWMNDWASPSPIFAAQGVGAQITDVDGKLYDDFCLGDTPSMFGHGDPSVAAAVSDQIKRGAGFMLPTASAAIVGKLLSERFGLPLWQAATTASDANRAAIRWARAVTGRPVILVFDGCYHGMVDDAFVVLKDGAPVMKPGLLGQVHDLTATTRVVAFNDLAALEAALAPGDVAAVLAEPVMTNCGMILPEPGFLEALRRLTREAGTLLVIDETHTISTGPGGYTRAHGLEPDVFVLGKAVAGGVPAAVWGVTAELSARMDAAQQRIGPGQSGIGTTLSGNALAMAAMRAMLSEVMTEAAYGKMLAGAERLVAGLNAVIAARRLPWSVVHVGARVELVFADPPPKNAAQMRKVLDHEAVEALHLWLINRGVLIAPFHNMMLVSPVTEDAAIDRLVAAVDGFAAAMGE

SEQ ID NO: 1635 - protein, 469 aa, Candida albicans SC5314
MQSIPQQQVPHHPPPANKPRPNAAAVPTISYQPTDIIIPTQLYDKIGNLGEYKRLQEAEKKLDLLIARKSLDFQAIQQKSIHPHEYRPSTGVLRIFIYNTCENQPWQKQLLQQKGLPVPDPTLAESSWTLRIEGKFISDIPDEQQQIDETFKFSSFLSAISVDLLPNENYPNIQESQSHIIEWRDDGPNANKPPASVSFDGLDIKRNGIFNIKSKIALLVKNHSNSLKLSEEMSRFVGKQECSQQELLYIIWQYVLFKGLFKKSNAYTEVPAVETSTLPNPADDKDSSDDDLTLVEADDLLFELLKVKTFKFSDLYKLTQAHFVPREPIIVDYEVDTRKSTTLGNVVLDIPVELPLNLLKAQKELLDVNKTAFENLAKADSTISQLDQRISLAIIALQNANSREKFYRELSDDPVKFIENWLESQAETLKALKSDEGYDEEVVRRAKYFEENEHLIKEKIELLLGSNKF

SEQ ID NO: 1636 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 1637 - protein, 272 aa, Mesorhizobium loti MAFF303099
MTGRLRLTILGCGSSPGTPRITGDWGNCDPANPRNRRMRTAALVERVAADGGRTTVVIDTGPDFREQMLLASVKRIDAVVYTHPHADHIHGIDDLRGYVLEQRHLIDIHADQPTMLRLRQAFGYCFETPPGSSYPPIVRAHIIDHAKPVVIEGEGGALALEPLPQIHGDIISLGFRIGGLAYCPDISDFPDPTADRLRGLEMLVIDALQYNPHPSHLSLGQALGWIEKLAPKQAVLTHMHVPLDYAKVKGEMPANVTPAYDGMVIEIPYESA

SEQ ID NO: 1638 - protein, 559 aa, Mycobacterium sp. MCS
MRKIETGDLWWKNAVFYCADIETFYDWNGDGTVDIRGMTERIEYLFDLGVTCLWLMPFYPTARKDDGYDIIDFFGVDQRLGNLGDFVELVRTARSKGIRVIVDFVMNHTSDAHPWFKSARRSKDDPYRDYYVWSETEPKSSPADVVFPDQEDSIWEQEPKTGEWYLHHFYKHQPDLNIANPKVQEEISRTLGFWLQLGVSGFRVDAVPFLFARDGVPGDPGVFDPYEYLGDVRNFVNRRVGDAVLLGEVNVPYDDQKSFFGGPDGDGLNMQFDFIGMQNMYLSLARGDAGPIAAALRERPPLDETSQWANFVRNHDELTLDKLGDAERQEIFDAFGPERDMQLYGRGLRRRLPAMLGGDERRMRMVYSLAFSLPGTPVLYYGEEIGMAENLDIPGRFAVRVPMQWTSDDNGGFSRAAARRLPRPITDGLYGPDRVNVADQRHDHQSFWWFIRDLIYTYRQQPEIGWSTAEVLDQPNPAVLAHCCREKSGWTMVGLHNFGADRCMVPIQIEDAPEGSTLVDLLDGLSVHELDAKGRLEIGLDGYGYRWLRLVRPGDDPII

SEQ ID NO: 1639 - protein, 349 aa, Streptococcus pyogenes MGAS315
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 1640 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQE

SEQ ID NO: 1641 - protein, 170 aa, Musa acuminata
YRHKVEVELSGVCSDIMTLIDEHLIPSSSAGESSVFYYKMKGDYYRYLAEFTTGNERKEAADNSLKAYQAATSTAEADLSPTHPIRLGLALNFSVFYYEIMNSPERACHLAKQAFDEAISELDTLSEESYKDSTLIMQLLRDNLTLWTADIPEDGEEYAKSGAGEDAQRV

SEQ ID NO: 1642 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQALADLSSQE

SEQ ID NO: 1643 - protein, 94 aa, Prunus salicina
PSNYSNPRTPSNCMGSQFNESIVSPRLRSKLKRSWPNVESSNDTRFWEGEWNKHGRCSQQTLNQYQYFERSHEMWHFHNITNILKNASIVPHPT

SEQ ID NO: 1644 - protein, 281 aa, Glycine max
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAGKSGVEVKAK

SEQ ID NO: 1645 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQE

SEQ ID NO: 1646 - protein, 435 aa, Xanthomonas oryzae pv. oryzae KACC10331
MSEFRQATDAFASNPAESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPRYKESRWHKGGALKKLNAAREGSMLDFLEDFTNTFPLRVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 1647 - protein, 443 aa, Oryza sativa
MAADKSPIDEALLHGKHEEALLHGKHEHVEQQLLPTSGGSFCITGASFGRSCLNLSNVISGIGMLSVPYALSQGGWLSLALFAMVGAICFYTGKLIYRCMRADRCVRSYPDIGYLAFGRYGRTAIGLIMYVELYLVAISFLILEGDNLDKLLPGTVVKILGYQVHGKQLFMLVAAAVILPTTWLKNLSMLAYVSAVGLVSSVALTVSLVWAGVADKGFHMAGSSILNLSGLPTALSLYFVCFAGHGVFPTVYSSMRARKDFPKVLLISSVLCSLNYAVTAVLGYKIYGEDVQAQVTLNLPTGKLYTRIAILTTLITPLAKYALVIQPVTTAIEEKLSTAAAAVAADAENNRLTRVLTSTTVVFSTVVLACTVPFFGYLMSFIGSSLNVTVAVLFPCLSYLKIYMPRGGVGRFEVAAIVGILVIGVCVAVIGTYTSLHQIIGTF

SEQ ID NO: 1648 - protein, 183 aa, Zinnia elegans
MAATTTTILLTISFALTNLYFVESAHQTGAPAPAADCSTVILNMADCLSYVTAGSTVKKPEGTCCSGLKTVLKTDAECLCEAFKNSAQLGVSLNITKALALPSACHINAPSATNCGISPGTAVAPALAPIGVGMAPSGAAVAFGPSMAVAPTPASQTSGSFALAMSTVSVFLSMLLSAYFYSC

SEQ ID NO: 1649 - protein, 954 aa, Vibrio vulnificus YJ016
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDALPQTEAFGALLQYPSTTGEVRDLTDVIAQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEEGIRTIARRTHHMTAILAAGLTKSGYELAHNAFFDTITINTGDKTQALYAKAQAADINLRLLDGQIGISFDETTTVADIDALFAIFDVKESVNALSTDIAGNEFAAIPEACRRTSRFLSHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 1650 - protein, 334 aa, Rhodococcus sp. RHA1
MTITDDNPLAQRIALAPTLAEIRAEERVMAAISQLSRGEAIILTDGIGSPTSGEVVFPAARISTADAAFAIRYSSGFLQVALPPDRCDALWLPAQQGAAPGTAQCVTVDAATGITTGISAADRARTIRLLASPDASPASFSRPGHVVPLRADAALPISDFGHPEAAVHLVAAAGFPPAAVLTTVVGTTHPTDVASGNDLQEFARTHQLPIVGLRDLDSEKTPLPILHVSVDLPSGRTSLESFTDLGHNYLVVAVGEVSGREDVPVHLLPADRVLIDAGSPGAEPRILIGLPQTPEDEYGRAIDGLHRQHSMIRAVLRRLGCLSVLAHRRPDSLR

SEQ ID NO: 1651 - protein, 296 aa, Arabidopsis thaliana
RSGRSIKNNRRTETTKPAGELRREKNPAKKGNSNSSSVDHCFTSASRAFTQKKLADLKSLFFSLASKSQSNDQYVSYPVFQEYFGLSGSLGERIFDMVTQHRKDDKMTFEDLVIAKATYEKGTDDEIAEFIYQTLDVNGNGVLRRSDLESFLVVILKSVFSTESSDAESSDYKEMVDALLDAATFSKSDDGSEKGMSFEDFRSWCPLVPTIRKFLGSLLIPPGPVRPGYQVPDLLYEDSVSSDRLLLKKEYAWHIGGALPHHELVEWKLLYRSSLHGQSFNTFLGHTSGMEGSNMA

SEQ ID NO: 1652 - protein, 979 aa, Debaryomyces hansenii CBS767
MSSQVVTNLEETTNQHKAINNPNVVKRIHREVRFGLYILGSTLGEGEFGKVKLGWRKDGKHPSQVAIKLIKRDTIMKDSESEIKIHREINSLKMLNHPNIVNLVEVMKSGKYIGIVLEYASGGELFDYILQHKYLKENVAKKLFAQLVSGVDYMHSKGLIHRDLKLENLLLDKHKNVIISDFGFVNSYNKDKNDLMKTSCGSPCYAAPELVLTQAPYEGRKVDTWSLGVILYAMLAGYLPFDDDPENEDGSDIVRLYHYICKTPLTFPEYISPLARDLLRKIIVPDPKKRITIKNIKNHPWLTPYVNLLSVTQPEWDKVHKDNKTVNPKSAATANNSYTNLIHSNTNKRFSMINEKTNSSSLMMPAGRSYSSTNVVNQLYSNPSAPTTSSSLANAVALSKPKDPASDRSRTPSPTKQLPNGNNYSSTNYQRGHAKSTSISNPYSSASNALKAMVTENDSKRNSLVSLDSTTSSMISLTSSTKPAQHNHLPSPHLPRSTTYTGSAISTIAESPSKPSPATHLAVDNESNVTHHNTASSSNITNLKPNSSSRESAKLPHANKKPRPTSYHPSSMSASLMSSNGSSLQDYIKIPTPLLPIPQLLSTSPTKASPSSETSSPVFTDTNNSSPTMRSNASINSRRNSVVTHVHVNGVLTSESNANHNENKRNSVLSYLEDKMDALELTELHSPLKSNKPGFTDNASDTNITPQINQLPMFDGQTESPIIHTSKAEESQVKDQSEEGNKIETDEHPFVNVANQVDENKVVDLALEKESISEAPEEPNVSHSQDRTNQQENITLEFEEPKYTLEAQPAEPVSQTFKDEPVVSLDEQLIKRDHVNIIDEQEKENLDRKTTNTKKETSREINKSSAKEIKDNKKRNRFSLLSFYSNYNGSSSSNVVLQQAPTSNVSHSGKRILEPSLEQNVPTQPQDQKRNVSNSSGKSSTSKKSNNSGTAHISSNNGKEASAARKVMDFFKRRSVKIG

SEQ ID NO: 1653 - protein, 259 aa, Streptomyces coelicolor A3(2)
MPAPAPSPVLLGVSLKMYFGHHQTLNWSRRIAALAERHPAVTSGAARLFVLPTFPALVPATGILAPYGVALGAQDIATEDSGPYTGEVGGPVLKEIGCRYAEVGHAERRRLYGEGDTVVAAKTAAALRNGLTPVLCVGERDAADPADAASRTVAEAERLLGGLSGAVVLAYEPQWAIGAPEPASADHIATVCTALRGWLDSHPRHAGSTVIYGGSAGPGLLTRLAGTAEGLFLGRFAHDPANVGAILDEIRSPAPAAVA

SEQ ID NO: 1654 - protein, 478 aa, Pseudoalteromonas tunicata D2
MARRTKIVATLGPATDRDNNLEKIIEAGVNVVRLNFSHGVAQDHKDRAAKVREIAAKLGKHIAILADLQGPKIRVSTFQDGKVTLVEGAKFILDAQMAKGEGNINAVGIDYKELPQDVSSGDLLLLNDGLIQLTVDSVQGQQVHCIVTIGGVLSNNKGINRLGGGLTAPAFTEKDEQDLITASEIGVDYIAVSFPRSGDDMRHVRALAEKAGSNAQLLAKIERAEAVCSVAAIDDIVLASDAVMVARGDLGVEIGDAELVGKQKLIISRARSLNRVVITATQMMESMIDNPMPTRAEVMDVANAVIDGTDAVMLSAETAAGDYPVETVKAMARVCVGAESQPETNVSKHRLDSMFADTSETLALSAMYAANHLSSVKAIVALTESGNTAKLMSRISSGLPIYSLSRHASTLGQTALYRGVYPVYFDSTACSKDAMVTEAVKALVAKGVLVAGDQVILTHGDSMETVGATNTMKIVTVQ

SEQ ID NO: 1655 - protein, 798 aa, Geobacillus stearothermophilus
MFTDKETFKQAFLIRLETLCGKQFEESTTRDHYYVLGHMVREHISRHWIATNERNRAQKRKQVYYLSIEFLLGRLLGSNLLNLGVRQVVEEGLRDLGIRLEDVEESEADAGLGNGGLGRLAACFLDSLATLNLPGHGHGIRYKHGLFDQKIVDGYQVELPQQWLRHGNVWEIRKEELAVEVNFWGKVEVYEQNGCLVFRHIDSKKVMAVPYDMPVIGYGTNTVNTLRLWNAEPAKTFPLHKDVMQYKRETEAISEFLYPDDAHDEGKILRLKQQYFLVAASLGSIVRAHRLQHGNLHQLHEYVAIHVNDTHPVLAIPELMRILLDEEGMSWEEAWHITTHTIAYTNHTTLSERLRMAIHLFQPLLPRIYMIVEEINERFCRELWERYPGDWGRIEQMAIIAHGVVKMAHLAIAGSHSVNGVAKLHTEILKQREMRLFYEWAPHKFNNKTNGVTHRRWLLKANPELSALITDTTGSRWIHEPETLIELKPHASDPAFQQALSAVKQQRKGKLAARIYEKTGIRVDESSIFDVQVKRLHAYKRQLLNVLHIMYLYNRLKEDPHFSIYPRTFIFGAKASPGYYYAKRIIKLIHSVADKVNNDKQTNEQLKVIFLENYRVSLAEEIFPAADVSEQISTASIEASGTGNMKFMMNGALTLGTLDGANVEIAEAVGKENMFLFGLTAEEVLNYYEHGGYRAHEYYHHDKRIKQVVDQLVNGFFPDVADYFEPIYDSLLTQNDEYFVLRDFAAYTEAHERVEAAYRDPARWWYMSAVNIAHSGYFASDRTIAEYAVDIWGISPSM

SEQ ID NO: 1656 - protein, 323 aa, Aspergillus oryzae
MAAFIGANLNPCNYIGGVSFNPERDIPDLSGKVALVTGGNAGLGKETILQLAKHRPQRIYLAARSETKAQAAISSLKGSLSNNVEITWLPLDLMSIKSIQTAAQTFNAESSRLDILILNAGVMSLPPGETEMGHEIQLGTNHTGHFLLTKLLLPTLLKTAEEPNSDVRVVSLSSIGHNLAPSFETILDQDRLKKVNTNTRYGASKAANILFAAELARRYPSITSVSVHPGIILTDLYSSVSDRSALAALGSKTLGLFGTQVPQGAYNELWAAAGAKKHDLVNGSYYIPVGHLKPYNQYARSEDMGRRLWDWTESELRKFNALP

SEQ ID NO: 1657 - protein, 438 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEAEFFIFDDVRYSVTPAKVAYQIDAEAAAWNTDAEVEMGNLAHRAGHKGGYFPVNPVDEAQDLRGEMLSTMKRMGMKVDKHHHEVATCQHELGLIFGGLTEQADNILKYKYVIHNVAHAYGKTVTFMPKPMKGDNGSGMHVNMSIWKDGKPLFAGDKYADLSQEALYFIGGILKHAKALNALTNPGTNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALTELEKDHDFLLAGDVFTKDQ

SEQ ID NO: 1658 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 1659 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIQVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVGSRK

SEQ ID NO: 1660 - protein, 199 aa, Triticum aestivum
TFSYCLPSFKSLNFSGTLRLGRKGQPLRIKTTPLLVNPHRSSLYYVGMTGIRVGKKVVPIPPSALAFDPATGAGTVLDSGTMFTRLVAPAYVAVRDEVRHRIRGAPLSSLGGFDTCYNTTVKWPPVTFMFTGMQVTLPADNLVIHSTYGTTSCLAMAAAPDGVNTVLNVIASMQQQNHRILFDVPNGRVGFAREQCTAA

SEQ ID NO: 1661 - protein, 941 aa, Mycobacterium tuberculosis CDC1551
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGVIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHTDIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 1662 - protein, 266 aa, Xanthomonas oryzae pv. oryzae KACC10331
MGYSVACLQLRNLRLMRRKIVAGNWKLHGSRAFATELVAKLAAHMPLEGIDVVILPPLPYLGDLIEDFEAHHLSFGAQDVSSNEKGAYTGEVSASMLVDVGAGYGLVGHSERRQYHQESSELVARKFAAAIHAGLTPVLCVGESLEQREAGQTEAILRAQLEPVLALVGSAGFAGAVLAYEPIWAIGTGCTATPEQAQAVHAFLRGEVAKADARIADSLPILYGGSVKPDNAGELFAQPDVDGGLVGGASLVAEDFLAIARAAAAC

SEQ ID NO: 1663 - protein, 529 aa, Medicago truncatula
MPSSHLLLEEPIRMASILEPSKASFFSAMTKIVGTLGPKSRSVETISGCLKAGMSVARFDFSWCDPEYHQETLENLKTAIKGTKKLCAVMLDTVGAEMQVVNKSETTISLEIDAQVVLTPNQGQEASSEILPINFDGLAQAVKTGDTIFIGQYLFTGSETTSVWLEVSEVKGNDVVCIIKNSATLTGSLFTLHASQIHIDLPTLTEKDKEVISTWGVKNKIDFLSLSYTRHAKDVREARDFLSKLGDLSQTQIFAKIENVEGLTHFDEILQEADGIILSRGNLGIDLPPEKVFLFQKSALHKCNMAGKPAVLTRVVDSMTDNLRPTRAEATDVANAVLDGSDAILLGAETLRGLYPVETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESETTTASNESILKVALDHGKALGVIKSHDRVVVCQKLGDASVVKIIELED

SEQ ID NO: 1664 - protein, 433 aa, Glycine max
  misc_feature (216)..(216): Xaa can be any naturally occurring amino acid
  unsure (1)..(433): unsure at all Xaa locations
MGMERVQCAYASLDEAFEIGKETYQGQQYSQIYFARLHLMRTLLYSLIPHWKPNSPVCTVLGLEEGKECVIVGTLYKHMKLKPCILDEYSKERSVVPLVKPHNFIHPDDHLVLEDESGRVKLSGYIISPSEYVTGIVVALLGKETGAGDFLVQDVLQAGLPPQIEFPLKSREDKYVVLVSGLSVGSSSSNPLQFQLLIDHITGHLGDEKEQSIASXIAQVVFAGNLIEIPHRLLNGQNLASKDLSRMAEPIKELDILLSQIAAGLPLDIMPGPSDPANFSLPQQSLHRCLFPGSSTYNTFRSCTNPHCFELDNVRFLGTSGQNVDDLEKYSEAKDKLEFMERTLRWRHLAPTAPNTLGCYPYTDKDPFFIESCPHVYFIGNQDKFETRVIKGSEGQLVRLVCVPIFSETGVAVMLNLRDLDCYALSFGTQFSS

SEQ ID NO: 1665 - protein, 61 aa, Glycine max
AEQTFIMIKPDGVQRGLIGEIITTFERKGPYLKGSKLRTVDRPFPQKHYADSSAKPFFTAL

SEQ ID NO: 1666 - protein, 563 aa, Oryza sativa
MRRWRKGAGGETVADREERRRQRGFLTTTVSPLPPSCCSCHPATLPISLIVDDKEGGVRFVFILVPCKCHIDATLDEDKSTRHEDQLIKFMESRALKRLRNRPNKNGPGEDDQWADPGRFSHLATRSVSSPESTKEDDRIAALPGQPCGVNFAQFAGYVTVDRKNGRELFYYFVESPYDASTKPLILWLNGVVLIEFIGPGCSSLGFGAMKELGPFRVNPDGKTLSRNKHAWNNVANVIFLESPAGVGFSYSMNSSDYSDVGDQITAEDTYVFLLNWFNRFPEYKGRDFYIAGESYGGHYVPQIATIVTFINHLFDGNTPFNLRGIFQASKGAKRGGEGCLVVVHDGNNNGRWWLGQVGNPLLDEYKNGEGNLEFLWSHGVISDEVWGKILANCTFTSSDDWPCFVAAHSFQRVNIDRYNIYAPVCLHEQDGTFRSSGYLPGYDPCIDYYIPRYLNNPDVQKALHARADTNWSGCNGDMDSICSLTATRYSVKDLNLTITHKWRPWYTPDNEVGGYVQQYEGGFTLASVRGAGHLVPSFQPKRSLVLLYSFLKGMLPPADIPK

SEQ ID NO: 1667 - protein, 705 aa, Dermatophilus congolensis
MTRRTRKITLSKIMAPAVVVALALPAGTAFAAQPHVVHTSAVKTDGSGAYLVGSGMYDITGAAAETGMLGYAASQEVDGLHMRLYSRAFVVADQKSGKRVAMVTTDMGAMFPSITSAVVAKLQQKFGDKYTPKNVLIAATHTHVGNSGMSGDRLYQVAGADSTSAGYDKKNFGTVVNGIVESISRAHTSLAPGTVQRSEGELKGATRNRSLPAHRANKNPGSEVDSSMTQLEFRRSNGQAVGVLNWFAIHPTSFSRKFTKLSGDNKGYASYMFEKQMGGDPDKAGSFVAAFANSAVGDVVPAQGNAHSAPGYGGSSDEYHNTHVAGEAQLGKARQLWAAQGQAQGGPVDFRSRHIDLRNYMVDAKYAGGKAVQLCKAARGFSFASGGENGPSKIPGMYEGMTRDSFSISDKIKKVIPSALGGLTRLAFAGVSALHQDKCHAEKPIPLPTGAWKMVSSVVQVQLVRVGNTAVLALPVEPTTVASRRLQERVAAELAGTGVNRVVIAGVANGYNGYLATREEYAAQHYEGASTEFGPFEFAAFEQEAAGLASAMKKGAAVSDAASPAGSFTAKTPARPGVLFDSKPAGQQFGQVLGQPSQSYSAGQVASAVFRAGHPKNDYRTMGSFLQVQRQEGGQWKTVRTDRDWDTTYAWKREGVAFSRATVQWRIPKGTPAGTYRLVQTGDWKNARGGKVSPYVGMSRSFTVR

SEQ ID NO: 1668 - protein, 311 aa, Mentha x piperita
MADTFTQRYALVTGANKGIGFEICRQLASKGMKVILASRNEKRGIEARERLLKESRSISDDDVVFHQLDVADPASAVAVAHFIETKFGRLDILVNNAGFTGVAIEGDISVYQECLEANIIAAQGGQAHPFHPKTTGRLIETLEGSKECIETNYYGTKRITETLIPLLQKSDSPTIVNVSSTFSTLLLQPNEWAKGVFSSNSLNEGKVEEVLHEFLKDFIDGKLQQNHWPPNFAAYKVSKAAVNAYTRIIARKYPSFCINSVCPGFVRTDICYNLGVLSEAEGAEAPVKLALLPDGGPSGSFFSREEALSLY

SEQ ID NO: 1669 - protein, 448 aa, Exiguobacterium sibiricum 255-15
MTRRNITREDIMKIAKAEDVRFIRLQFTDILGTIKNVEIPVSQLEKALDNKMMFDGSSIEGFVRIEESDMYLFPDLNTWVVFPWTEDGTGKVARLICDIYNPDGTPFAGDPRGQLKRVLKEMEELGFTSFNVGPEPEFFLFKKDANGRPTLELNDQGGYFDLAPVDLGENCRKEIVIELENMGFEIEASHHEVAPGQHEIDFKYADAITTADNIQTFKLVVKTIAAKHNLHATFMPKPLYGVNGSGMHANMSLFKGNENVFFDEENSNMQLSDDARAFTAGILKHARAFTAVCNPTVNSYKRLVPGYEAPCYVAWSARNRSPLVRVPAARGLSTRIEVRSVDPAANPYLALATLLASGLDGIKNNLQAPAPIDRNIYVMDKPERVANGIDDLPSTLSHALEVLKADDVVMHALGEHIAEHFVELKEIEWDMFRTQVTEWERDQYMVLF

SEQ ID NO: 1670 - protein, 115 aa, Brassica napus
  misc_feature (111)..(111): Xaa can be any naturally occurring amino acid
  unsure (1)..(115): unsure at all Xaa locations
MYVRALPTTDVNRNTEWFTYPGVWTTYILILFFSWLLVLSVFHCSPGMAWTIVHLAHFTVTYHSFHWKKGTPFGDDQGIYNRLTWWEQIDNGKQLTRNRKFLTVVPIVLYXIASH

SEQ ID NO: 1671 - protein, 332 aa, Ralstonia eutropha JMP134
MTIKIGINGFGRIGRMVFRAAAANFKDIEVVAINDLLEPDYLAYMLKYDSVHGRFDGEVSVDGNTLVVNGKKIRLTAVKDPAELKWGEVGADVVIESTGIFLTKEGAQKHIDAGAKKVIMSAPSKDDTPMFVYGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKSASYEEICAEMKAQSQGALKGVLGYTEDKVVATDFRGDARTSIFDAEAGIALDGTFIKVVSWYDNEWGYSNKCLEMARVVAK

SEQ ID NO: 1672 - protein, 468 aa, Nitrosomonas europaea ATCC 19718
MAADVLKMIQDHEVKFVDLRFTDTNGKEHHVTVPAHTFDTDKFEDGHAFDGSSIAGWKNIHASDMLLMPDPETAALDPFMEETTLLLTCDVVDPADGQGYNRDPRSLAKRGETYLKSTGIGDIAYFGPELEFFIFDSVRWHTDMSGCFVKIESEEAAWSSKKRYEKSNNGYRPAVKGGYMPVPPVDSLHDIRSAMCMVLDELGIPVEVHHHEVANAGQCEIGTRFSSLVKRADWNQLMKYVIHNIAVSYGKTATFMPKPIVGDNGSGMHVHQSIWKEGKNLFAGNGYAGMSETALYYIGGIIRHAKALNAFANPGTNSYKRLVAGFEAPVNIAYSASNRSAAVRIPYASSPKQRRIEIRFPDPSANPYLTFTALLMAGLDGIQNKIHPGDPMDKNLYDLPPEEASMVPNTCASLEEALASLDSDREFLTRGNVFSNDMIDAFIKLKSEEATLLRTTTHPVEFALYYSL

SEQ ID NO: 1673 - protein, 166 aa, Oryza sativa
TTDLAQHTLEQIEPIRNFFAALFLASIGMLINVHFLWNHVDILLAAVILVITVKTFIVAVVVKGFGYSNKTSLLVGMSLAQIGEFAFVLLSRASSIHLIEGKLYLLLLGTTALSLVTTPLLFKMIPAHEDLGVLLRWFSVDSNQVELGVKSDGLRINLIVQGSHDS

SEQ ID NO: 1674 - protein, 85 aa, Debaryomyces hansenii CBS767
MSLSADSFRELIKEKLQASLVQVEDMSGGCGQAFAVIIVSPNFEGKNKLMRHRLVNNALKEEIASIHAFTQKAFTPQEWAAQDGK

SEQ ID NO: 1675 - protein, 514 aa, Bifidobacterium longum NCC2705
MFAERLRNAMNSRGLKQVDLVHAAEHRGVKMGKSHISQYVAGKTMPREDVLEFLASELDVDMNWLRGEESTTQLNSDASNSVTDGEHAATPLATGASKPQTDSEIPVGRRRTFGKSHKLDNVLYDVRGPVADEAMRMEANGTHILKLNIGNPAPFGFRTPDEVVYDMAHQLTDTEGYSPSKGLFSARKAIMQYAQLKNIPNVTIDDIYTGNGVSELINLSMSALLDTGDEVLVPSPDYPLWTACVNLAGGTAVHYLCDEQSEWYPDIDDIRSKITSNTKAIVIINPNNPTGALYPKEVLQQIVDIAREHQLIIFSDEIYDRLVMDGLQHISIASMAPDLFCVTFSGLSKSHMIAGYRIGWMILSGNKRIAKDYIEGLNMLANMRMCSNVPAQSVVQTALGGHQSVNDYIVPGGRVHDQRDLVYDMLNQIPGITAVKPKAAFYIFPKIDVKRFNIHSDEQFALDLLHDKHILISHGGAFNWHRPDHFRVVYLPRMGMLRETMGEISDFFSYYWQS

SEQ ID NO: 1676 - protein, 608 aa, Polaromonas sp. JS666
MEHAPAWLTNSFIYLAAAVVAVPLAKKFGLGSIIGYLAAGIAIGPWGMGLVTNVQDILHFAEFGVVLMLFLVGLELEPQRLWNLRRPIFGWGSAQVLGCAALLTGAAMLFGVGWQTALVAGLGLALSSTAIALQSMGERNLLPTSSGQAGFSILLFQDVAAIPILALLPLLGAVAGENEAAAQSHRAIEALKIIAVIGGIILGGRLLLRPLLRWIANSGTPEIFTAASLLLVVGIAALMQLVGLSMALGAFLAGVLLAESEYRRELETDIEPFKGLLLGLFFIAVGMSIDFGVLWKSPGLMAAILLGFLGLKLAVIYGLAWRMKLPYQERPVFTVLLAQGGEFAFVVFQAAAGAQVFSAETASLLIGAVALSMLISPLLLVAVDKLLLPRWANCSTPQLEEISEPQQASIIIAGFGRYGQIVGRMLLAQGIPATVLEHDADMVETVRAFGYRVFYGDATRLDLLRTAGAASARILVLAVDSMEQSLKIVDLAKEHFPNLEIVARAHDVTHWNALRDRGVMRVEREVFESSLRSARTVLELLGQPPHEARQAAMRFRQHNLELFERMYPHRKDRTKVIAVATQGRLQLEEQMAQERAQAAQPRPQDWHG

SEQ ID NO: 1677 - protein, 501 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGSGLRHEPSYKFFSFNAGPRTCLGKNLAMNLMKTVIVEILQNYEIKIVSGQKIEAKPGLVLHMKHGLKVTMTMKCSSLE

SEQ ID NO: 1678 - protein, 331 aa, Candida albicans
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKVEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRLPTTDVSVVDLTVRLKKAASYEEIAPAIKKASEGPLKGVLGYTEDAVVSTDFLGSSYSSIFDEKAGILLSPTFVKLISWYDNEYGYSTKVVDLLEHVA

SEQ ID NO: 1679 - protein, 490 aa, Blastopirellula marina DSM 3645
MSAARLLPQRARTKIVATVGPACNTPEMLEQMILAGVDVFRLNLAHGELDEHSRVATTIREISERLKRPVATLADLSGPKIRLGTLVQDPIYCVEEQMYRFIRGDVATEPNELVSNYEPLIDEVKVGDNVMLADGTITMEVVEKTEDSVTCVVVAGGILRSRQGINLPGTKLGVETITPRDRDHIRWAAETDLDYVSLSFVREADDIRQLKDLLQAHESRAMVIAKIEKREALDNLEEIVEVSNGVMVARGDLGVEIDVAEVAAAQKLIVKTCTRIGRPVIVATQMLDSMTKNSRPTRAEATDVANAILDGADACMLSQETAVGEHPIVVIKMMNRIMLATEKMLCEDLSNAIRGEEIGLVHPVTQAVVSGATRTADLLNAKLMVMATRTGGTALTKAKIRDCIATIGVSDSKAALRRMSLYWGIIPIDGAPVHNGIQLRRFVDKWGFEAGLLKPNDRVVFVTGGGIMQSAEYIVVVHKVEAPEGYGVTE

SEQ ID NO: 1680 - protein, 410 aa, Spiroplasma citri
MKLPLTIRDSVHGDIEINEEITVKLINTPEFQRLDRISQLAGGQFVFPSASHTRFSHCIGVYYLVSKMLETTSFQEMYSKHEQLLVKLAGLLHDVGHGPFSHTFEITNQVTKQNISHENYSSLLIKDPTTNINKILAAEFSTDEINELCMMIEGKHPDGVLSSLVSSQLDADRMDYLLRDGQTSGVGYSHVDTQWIIRHLFIKDKKIVFPLKVQYAIESFLIGRYHMYKQVYLHSLSIGFDLTFQMMFKRLYDLYHNKYQFKNKAIITLLTPVLEGKMMSPNQYCTLDDYTLFTYLKMLESENDEILVTLIKMLTMRNFLQKINPEKKNFEEIKNNLIKKYKNHYNYFMVEYNLKPVKLYDSDTKPIYIDTPKGIKCIMEVSEVLAFKNNSKKTATTIWFSIGEKYENDW

SEQ ID NO: 1681 - protein, 471 aa, Pseudomonas aeruginosa UCBPP-PA14
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPLSSYLALAFLVMVVVLMAFFEDTRIALYIGPPFILLLTVLYYAFNLAPKEPAGTGSVSRAAS

SEQ ID NO: 1682 - protein, 467 aa, Escherichia coli K12
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 1683 - protein, 491 aa, Vibrio vulnificus YJ016
MKMCKTKIVATLGPASQTREKLTQLIQAGVNVVRLNFSHGSAEEHIARAEMVREIAQDLNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVEAMVRIAQGVEHETSCAQGCWDKLHHLCNDAGKSFALSSMISATKVHKDLGVAIVTQHGETPLLMSRCQSQATIWAVSDKPELLRKLAILRGVTPVYLPTLDKRGDIAHQLVSLLGADAKQKQISSIMMTQLESVEGVGDMNVCRLLNLNETPITTAIAA

SEQ ID NO: 1684 - protein, 154 aa, Oryza sativa
MASPTTMVGVATSAHLHTTTTGRLSCACAPPTRGTRRRRLAVAVRVRVRVRASASEAMATEKLGVRVERNPPESRLSELGVREWPKWGCEKSKFPWTYSAKETCYLLQGKVKVFPDGAGEDFVEIAAGDLVVFPKGMSCTWDVAEAVDKHYKFE

SEQ ID NO: 1685 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 1686 - protein, 186 aa, Bacillus thuringiensis serovar kurstaki
MILVGDSLGMVVLGYDSTVPVTVEDMIHHTKAVRRGAKETFIVTDMPFMSYHVSLQETMVNARRIVQESGAHALKVEGAGEVISTIQYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYAV

SEQ ID NO: 1687 - protein, 172 aa, Glycine max
  misc_feature (40)..(40): Xaa can be any naturally occurring amino acid
  misc_feature (55)..(55): Xaa can be any naturally occurring amino acid
  misc_feature (76)..(76): Xaa can be any naturally occurring amino acid
  unsure (1)..(172): unsure at all Xaa locations
SLHPWEQDLLKKICDAYYLPAWCSASDYVKLLQILSLQDXQSEDWSRFVAPFWPXVIRSALNGIGLTPLLGRGLKXIKGALGFPLGVKGSKKNRVNFAPHYMAKTPKINGGGEKTLFKKKKGVFFGGGNVLKNFYWGGGVFLRGEKKFFFLCGPPRVFLSPPSLFFSSPQKS

SEQ ID NO: 1688 - protein, 491 aa, Gibberella zeae PH-1
MSDDEDFMQESDEEQYDFEYEEDDDEETGDVDIENKYYNAKQLKLSDPEDAISEFLGIPPLEDEKGEWGFKGIKQAIKLEFKLGQYDKAAEHYAELLTYVKSAVTRNYSEKSINNMLDYIEKGADGPEAVKCMEQFYSLTLQSFQSTNNERLWLKTNIKLAKLLLDRKEYTAVSKKLRELHKTCQREDGSDDPSKGTYSLEIYALEIQMFAETKNNKQLKALYQRALKVKSAVPHPRIMGIIRECGGKMHMSEENWKEAQSDFFESFRNYDEAGSLQRIQVLKYLLLTTMLMKSDINPFDSQETKPYKTDPRISAMTDLVDAYQRDDVHMYEKVLQRNQDILDDSFIAENIDEVTRNMRTKGVVKLIAPYTRMKLSWIAKQLKISEPEVQDILGFLIIDGKINGRINQQEGLLEITSDADAERIAALQGLTSSISELFGAVFRDGDGFRNIEHSAADEQNIEGGLLLGKVGRPGGQHRGKKGKIAAAAAWA

SEQ ID NO: 1689 - protein, 227 aa, Sulfolobus solfataricus P2
MDPKELLATYTLNYLRGKKIIGVGTGKTVKKLIEVLSSEENLKESSLFVASSIDTEIELSKRGFKVLSLFSAIQPEIYVDSFDIVTKDGIMIKGGGGALLREKLLAYFSKYRIFIGESTKLKDTKVIDIPIEVISVGVSYVKYKLEKMGFTVKIREGSGKMGPIISDNGNVILDVSVKTENLCEFDRMIKNIPSIVETGIFCKELYNKIILANEQGRIEEMDAGDGI

SEQ ID NO: 1690 - protein, 452 aa, Sulfolobus solfataricus P2
MRKTKIVATLGPSSEEKVKELAEYVDVFRINFAHGDETSHRKYFDLIRTYAPESSIIVDLPGPKLRLGELKEPIEVKKGDKIVFSQKDGIPVDDELFYSAVKENSDILIADGTIRVRVKSKAKDRVEGTVIEGGILLSRKGINIPNVNLKSGITDNDLKLLKRALDLGADYIGLSFVISENDVKKVKEFVGDEAWVIAKIEKSEALKNLTNIVNESDGIMVARGDLGVETGLENLPLIQRRIVRTSRVFGKPVILATQVLTSMINSPIPTRAEIIDISNSIMQGVDSIMLSDETAIGNYPVESVRTLHNIISNVEKSVKHRPIGPLNSESDAIALAAVNASKVSKADVIVVYSRSGNSILRVSRLRPERNIIGVSPDPRLAKKFKLCYGVIPISINKKMQSIDEIIDVSAKLMQEKIKDLKFKKIVIVGGDPKQEAGKTNFVIVKTLEQQKK

SEQ ID NO: 1691 - protein, 300 aa, Triticum aestivum
  misc_feature (38)..(38): Xaa can be any naturally occurring amino acid
  unsure (1)..(300): unsure at all Xaa locations
MAAPSSLASSPPASPPPPRPRSTTTRTTSSASAAPAAXAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 1692 - protein, 75 aa, Brassica napus
ARAYRSFTRRGGVIFAGDEYGESVVWKIGKGAMGRRMEWEIKGSIWLTYWPNKYKTFYHETRRLDFTQLLYLTID

SEQ ID NO: 1693 - protein, 337 aa, Coccidioides immitis RS
MVVKVGINGFGRIGRIVFRNAVEHPEVEIVAVNDPFIETHYAAYMLKYDSTHGRFKGDVKFSDNGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRAAAQNIIPSSTGAAKAVGKVIPSLNGKLTGMSMRVPTSNVSVVDLTCRTDKSVTYDQIKEAMKKASANELKGIMSYSEDALVSSDLNGDTHSCIFDATAGIALNDHFIKLVAWYDNEWGYSRRVIDLIAYIAGVDAGK

SEQ ID NO: 1694 - protein, 472 aa, Rubrivivax gelatinosus PM1
MANKTVADVMKMVKENEIKFVDFRFTDTRGKEQHVSVPVSHFDEDKFTSGHAFDGSSIAGWKGIEASDMQLMPDPNTANIDPFFEEPTLILTCDVIDPADGKAYERDPRSLAKRAEAYMKASGLGDAAYFGPEPEFFVFDSVRWSNDMSGCFAKIESEEAAWNTGKEYEHGNSGFRPAVKGGYFPVPPVDSGQDLRSEMCLILESLGIPVEVHHHEVANAGQMEIGTKFSTLIQRADWVQLQKYVIHNVAHAYGKTATFMPKPIVGDNGSGMHVHQSVWKDGKNLFAGDGYAGLSEFALFYIGGIIKHARALNAITNPGTNSYKRLVPGFEAPVKLAYSAKNRSASIRIPYVANPKGRRVEARFPDPLMNPYLGFAALLMAGLDGVENKIHPGEAATKDLYHLPPEEDAKIPTVCASLEQALEYLEKDRAFLTKGGVFTDSYLDAYIDLKMQEVTRFRMATHPVEFDMYYTL

SEQ ID NO: 1695 - protein, 789 aa, Mannheimia succiniciproducens MBEL55E
MTFQSIVEKYCRYFDVADPKNLTLQQWYQIVAEGSLELACSQPFAKPAESRHVNYLSMEFLIGRLTGNNLMNLGYYEQIRDYLKQYQVELVDVLEQERDPALGNGGLGRLAACFLDSMAALGQNATGYGLHYQYGLFKQSFAEGMQKETPDTWDRNNYPWHSFNPSKTRYVGFGGKIKHIQGDNYEWSPKLTIQGKAFDLPVVGYRNNLIQPLRLWQADSDQSFDFDAFNEGKFLKADKTIVNAAALTQVLYPNDNHKAGQKLRLMQQYFHCACSVADILERHFAEGYQLADFAKRQVIQLNDTHPTLAIPELMRLLLDDYHLTWDQAWDICTNTFAYTNHTLLPEALEQWDQRLFKQLLPRHYQIVEKINDIFHQKVRSEFGENSQVWEKLAILFDYRVRMANLCVVTCFRVNGVAQIHSDLLVTDLFPEYHKLFPGKFCNVTNGITPRRWIRQANPKLSDLLDRTLKQDWAKDLELLSGVEKYVDDAGFREEYQAIKRHNKIVLADEINRTLALKVNPDAIFDVQIKRFHEYKRQHLNLLNIIADYQSLKANPNQDYTPRVFVFAGKAAPGYYLAKNIIHAINNVAEIINNDKQVNDRLQVAFLPDYRVSLAEKIIPAADVSEQISMAGKEASGTGNMKLALNGALTLGTLDGANVEIAEMVGEENVFIFGHTVESVRELLAKGYHPKDYYKKDSVLKNAVDFLAHGKASNGDKETFRLMLDSLLERDPFLVFADFDSYRLAQQKIGSAYLNREAWLRSAILNTARLGTFSSDRSIRDYQQHIWLKK

SEQ ID NO: 1696 - protein, 349 aa, Nostoc sp.
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 1697 - protein, 334 aa, Nitrosomonas europaea ATCC 19718
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 1698 - protein, 168 aa, Arabidopsis thaliana
  misc_feature (106)..(106): Xaa can be any naturally occurring amino acid
  misc_feature (112)..(113): Xaa can be any naturally occurring amino acid
  misc_feature (117)..(117): Xaa can be any naturally occurring amino acid
  misc_feature (124)..(124): Xaa can be any naturally occurring amino acid
  misc_feature (132)..(132): Xaa can be any naturally occurring amino acid
  misc_feature (134)..(135): Xaa can be any naturally occurring amino acid
  misc_feature (146)..(146): Xaa can be any naturally occurring amino acid
  misc_feature (152)..(152): Xaa can be any naturally occurring amino acid
  misc_feature (155)..(155): Xaa can be any naturally occurring amino acid
  misc_feature (163)..(163): Xaa can be any naturally occurring amino acid
  misc_feature (165)..(165): Xaa can be any naturally occurring amino acid
  misc_feature (167)..(167): Xaa can be any naturally occurring amino acid
  unsure (1)..(168): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFXVYREQXXNTPXYYDGRYXWAMWKLPXFXXPIPLKFLKEVXGSRRGXPGXLFGSIGFXKXRXA

SEQ ID NO: 1699 - protein, 98 aa, Zea mays
  misc_feature (38)..(38): Xaa can be any naturally occurring amino acid
  misc_feature (55)..(55): Xaa can be any naturally occurring amino acid
  unsure (1)..(98): unsure at all Xaa locations
EYRAPTPAVGTPKQRNDAGDDDNDDDDDEPPLNEDDDXELDALEQGEDDPNTQHXLVLAQFDKVSRTKNRWKCTLKDGIMHLNGRDVLFNKATGEFDF

SEQ ID NO: 1700 - protein, 248 aa, Bordetella bronchiseptica RB50
MTTAENRARLVLGNWKMHGNLAENAALLAELRAADAAAHCEMGVCVPFPYLAQTAAALQGSAIGWGAQDVSAHAKGAYTGEVAAPMLAEFGCRWVLVGHSERRTLHAESDQLVADKARAALEAGLTPVVCVGESLQEREGGNTLGVIERQLEPVLALGRDALVRMVLAYEPVWAIGTGRTASPEQAQEVHSAIRVALDGLQASQVRVLYGGSVKGANAASLFAMPDIDGGLVGGASLVAEEFLRIAAA

SEQ ID NO: 1701 - protein, 524 aa, Debaryomyces hansenii CBS767
MSTDKLKSYVEEISPYLTQWYVIALGGILVWYIGTSIKAYQFKQKYGCKEPPLVPGGFLSIKLLLDLLKTKSEGTMLEYAEHFFSLVKSQTFKLKLATVPIIFTQDPENIKAVLATQFNDFALGTRHAHFKPLLGDGIFTLDGDGWKNSRLLLRPQFAREQVAHVQTLEPHLQTLAEHISNKKGETFDIQELFFRLTVDAATEFLFGESVYSLRDGTVKDVAPLDFDGKSSFADSFNLSQSYLASRAYSQMFYFLINNKEFRNSNTKVHKFCKHYVEQALATSQDELDKKSKDGYIFLYELVKQTRNPKILQDQLLNILLAGRDTTAGLLSFTFFELARNPDVFEKLKNEIYTHFGDGANPRIETITFESLKRCEYLKFVLNEVLRLYPSVPINFRVSTKDTTIPRGGGPDKQDPVYVAKGTTVAYSVYTTHRLEQYYGKDSREFRPERWAENKKVGWAYVPFNGGPRICLGQQFALTEASYVVVRLIQMFPNLVSRDDRPYPPRKNVQLTMCHQDGVFISLNK

SEQ ID NO: 1702 - protein, 118 aa, Saccharomyces cerevisiae
ASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 1703 - protein, 103 aa, Triticum aestivum
ARRAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 1704 - protein, 471 aa, Sulfolobus solfataricus P2
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWSDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 1705 - protein, 492 aa, Campylobacter jejuni RM1221
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLQKLLAKCKRVHIIGLYSDGGVHSMDTHFKAMLEICAKNGNEVFAHAITDGRDVSPKSGLNFIKDLKGFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNAAIKAVEAVDTCLGEIIECAKKHDYAFIITSDHGNCEAMQDEKGNLLTNHTTFDVFVFVQAKGVSKIKDNMGLSNIAASVLKILDLEIPKEMNEALF

SEQ ID NO: 1706 - protein, 523 aa, Saccharomyces cerevisiae
MRVYQFCRPFQLFTCFLCYLLVFVKANKEKISQKNYQVCAGMYSKEDWKGKIDPFISFNLKKISGLSDESDPGLVVAIYDFQDFEHLGVQLPDEEMYYICDDYAIDIGICEEENRDEFIVQDVVYDPYTSTNRSLANPIMTFSQNEVGLHDTRYPIKETGFYCVTAFRSSTSTKFNAVVNFRNAYGQLAGTEINKLPLYGLLAVAYVVAMALYSFAFWKHKHELLPLQKYLLAFFVFLTAETIFVWAYYDLKNEKGDTAGIKVYMVFLSILTAGKVTFSFFLLLIIALGYGIVYPKLNKTLMRRCQMYGALTYAICIGFLIQSYLTDMEAPSPLILITLIPMALALIIFYYMIIRSMTKTVIYLKEQRQIVKLNMYKKLLYIIYASFLSVLAGSIVSSFIYVGMNTIDMIEKNWRSRFFVTDFWPTLVYFIVFVTIAFLWRPTDTSYMLAASQQLPTDPENVADFDLGDLQSFDDQDDASIITGERGIDEDDLNLNFTDDEEGHDNVNNHSQGHGPVSPSPTK

SEQ ID NO: 1707 - protein, 392 aa, Prochlorococcus marinus str. MIT 9313
MPLPPHLSDRVVALQPSLTLAISARAKALQQEGRDICSLSAGEPDFNTPEFIIDATVKALRDGITRYGPAAGDPELREAIATKLSKENTVPTNAEQVLVTNGGKQAIFNLFQVILNPGDEVLIPAPYWLSYPEMARLAGAKVTTLPSTPENGFCLDLNNLEASIGPKTRLLLLNSPGNPTGRVMARKELETLADLLRDHPQILVMSDEIYEFILEEGQQHYSFSAIAPDLSNRTFIVNGFAKGWAMTGWRLGYLAGPADAVKAATALQSQSTSNVCSFAQRGALAALQGSRECVKKMVKSYNTRRELLTSGLLSLEGMSLVPPKGAFYAFPKLPPESLDSVSFCEQALENHGLAMVPGAAFGDDSCVRLTCAVSPETICDGLERLRKALKQS

SEQ ID NO: 1708 - protein, 480 aa, Pseudomonas syringae pv. phaseolicola 1448A
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVSKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEDGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 1709 - protein, 483 aa, Pseudomonas syringae pv. phaseolicola 1448A
MIPVILSGGSGSRLWPLSRKQFPKQFLALTGEHTLFQQTLERLVFEGMQEPIVVCNKDHRFIVNEQLAALNLETQAILMEPFGRNTAPAVALTAMKLVNEGNDGLMLVLPADHVIEDQKALQRALALATVAAERGEMVLFGVPANKPETGYGYIKSTADALLPEGVSRVSQFVEKPDEKRAREFVEAGGYYWNSGMFLFRASRFLEELKKHDPDIYDTCLLTLERSVQDGDALEIDASTFACCPDNSIDYAVMEKTQRACVVPLSAGWSDVGCWSSLWEVNAKDVNGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 1710 - protein, 255 aa, Photorhabdus luminescens subsp. laumondii TTO1
MRHPLVMGNWKLNGSTHMVNELITGLRQELSSVTGCDVAIAPPALYLSQAKQALAGSRIALGAQDVDVNLSGAFTGETSATMLKDIGAEYIIIGHSERRTYHQESDEFIAKKFAILKQQGLIPVLCIGETEQENEAGQTESVCARQIDAVLNTLGVAAFQGAVIAYEPVWAIGTGKSATPAQAQAVHKFIRDHIAQKDAAIAQQIIIQYGGSVNADNAAELFSQPDIDGALVGGASLKANAFAVIVKAAAAAKKA

SEQ ID NO: 1711 - protein, 469 aa, Shewanella oneidensis MR-1
MSVESVLKQLEELEVKFVDLRFTDTKGKEQHVSIPSHQVDADFFEDGKMFDGSSIAGWKGINESDMVLMPDPTTFVLDPFTEETTALIRCDVLEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVARTTHPLEFEMYYSL

SEQ ID NO: 1712 - protein, 168 aa, Saccharum hybrid cultivar H32-8560
MALTVMASSATAAAPFQGLKSTASLPVARRSTTSLAKVSNGGRIRCMQVWPAYGNKKFETLSYLPPLTQEQLLKQVDYLLRNNWVPCLEFSKEGFVYRENSTSPCYYDGRYWTMWKLPMFGCTDASQVYKELQEAIASYPELRAILGFDNIRQTQWLTFIAYKPAGSE

SEQ ID NO: 1713 - protein, 439 aa, Glycine max
MASDADMEDYGFEYSDEEEVEQDVDIENQYYNSKGMVESDPEGALAGFAQVVQMEQEKAEWGFKALKQTVKLYYRLGRYKEMMEAYREMLTYIKSAVTRNYSEKCINSIMDYVSGSASQNFGLLQEFYQTTLRSLEEAKNERLWFKTNLKLCKIYFDIGEYGRMSKILKELHKSCQKEDGTDDHKKGTQLLEVYAVEIQMYTETKNNKKLKQLYQKALTIKSAIPHPRIMGIIHECGGKMHMAERQWAEAATDFFEAFKNYDEAGSQRRIQCLKYLVLANMLMESEVNPFDGQEAKPYKNDPEILVMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERADRSKGMKKYTAVDKWNTQLKSLYQTINNRVC

SEQ ID NO: 1714 - protein, 478 aa, Salmonella enterica subsp. enterica
MTNMRLCPVVMAGGIGSRLWPLSRELYPKQFLCLQAKTTMLQATINRLDGLRCQEPIVICNEQHRFIVAEQLREINKLAGNIILEPFGRNTAPAIALATIAMRNNSVDHDPLLLILAADHIIQNEEAFRDAVRGAMSYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 1715 - protein, 840 aa, Vibrio vulnificus YJ016
MFIHCHPCTMYRRWIRTKSEISVMKPTQQKQFDKVSFQESVKKHLSATYAHTLENADSRAWYLAMGRALAELTTFDLLATETDKKIVEAKSVNYLSLEFLIGRLTGNNLISMGLYEQITEAMAELGQNLTDLLEEERDPSLGNGGLGRLAACFMDSLAAQEFPTVGYGLHYEYGLFKQSFEAGRQKEAPDAWRGVEGYPWEVARPELAQEIGFYGHVEVINEGGKERRQWVPGMHVKAMPWDLPIVGYESDTVYPLRLWECQAIAPFSLESFNNGNYFEAQHALIDAGNITKVLYPNDNHEKGKTLRLMQQYFHSAASVRDILRRHEAAGHTLASLPNFETIQLNDTHPTIAIPELMRILIDEKGLNWDEAWAICSKTFAYTNHTLLPEALETWSESLIQHLLPRHMEIIYEINHRFLQEVRAKWPGDVAKQQKLSIIQEGFHRMVRMANLCVIGSYAVNGVAALHSELVKRDLFPEFDELYPTRLQNVTNGVTPRRWLKFCNPGLSALISEKIGTDWPAHLEQLEGVAKFADDAKFQKEYMAVKKANKERLANWVKENMNIDLDTNAIFDVQIKRLHEYKRQHLNMLHILSLYHRLLNDANFDMAPRVVFFAAKAAPGYHLAKEIIFALNKIAEKINNDPRIGNKLKVVFIPDYRVSMAEIIIPAADVSEQISTAGKEASGTGNMKMALNGALTIGTMDGANVEIREEVGDDNIYIFGLEVDGVEALKAKGYNPFDYYNADPLLKASMDLLLGEEFTPGQPGLLRATFDSLLDGGDPYLCLADFASYVKAHEAMDKQYRDQAGWAKKAILNTALVGKFSSDRSIRDYVNNIWKLEAVHR

SEQ ID NO: 1716 - protein, 318 aa, Brassica napus
  misc_feature (235)..(235): Xaa can be any naturally occurring amino acid
  unsure (1)..(318): unsure at all Xaa locations
MDVVKIDYNYKGDNALKELERITSKAAEVQDNILCGILEQNKDTQYLSKYMKGSKDVLEFKRSVPIITYKDVCPYIQRIANGEDSSLITGHPITEILCSSGTSGGEPKLMPTISEDLDRRTFVYNLINPIANKYLEGLDKGKTMYLNFVKAETSTPCGLPIRTVLTSYYKSKHFQCRPYDPFNDLTSPIQTILCEDSNQSMYCQLLAALIHRHKVMRLGAVFASAFLRAISYLEXKWSQLCQDIRTGHLSPMITDPGCQTAMTSLLGSPNPDLADEVEEICGRPSWKGILCQLWPQAKFIEAVVTGSMAQYIPALEFF

SEQ ID NO: 1717 - protein, 430 aa, Yersinia pestis biovar Medievalis str. 91001
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 1718 - protein, 467 aa, Yersinia pestis CO92
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 1719 - protein, 306 aa, Burkholderia sp. 383
MNAPTSSDTPDSGDAHIARNRLEAHLDAAPRAWPLDIVAATGSTNADVATRLKALPRNANALPAPLVRVAFEQTAGRGRQGRPWFAQPGNALLCSVGCIVPRPVDALGGLSIAIGVALAEGLAALPLDARSRVALKWPNDLLLTATDDGTPRIVGKLAGILIETAWASADATAVVIGFGINVRGAEAVAAQVDALRAREATLASGLPPAALSIACASANLTDTLAASLNALTPALAQFGAEGLAPFLPRWHALHAYAGREVVLLEQGVERARGIATGIDATGQLLLDTPDGMQAIAAGDVSLREAQ

SEQ ID NO: 1720 - protein, 282 aa, Streptococcus pyogenes MGAS315
MAMIQWFPGHMSKARRQVQENVKHVDFVTILVDARLPLSSQNPMLTKIVGDKPKLMILNKADLADATRTKEWKAYYESQGIKTLAINSKEQSTVKKVTEAAKELIADKIKRLRDRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTHYPSRLTKRFKNIPLEEEAPEIIMTLTRQLGFKDDYDRFYSLFVKEVRDGKLGQYTLDQVGDMDAD

SEQ ID NO: 1721 - protein, 589 aa, Ustilago maydis 521
MATLPAMDKRTFWFRDAIVYQIWPASYKDSNNDGIGDIQGIISTLDYVESLGVNTIWLSPMYESPQVDMGYDISDYQNVYAPYGTLQDMDELIRECHAREIKLILDLVINHTSDQHAWFQESKKSKVSPKRDWYIWRPAKYDARTGERRPPNNWRGALNQSAWTWDEATQEYYLHLFTPQQPDLNWSNVECRRTLYSDTIEFWLKRGINGFRVDTVNLYSKPMDFPDAPITDPNAEWQMGDTVFCNGPRMHEYLQEMGVIFAKYDAMTVGELPSTPKIEDVLRYISAERNELSQVFQFDISTLGRDENDFYATHPFSLQELKEVVEKWQRYVEGTDAWPTVFLENHDLPRAISKYASDRPEFIAASGKMLALMEIGLTGTLYIYQGQEIGMTNVPKAWAHEEYKDVIAVNYYRDAVTRSGGDEKVLKKTLEDINKQGRDSARTPVQWSSEPNGGFSTDPNTVPWMRTNDNYTSINVAAQEKDDQSVLAFYRKGLALRKEYACLLARGEFRLLDRENQQVLKYLKIPEGGQEDDNGQRVFVVLNFSNCPQEYTVPEEAGGNKASMLVETLEKGEPGKLRPWEGRMYLYRP

SEQ ID NO: 1722 - protein, 357 aa, Rubrivivax gelatinosus PM1
MPKMKAAVFVEPGRIVLEDKPIPDIGPLDALVRITTTTICGTDVHILKGEYPVARGLTVGHEPVGVIEKLGSAVEGYEEGQRVVAGAITPSGWSNACLCGACSQDGAGTAHGWKPMGGWRFGNTIDGCQAEYVRVPDAMANLARVPDGLTDEQVLMCPDIMSTGFGGAESAGIRIGDIVAVFAQGPIGLCATAGAKLCGASVVIGVDRLPERLAMARRMGADHVIDASRVDPVEEIARLTGGRGVDVAIEALGTQQTFESCLRVLRPGGTLSSLGVYSTDLKIPLGAFAAGLGDHKIVTTLCPGGKERMRRLMSVIERGRIDLGAMVTHRYRLDDIETAYELFGQQRDGVLKIAITP

SEQ ID NO: 1723 - protein, 503 aa, Bradyrhizobium japonicum USDA 110
MPSLIDLMLEGRPVQQHSPWPRATVDASVWTFAASELAHGRWSLLGLWGEPSTVHMAIMDGHTAEVATVSLDCPDRTYPSVGKHHPPALRLERAINDLFGLSAEGLPDTRPWFDHDCWAVRFPLGNRINALSKASPYHFLPVEADGLHQVAVGPVHAGIIEPGHFRFTASGETVARLEQRLGYTHKGIEGLMTGANLERAVQLAGRVSGDSTVAYAFAFSRAAEAALQLVVPDRAAWLRALLAELERLANHLGDIGAICNDASFTLMHALCGVLRESILRASDTAFGHRLMRDIIVPGGVTRDLTEEGREIIRTTLHTIRLRFPALVELYDNTASLQDRTVDTGVLKAALARQYAVGGYVGRASGRSFDARRTLVYAPYDALRFDVPVLNEGDVNARVWIRVREVEQSLLLIDQILDRLPDGPLGTHAGHRREAREGMAIVEGFRGDVLVWLRLRDGKVERCHLRDPSWFQWPLLEAAIEGNIIADFPLCNKSFNCSYSGHDL

SEQ ID NO: 1724 - protein, 252 aa, Rhodospirillum rubrum ATCC 11170
MTVRRPLIAGNWKMNGLKAEGQGLARDLAQRLNKAGGVDFDLLLCPPFPLISTVVGAVAGSGIAVGGQDCHAKAKGAHTGDVSAPMLADLGCQFVIVGHSERRADHGETDALVKAKAEAALAAGLIAVICVGETEAQRDAGETLAVVSGQLAGSLPTHADSGKVVIAYEPVWAIGTGRVPTTEDVAKVHGALRKDLVGALGADGNGVRLLYGGSVKPDNAAELMALENVDGALVGGASLKAEDFWAIAQSCA

SEQ ID NO: 1725 - protein, 254 aa, Actinobacillus pleuropneumoniae serovar 1 str. 4074
MSKLNQSQIQTALLCGQALVFDEIDSTNEYLLKHYQTLPQGSVCLAEQQTAGRGRRGRTWYSPQSENVYFSILWHYPTEDAAHISSLSLVVSLIIAESLQAQQVENIQIKWPNDIYYCGKKMGGILIETKADRSGIHLVIGIGLNLGMTKVDEKIVTQAWSDLSDYQFDRNALVCRLAYELQKNLKIYPLVGFEHYAERWQTFDIFRDQPVKLVTEGNEIHGISRGINQQGELLLEQNGTITPFGIGEMSLRAE

SEQ ID NO: 1726 - protein, 337 aa, Schizophyllum commune
MAVKVGINGFGRIGRIVLRNALQLGNIEVVAINDPFIALDYMVYMFKYDTVHGRYKGTVEVKDGKLVVDGHAITVFAEKNPADIKWGSAGADYIVESTGVFTTVEKASLHLQGGAKKVVISAPSADAPMFVVGVNLDKYDSKYQVISNASCTTNCLAPLAKVIHDKYGIAEGLMTTVHATTATQKTVDGPSHKDWRGGRSVNNNIIPSSTGAAKAVGKVIPSLNGRLTGLAFRVPTLDVSVVDLVVRLEKEASYDEIVATVKEASEGPLKGILGFTDESVVSTDFTGANESSIFDSKAGIAISKSFVKLIAWYDNEWGYSRRVCDLLVYAAKQDGAL

SEQ ID NO: 1727 - protein, 483 aa, Streptococcus thermophilus CNRZ1066
MIVSTYYPKIFYCDKLILLHLLEESMKNHNYENEGQFQRKMTSRHLFMLSLGGVIGTGLFLSSGYTIAQAGPLGAILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAILVFIILGLGAMFGLVRFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 1728 - protein, 560 aa, Oryza sativa (japonica cultivar-group)
MSATMDAVMPGAAGAHNATAAAAAGRRGGGIVAGMMALPEVQTVELLVAVSIFVAIHSLRQRRSQGLPSWPLVGMLPSLLLGLRGDMYEWLTGVLASRGGTFTFHGPWLTNLHCVVTSDPRNLEHMLKTKFGSFPKGPYFRDTVRDLLGDGIFGADDEVWRRQRKAASLEFHSAEFRALTASSLVELVHRRLLRVLGDAEEAGDAVDLQDVLLRLTFDNVCMIAFGVDPGCLRPGLPEIPFAKAFEDATEATIVRFVTPTAVWRAMRALGVGHERVLQRSLAGVDRFAYDVIRQRKEEVAAGGGGGGGGRSDLLTIFTKMRDADTGAAAYSDKFLRDICVNFILAGRDTSSVALAWFFWLLNKNPAVEAKILEEIDDIVAARRSSPPAPAVAANGADEDDLVFHPEEVKKMEYLHAALSEALRLYPSVPVDHKEVVEDEVFPDGTVLKKGTKVIYAMYTMGRMESIWGEDCREYKPERWLRDGRFMGESAYKFTAFNGGPRLCLGKDFAYYQMKFAAASILRRYHVRVVDGHPVAPKMALTMYMKHGLKVKLTKRDKSKL

SEQ ID NO: 1729 - protein, 616 aa, Xanthomonas campestris pv. campestris str. ATCC 33913
MSQPAESSELINVVTLLGAAVVAIPLFRRLGLGSVLGYLAAGLAIGPFGFGLFDDPQAILHVAELGVVMFLFVIGLEMRPSHLWSLRSEIFGLGTVQICVCALVLTGIGILLGFAPPVAFVAASGFVLTSTAVVMQLLAERGDVALPSGQKIVAILLFEDLLIVPLLAIVAWMGASGDPQAASQRWQGIGIGLACIVGLLVAGRWLLNPLFRILAASKAREVMTAAALLVVLGAALLMQVGGLSMAMGAFLAGVLLSESTFRHQIEADIEPFRGILLGLFFLGVGMSLDLRVVAADWRLILVGVLALMVGKAVCIYAVARLMRSDHRQALDRGVLMAQGGEFAFVLFAAASASGVIDAQVNASLTAIVVLSMALTPLFVLLQRRLTPAAAVSLDGVEEASGQTGSVLIIGFGRFGQVASQSLLARDVDVTIIDNDIEMIQSAEEFGFKIYYGDGTRLDVLHASGAHTARAIAVCVDNREAANRIVELATREFPHAKLLVRSFDREHALELIAAGVDYQIRETFESAVAFGEVALVELGVDEDEARTIAREIRRRDAERLELEIAAGNVRAGAGLMYGNIMPTVPKPTPFTPPKRESRTLNRDALPQELREETAERD

SEQ ID NO: 1730 - protein, 166 aa, Glycine max
MIEKEWQKNMFQGINRGIFGIPATKKSEIERLVKQIESLNPTPCPTLELEKVAGCWRLVYSTISILGSKRTKLGLRDFISLDDFFQTIDISKSKAVNVIKFSAMGLSLLSGQLNIEASFRIASSTRVDINFENSTITPDRLMNVFRKNYDLLLGIFNPEGWLEITP

SEQ ID NO: 1731 - protein, 351 aa, Mycobacterium sp. MCS
MHAMVYHGPGRRSWEQVPDPEVQRATDAIVRVDAVTICGTDLHILKGDVPEVQPGRILGHEAVGTVIEIGSAVEKLAVGDRVLVSCISACGSCRYCRDGQYGQCLGGGGWILGHLIDGTQAEYVRVPFADNSTHKVPAGVSDEQMVMLADILPTSYEVGVLSAAVRPGDTVAIVGAGPIGLAAVLTAKLFSPSHIVVIDIAESRLEAAKNMGADVVVNSTSQDARSVLDELTDGLGADVAMEAVGMPETFEQAVRLVRAGGHVANIGVHGKPATLHLEDIWIKNLTITTGLVDTHSTPSLISLVANHQIDTAAMITHHFGMEEFDLAYDVFSRAGETGALKVLLTRTAHSG

SEQ ID NO: 1732 - protein, 339 aa, Acidovorax sp. JS42
MTERISLTRYLVEQQRVHGRIPPQLRLLVEVVARACKRISFAVNKGDLGDVMGTAGTENVQGEVQKKLDIIANEVLIEANEWGGHLAAMASEEMDGIYVVPNRFPQGEHLLMFDPLDGSSNIDVNVSIGTIFSVLHKHHDDPTTDEPVTEADFLQPGHQQVAAGYCIYGPQTTLVLTVGDGVAMFTLDREQGSFVLTRENIRIPEDTKEFAINMSNMRHWDAPVRRYIDECLQGKEGPRGKDFNMRWIASMVADVHRILMRGGIFMYPWDKREPNKPGKLRLMYEANPMGWLVEQAGGAATNGRQRILDIQPAQLHERVSVILGSKNEVDRVTSYHSGI

SEQ ID NO: 1733 - protein, 178 aa, Triticum aestivum
  misc_feature (100)..(100): Xaa can be any naturally occurring amino acid
  misc_feature (133)..(133): Xaa can be any naturally occurring amino acid
  misc_feature (171)..(171): Xaa can be any naturally occurring amino acid
  unsure (1)..(178): unsure at all Xaa locations
MPPPVMASSATSVAPFQGLKSPAGLPVSRRSNGVSLGSVSNGGRIRCMQVWPIEGIKKFETLSYLPPLSTEALLKQVDYLIRSKWVPCLEFSKVGFIFRXEHNACRGYYDGRYWTMWKLPMFGCTPHTQVINXEVGEVKKEYPDAYVRIIGLDNMRQVQCVSFIAFKPPGXCEESGKA

SEQ ID NO: 1734 - protein, 260 aa, Zea mays
MPQGDHIELHQKRHGKRLDHEERKRKREAREVHRRSKDARNLIGAKGKRFAKKRYAEKAQMKKTLKMHDESNKRQKVDDDVQEGALPPYLLDRDQTQRAKVLSNTIKQKRKEKAGKWDVPLPKVRPVAEEEMFKVLRTGKRKTKQWKRMVTKATFVGAGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 1735 - protein, 474 aa, Bacillus anthracis str. 'Ames Ancestor'
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 1736 - protein, 405 aa, Shigella flexneri 2a str. 301
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 1737 - protein, 592 aa, Xanthomonas oryzae pv. oryzae KACC10331
MLNLRIGWRRGSGAFRHSFRCPVPGGEREPARLTWMPVSEDLGTVRCEVARVEMAGVSRYRQAELHTVRIVSVGSAVRLERWLRSWGGAGLRRGPCPGRCRDVSITAWHKARPLARMGAISYPDQFAHSSGAVPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAVLCVLLLLSLNLVKVKLFGEMEFWFALIKIIAIAALIMTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPNGFAKLSRASVPARGLLFSCLCLLLGAMLVYLIPNLVTAFTLVTTLSAVLFMFVWSLILCAYIAYRRKCPEQHAVSAFKMPGGVLMCYVCLSFFAFVIVLLMLQDDTRQALLASPVWFLLLAIGYAVKRRQNRQR

SEQ ID NO: 1738 - protein, 492 aa, Sulfolobus solfataricus P2
MPMTFVFITVGFSITIFFSLVSIITLVAFICSVFIPILSIFFRSEGFIFAITCFIEEEVNLIVCGYDISQMNYFLKILGGGREVGRSAIEVGNSDGSIILDYGVNFDEKDNPNFPLQEMPGKVKGFVVSHAHLDHIGALPIYQIGSLNTKVYGTVATRIITETMLKDFLKLSGAKIPYEWVEVRKTMDNFMAIGYGEEVEIDSLKVSLYNAGHIPGSSIIKVSSEKGVIAFTGDINLTETKLMKPAEIENIGDANVLVMESTYGKFNHPNRKDVENDFYDKVMEVVESGGTVLVPAFSLARSQEVLSVLAERNFPYPVYYDGMSREITEIMLGFKEFLNRPDLLKKAYDNFNYVKGWEDRHRAWKEKGVIVASAGMLKGGPAVYYFKKLSENSKNAVFLVSYQAINTPGRKLLEMGKFDEYSGLLKARLEIFDFSSHAGRRQLLEIVKSVKDLEKVVLVHGSPDNESSLADLIKQEIGVEVITPENGQEISL

SEQ ID NO: 1739 - protein, 287 aa, Yersinia pestis KIM
MGRSWFIRLLIKLFTLISGDRVMKTTTMSQLRQWKQEKRKFATLTAYDASFAQLFAEQGIQVLLVGDSLGMTLQGFDSTLPVTVADMAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 1740 - protein, 226 aa, Glycine max
CIWHYHNSRCNHARLKKNTLKKDIVLSKVEENLCPDLFCYFKSSVNTMLPIKQDLWLHNWDHGIDRTFEVAQKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALAFRAKSNSLAQLGKYTGEGESEEAKKELFVKSYSY

SEQ ID NO: 1741 - protein, 426 aa, Pyrococcus abyssi GE5
MSKVEYWVKVPFGPIHPGLEEPEKFILTLDGERIVNVDVKLGYNLRGIQWIAFRRNYVQLMYVAERICGICSFSHNHTYVRAVEEMAGIEVPERAEYIRVIIGELERIHSHLLNLGVLGHDIGYDTVLHLTWLAREKVMDVLEAITGNRVNYSMMTIGGVRRDIEEKHRRLLLDMIKYYREIMPQIEDVFLHDSTIEARLRNCAIIPKKLAIEMGAVGPTGRGSGVRDDARWSEKLGVYPDLGIKPIMPEDVTGEKARGDVYDRAAVRIGEIWQSLELIEHALDQIPKGKIKTFPKDNVLVAKLKLLGDGEGIGRYEAPRGELVHYVKGKKGRDGPVRWKMREPTFPNLFAIAKGLEGNQLADVVVAIASIDPCLSCTDRVAVITGDKKVILTEKDLLKLSIQKTREINPEIRGDPTPAGVGCVRG

SEQ ID NO: 1742 - protein, 474 aa, Brucella suis 1330
MREMLMRPVVLAGGKGTRLWPMSRSQRPKQFLALTGELSLFQMTLKRLSDPNRYSSPIIITNADYRFLVAEQALECGVELSDVILEPMARNTAPAIAAAALIASKDEQTLIHVVASDHNIEINDAYFQAVDTACNAARMGRLATFGITPTEPATGFGYIEAGELEESGACAIKRFVEKPKEEVAREMLAAGGFYWNSGMFLFRSDVFLDECRRYAPAVYEAAEASVATAQRDLDFVRLNSAEFEKAPDISVDYAIFEKTKLASVVPSPIHWSDLGSWDAVWKESKQDPSGNVARGPVSLHNTNNSLVLSEGVHVAVNGVDDLTIVASEDALYVGKLSEAQGVGTIVKALMKQPATAKLAEEHRTIYRPWGGYTHLLSGDRFQVKRLFIKPGKQLSLQKHHHRSEHWVVVRGVAEIVIDDKSLFLSENESTYISQGAIHRVSNPGKILLELIEVQTGAYLGEDDIVRFEDDFGRV

SEQ ID NO: 1743 - protein, 310 aa, Triticum aestivum
  misc_feature (148)..(148): Xaa can be any naturally occurring amino acid
  misc_feature (150)..(150): Xaa can be any naturally occurring amino acid
  misc_feature (249)..(249): Xaa can be any naturally occurring amino acid
  misc_feature (298)..(298): Xaa can be any naturally occurring amino acid
  unsure (1)..(310): unsure at all Xaa locations
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIXKXASERGAKRIRLHILTDGRDVLDGSSVGFVETIEKDLAQLREQGVDARIASGGGRMYVTMDRYENDWSVVKRGWDAQVLGEAPHKFQNALEAVKTLRAEXRANDQYLPPFVIVDESGKSVGPIVDGDAVVTFNFRADRMVMLAKALDFXDFDNLDRVRVQK

SEQ ID NO: 1744 - protein, 373 aa, Acidovorax sp. JS42
MTTPLTPAPISPVQDIVAELRAGRIVILVDEEDRENEGDLVIAADHVTPEAINFMARFGRGLICLTLTRERCERLRLPPMVARNGTKMGTAFTVSIEAAEGVTTGISAADRARTVQAAVAANAQAADLVQPGHIFPLQAVDGGVLMRAGHTEAGCDLAAMAGCSPSAVICEVMKDDGTMARLPDLQLFAAEHGIKIGTIADLIEYRSRTESLVHKVASRQITTAFGEFIMHAFRDEPSQAVHLALVKGQWDTAESVPVRVHEPLSVLDLLEVGRGMHSWSLDASLQYIHHHGQGVAVLLNCGESAEQLLEQFEGTARAAQAPERGRMDLRTYGVGAQILREVGVAKMQLMGQPRRMPSMVGYGLEITGYIPKE

SEQ ID NO: 1745 - protein, 229 aa, Medicago truncatula
MPPKASASYSTGGSSVEGGAEREILVQHLLVKEDDPKLLVDLQQRVAAGEDLSDLAVEHSICPSKDEGGMLGWVRKGQMVPEFEEAAFSAPLNKIVRCKTQFGWHLLQVLSEREEPVLLDIQPDELHVKFQDPNFLEEAQLIDVREPEEVTTASLPGFTVLPLRQFGTWGPEINSKFDLQKDTYVLCHHGVRSLQVARWLQSQGFRKVYNISGGIHAYAVKVDPSVPTY

SEQ ID NO: 1746 - protein, 241 aa, Medicago truncatula
MSPYATTLYSTGSSAVEGGGEREVLVQHLLVKEDDEKLFLNLQKRLSAGEDLSDLAVDYSVCPSKEEGGRLGWVRKGQMVPEFEEAVFSAPLNKVVMCKTKFGWHLLQVLSEREESVFQDIQPDELHVKLQDPNFSKEAQLIDVREPEEVDKASLPGFMVLPLLQFGTWVPEINTKLDLQKNTYVLCHHGIRSLKVARWLQSQVDPSIPTYNRVKFGERTPSNILASHPFGTFNSYLRGKA

SEQ ID NO: 1747 - protein, 475 aa, Vibrio vulnificus YJ016
MNSLFRQQCYLLGEWRSAPQTMTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYTEFCEKLVEKVSALNVGNGFDQGVHLGPLINDAAVAKVVQHVEDAQSKGAHIECGQLPTAGSRLVQPLVLSGVTDEMLVAQEETFGPMAPLFVFDSEEEVLARANNTDFGLAAYFYTQSLSRAWRVSEALEAGIVGVNEGLISTTVAPFGGVKESGLGREGSFLGMDDYMESKYILMGL

SEQ ID NO: 1748 - protein, 394 aa, Acidovorax sp. JS42
MKFSTRAERIEPFYVMEVAKAAQALAREVAGTREPMIFLNIGEPDFTAPPLVVEAADRAVRSGVTQYTNALGLEALRERISGWYAERFGVDVPARRIVVTAGASAALQLACLALIDAGDEVLMPDPSYPCNRHFVSAAEGKAVLIPTTAEERFQLSAAKVEAAWGTKTRGVLLASPSNPTGTSIAPNELRRIHDVVRGKGGLTIIDEIYLGLSYDDAFGQTALALGEDIISINSFSKYFNMTGWRLGWMVVPEAMVPVVERLAQNLFICASTVSQHAALACFEPDSIAEYERRRAEFKARRDYFIPALDALGLTVPVQPDGAFYAWADCTQAAERLGVAGSWDFAYELMRRAHLAITPGRDFGTADTQRFVRFSTANSMAQLQEAAARLQRLIG

SEQ ID NO: 1749 - protein, 521 aa, Zea mays
MVAGAGNPGRPVAVLALLLLAAAAPPGAWAGSAAVNGDRLRAEQIRKQASDAAASAAALAAASRRLHLDRARHLRLLSSLHRNLTNTLRALSVAADFASDPSSANVSSSRQLDLQAKDLIRAARAAIADSKPLFDPQLKIQRLKDTIFAQNELLARAKKRGAFASLIAAKSIPKPLHCLAVRLTAERIARPDQYADPVPPPPALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYAQYMNFSHPLIKAKFNPNACGWAYGMNFFDLDSWRREKCTEQYHYWQNQNENRTLWKLGTLPPGLITFYSTTKPLEKSWHVLGLGYNPSISMEEIRNAAVVHFNGNMKPWLDIGMNQFRHLWTKYVDYDDSYIRQCNFAPP

SEQ ID NO: 1750 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPHGNGQRACIGQQFALHEATLVLGMMLKHFDFEDHTNYELDIKETLTLKPEGFVVKAKSKKIPL

SEQ ID NO: 1751 - protein, 215 aa, Zea mays
MAGATTPASGALVRLCLPSLLLFLYRQSRSYFGAAFWGALYAVAVQAYKAARLVCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSTLCHFSIRAMCGLDSEKNCVHGSDSPESADREISFFFGEAESVTVEHDEL

SEQ ID NO: 1752 - protein, 346 aa, Polaromonas sp. JS666
MKAAVLRAPKVLQLSDIATPEAAPGELVLRVRAAMVCGTDLRILTGRKTKGVRFPSVIGHEFAGEVVQVGDGVTQFKTGDRVCMDPVIPCRACAYCKTGHENVCLHRQAMGYEFDGAFAEYIRIPAIALTAGNVFMMPAQMSFESAALAEPLACCINGQRNAGVQVGDTVVVLGAGPIGLMHAALARLSGARQVIVSEPNAARRQAAVDRGVEHMCDPSTESVMEFVKARTDGLGADVVILAIGVPQLANESLNLVRKGGHVNLFAGFSAGETSNIDVNLIHYNEIVVTGASALRRRDYELALNMLSAGQIDANSLITHRYEVADSLAAFDEAGSGRALKVAIHNV

SEQ ID NO: 1753 - protein, 290 aa, Streptococcus pyogenes MGAS315
MRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIKQFKNPDLPIKVVANLPYYITTPILMHLIESKIPFQEFVVMMQREVADRISAEPNTKAYGSLSIAVQYYMTAKVAFIVPRTVFVPAPNVDSAILKMMRRDQPLIEVKDEDFFFRVSRLSFVHRRKTLWNNLTSHFGKSEDIKAKLEKGLALADIKSSIRGEALSIQDFGKLADALKEVGL

SEQ ID NO: 1754 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 1755 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 1756 - protein, 342 aa, Triticum aestivum
  misc_feature (73)..(73): Xaa can be any naturally occurring amino acid
  misc_feature (86)..(86): Xaa can be any naturally occurring amino acid
  misc_feature (97)..(97): Xaa can be any naturally occurring amino acid
  misc_feature (112)..(112): Xaa can be any naturally occurring amino acid
  misc_feature (134)..(134): Xaa can be any naturally occurring amino acid
  misc_feature (220)..(220): Xaa can be any naturally occurring amino acid
  misc_feature (287)..(287): Xaa can be any naturally occurring amino acid
  misc_feature (301)..(301): Xaa can be any naturally occurring amino acid
  unsure (1)..(342): unsure at all Xaa locations
MGKIKIGINGFGRIGRLVARVALQSDDVELVAVNDPFITTEYMTYMFKYDTVHGHWKHSDIKLKDDKTLLFGXEKPVTVFGRQEPXEEIPWGEAGAXYVVESTGVFTDKDKXAAAHLKGGAKKVVISAPSKDAXPMFVVGVNEDKYTSDVNIVSNASCTTNCLAPLAKIINDNFGIIEGLMTTVHAITATQKTVDGPSSKDWRGGRAASFNIIPSSTGAXAKAVGKGLPELNGKLTGMSFRVPTVDVSVVDLTVRTEKAASYDDIKKAIKAASEGKLKGIMGYVEEXDWVSTDFVGDSRSXSIFDAKAGMLLNDISSARLWSTTGGTQPVCDRSAHARTVKV

SEQ ID NO: 1757 - protein, 243 aa, Prochlorococcus marinus str. MIT 9313
MRKPVIAGNWKMHMTCAQAREYTAMFLPLIEATPNDRHVVIAPPFTAISSMAESVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRRWVGASELIIQYGGSVKPGNIDELMAMSDIDGVLVGGASLDPESFARIANYQTS

SEQ ID NO: 1758 - protein, 106 aa, Arabidopsis thaliana
MFEIIQAVFSAGVALALLTFAGITLGGSVVACIISTPLLVIFSPVLVPATIATTLLASGFTASGSFGATAFTILSWLYKKRTGRDLPKIPGLTPPAPASNPAGSGV

SEQ ID NO: 1759 - protein, 284 aa, Pseudomonas syringae pv. phaseolicola 1448A
MVSHNLPHKDPFMSKTRIAFVGAGNMAASLIGGMRAQGVDAALICASAPGAETRERIANDHGIQVFADNAEAIKGADVVVLAVKPQMMKNVCQALKSSLEANQLIVSVAAGITCASLTQWLGDQPVVRCMPNTPSLLRQGASGLYATDKVTAEQREQAEQLLSAVGVAVWVEQEKHMDAVTAVSGSGPAYFFLMMEAMTAAGVKLGLPEDIAKKLTLQTALGSALIATGSDVGAGELRRRVTSPGGTTEAAIKAFQAGGFEALVETALTAADHRAAELAEQLGK

SEQ ID NO: 1760 - protein, 226 aa, Agrobacterium tumefaciens str. C58
MKIKAAEAALSHVQDGMRLGIGTGSTAEEFVRLLAEKVAAGLKVEGVPTSERTARLCVELGVPLKSLDELPELDLTIDGADEVDHVLRLVKGGGGALLREKIVAAASGRMIVIADQSKVVETLGAFPLPIEINPFGQVATRIAIEKLAARSGLSGELTMRSSGDGAFMTDGGHLILDASFGRIPDAEALARELNTIPGVVEHGLFINLASLAIIAGPEGARMMQAV

SEQ ID NO: 1761 - protein, 294 aa, Mycobacterium sp. MCS
MSGSTPRYGIVVGVDGSPESQVALRWAATEAQTSGRPVTLINVVTPIAISWPTIMLQEQISAYEKQNAEEVLGHARQTLLDGLGPGPQPAVHSEVLMAGIVEALVEASKDAHMVVVGARGRGAVRRVLLGSVSAGLIHHAHCPVAVIHSRDGRLPTADAPVVVGIDGSPASEAATALAFDEASRRGAELVAVHVWSDMAPIPGAATDRHQCEQRAEETLAERLAGWQERYPDVRTRRVVESDRPARWLVEHSADAQLVVLGSHGRGGFAGMLLGSVSAAVAQSVDVPVIVVRQQ

SEQ ID NO: 1762 - protein, 390 aa, Pseudomonas putida
  misc_feature (333)..(333): Xaa can be any naturally occurring amino acid
  unsure (1)..(390): unsure at all Xaa locations
QATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFXFVVFKLALEHQVLTQAVHDLLVLAITLSMAVVPLVMMALARQLHDDSPVQASPETGQ

SEQ ID NO: 1763 - protein, 149 aa, Arabidopsis thaliana
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 1764 - protein, 496 aa, Glycine max
MGKESSTCVLLSLLILSLFVAEIYGNRQVQALNKLHKSTKFRGNSQIDRSEFEVEELAYDGIVHSQEGLKEKDRIESLPGQPPVSFSHYGGYVTVDKEAGRAFYYYFVEAQRSKQTLPLLLWLNGGPGCSSLGYGAMQELGPFRVNSDGKTLHRNIFSWNKVANVLFLESPAGVGFSYSNKSKDYDTNGDKKTAADNYLFLVNWLERYPEYKERDFYIAGESYAGHYVPQFAHTILYHNKKANKKIINLKGILIGNAVINEETDSDGLYDYLASHAIISDKAAYLNKACDSSSSKIQESVCDAAGDELGEDIEYIDLYNIYAPLCKNANLTALPKRNTIVTDPCSENYVYAYLNRKDVQEALHANVTNLKHDWEPCSDVITKWVDQASTVLPLLHEFLNNSLRVWIFSGDTDGRVPITSTKYSVKKMNLPIKSVWHPWFSYGEVGGYVEVYKGGLTLATVREAGHQVPSYQPARALTLIKYFLDGTPLPGPPKRKD

SEQ ID NO: 1765 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 1766 - protein, 307 aa, Aspergillus oryzae
MPGLAFNPDNDIPDLSGKVIFITGGTAGLGAQSVAQMAKHSPARIYISGRNATSAEKIIKEIAETGSNTPVSFVECDLTSLDSVKRAADEIIAKESRLDVLMCNAGIMALPPGLTKDGYEVQFGTNHLGHALLIQKLLPLLQRTAERGADVRVIILTSKGYQLHPYGGIIFDDLKTTQDYGFLGSWRRYGQSKLANILYTRELARRYPAITVVSVHPGVITTGLVENLGWAHRWFIYATTYNQMVTLEEGAYNQLWAATTSKDGLETGQYYIPVGVASNDKLTKTGRDDVLAGQLWEWTDKALEDYL

SEQ ID NO: 1767 - protein, 380 aa, Lagenaria siceraria
MKKMALHSNKHRTQRLHNSLFFFDFLHCTEQQHLQTEHPIFLNNGGTNDFPLFQQTTTHFLVYEDEELNHLLSKEKDQNLQTGAVLKTLVQTDNALSLARTEAIDWLLKVNAFYGFSSLTALLAINYLDRILSGPYFQRDKPWMLQLAAVTCISLAAKVEEIRVPLLLDLQVEDSKYIFEAKTIQRMELLVLTALQWKMHPVAPVSFLGIITKGLGMKNQYIQREFLRRCERILLSLVSDSRSVGILPSIMAVSAMVSVVEEMGNCNPLEEFQDQLLNALKINKGRVKECCKVIMEAKIKGSGKRKHVEEEAEAEAESESSEAETEGEAEAEAGSPNGVMEANFSCESSNDSWEMGTIVSEYTHFSSSSSSSSKRIRPTR

SEQ ID NO: 1768 - protein, 251 aa, Desulfitobacterium hafniense DCB-2
MDDRVIEAIAAASIKDPEIPVVEIGPGLGVLTRVLAQKAQKVWAVELDRGKVNLLQRELQGLPVDILNMDALKLDLKDIWGTGKGVLVGNLPYYITSPLLMHFLEQKDSLASMVVMVQKEVADRLVAKPGGKDYGILSIAAQVSAQGEKLFEVPPQAFWPAPKVTSAVVRFELRSYPGFRVKEKDFFRVVKAAFSQRRKTLGNSLAGGLGLPKQQIGEILAAAGVDEQRRAETLSIDEFQAVTEAVMKNLD

SEQ ID NO: 1769 - protein, 1154 aa, Oryza sativa
MDLSRFTAPRPGLQIGAAGNGFRACSLRRLRYRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLELSVERLSSMKKYVFGLGSAQVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 1770 - protein, 312 aa, Ralstonia metallidurans CH34
MKKQPVVLVTGNDLAPQALELLKDFEVRFAGKSCTEDVLLALAKETDPVAIIVRYGRIGASIMDAAPSLKVISKHGSGIDVIDQKAAAERGIAVKAAVGANAAAVAEHAWALILACAKSVPHLNDRMREGYWDKSIHKSIELNGRTLGIVGLGEIGRRVAVTGVVLGMRVIAFDPYANAAPDGVELVNDLHDIYRNADVVSLHCPLTESNRGMLHRETLGLFKNGAILINTARGGLVDEPALAEALTNGMLYAAGLDSFAVEPMTAPHPLQQIPNAILTPHIGGVSDAAYVSMGVGAATNVLAVLGSVTADG

SEQ ID NO: 1771 - protein, 223 aa, Ralstonia eutropha JMP134
MPSLSHESDSITLAADADERPLALRIAQALDAMREGRPVVLLDDDDRENEADLILAAECLTPSNMAMMIRECSGIVCLCLTTDKVRQLGLRPMVENNRSQYGTAFTVSIEAREGVTTGVSAVDRITTIRAAIAKDAGTDAVVSPGHVFPLVAVDGGVLVRRGHTEGSVELARMAGLSPAAVLCELMNPDGTMARRPEALSFAEMYRLPILTIADLVAWREIHG

SEQ ID NO: 1772 - protein, 589 aa, Shewanella sp. MR-7
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTCVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTTVLMLLGRLRHHTWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASAAHQHDLAKLIDLSTKGKAELESLMRGDRENVS

SEQ ID NO: 1773 - protein, 476 aa, Idiomarina baltica OS145
MLRRTKIVTTLGPATDDPSVLKSLIQAGANVVRLNFSHGSADDHIKRAEMVRKLSAELKAHVAILGDLQGPKIRVARFKNDKVTLSQGEKFTLDAQYDSQSGDEHIVGLDYKELPHDVEPGDILLLDDGRIRLQVERIDGSAVHTLIVVGGQLSNNKGINRLGGGLSAKALTEKDLEDIKTAAQIGVDYLAVSFPRSGDDINEARQLLRAAGGNGVLCAKIERAEAVASEHALDEIIRASDAVMVARGDLGVEIGDAQLVGKQKLIISRARQLNKVVITATQMMESMIENPMPTRAEVMDVANAVLDGTDAVMLSAETAAGKHPVATVKAMAEICLGAETHPSAQLKHHDLEEHFSSISEAAAMSAMYAATHLTGVKAIIALTESGFTAKLMSRITSHLPIFSLSRHSGSRHKCALYRGVYPIQFDSTESKNPILDAIAVIKGLGHVAKGDLVVLTHGDVMETVGSSNTCKVIEVQ

SEQ ID NO: 1774 - protein, 219 aa, Sulfolobus solfataricus P2
MDFLSLRKDLESGIPILIYDFDGREEETDMVFYAGAISWKSIYTLRKEAGGLICYATAINEAKTLGLNFIAEELKQHETYSKLVKKPSYGDYPAFSVWVNHVNTKTGISDYDRYITISELHKIILKTKTNPEEARREFYENFMTPGHVPILIARDIRERRGHTELSITLLQKLGLERSAVIAEILDEKSSMNKDKAKMIAKNFGLHFIEGKDIFKEVII

SEQ ID NO: 1775 - protein, 257 aa, Anabaena variabilis ATCC 29413
MPVTTQQLIQWKQQGRSIVALTAWDYTIAQILDAAGVDLILVGDSMAVMLGYKTTLPITLEEMLHHAKAVCRGVQRALVVVDLPFLTYQESIPQAINSAGRILKETGAQAVKLEGGYPAMVETITRLVQAGIPVMGHVGLTPQSVHQLGLRQQGKTQETAQRILNEAIALEQAGVFSIVLEHIPADLAMQITQKLSIPTIGIGAGSHCDGQVLVTSDVLGLSERQPPFAKVYTNLRATITKAVQDYAAEVRDRQFPE

SEQ ID NO: 1776 - protein, 379 aa, Pseudomonas syringae pv. phaseolicola 1448A
MKAIVYGGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTNGKGTDRGCECVGYQCCDRHGHEANHVTMNNLVASTKATGGIGVVGVFVPQDPGAHNDLAKEGKMAFDFGSFWFKGQQIRTGQANVKAYNRRLAELIHHDRAKPSQIISHRLKLEEGPAAYQHFDARDEGWTKVVLKPSA

SEQ ID NO: 1777 - protein, 544 aa, Rubrivivax gelatinosus PM1
MHDLTLIVTLAGGLAFALLLGTLTRRLGLSTLVGYMLAGIVVGPNTPGFVADQSLASQLSEIGVILLMFGVGQHFHPQELLRVWRLAVPGAVAQSLVAGVAGWAAARAFGWSHAAGAVFGMSLAVASTVVLMRMLVERDRLSSRDGHVAVGWLIVEDLFTVAALVVLPVLASDSSDAQSLGSALLLAMGKVAAFVAIVMLVGTRVVGRLLERVAGARSAELFTLTVFVVALGVAVLASELFHVSVALGAFFAGLVVGQSRFGPQAAADMAPFRDVFTALFFVSVGMLFNPNLVVQQPALVLTALGVVLLLKPLVAVVIVLLLRSDWRTAATVGVGLAQIGEFSFILASLGLSLGVIPKEALDVLVVAAIVSIALNPVLFRLVERWLPKEHGSAPEEEVPLASTYAPDAPGAAVVLAGYRSLGRRVVQRCAAAGIPLCVVQHEAIEALEGLPPGVAQIYGDPGRPDVLAAAGLGQAHMLVVADMPLVEKMQVCRAARQLNPRVEIVGAAMNDAEAAWLRDFGAEFVVDALDEQTEQITRAIRARL

SEQ ID NO: 1778 - protein, 350 aa, Thermoanaerobacter tengcongensis MB4
MSIMDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 1779 - protein, 452 aa, Anabaena variabilis ATCC 29413
MSRHTDYSSLEQIQTTGAAAPKPLLTLSDAVALIVGIVIGAGIFQTPALVASQAGSDIAVLLLWLAGGLVSIVGALCYAELATTYPNVGGVYYYLKRAFGQKIAFLFAWARLTVIQTGSIALLAFVFGDYASEILRLGTFSSSVYATVVIVLLTILNIVGLQQGKWTQNLLTVAKVLGLLLVVVFGLGATANSVAPIESTPPGSWGLAMVFVLLSYGGWNEAAYISAEIQNRQRNIVRSLVWSIGIITAIYLLINLAYLRGLGLANMADSSAVAADLMRTIWGTPGALFISVLIAICTLGAINATIFTGARTNYALGQDFTLFGFMGSWRQLPSTPGTALLVQGAIALALVLLGTFTRKGFETMVDYTAPVFWFFFLLSGISLLILRRKEPHILRPFRVPFYPVTPLLFCAVCGYLLYSSVVYTNVGAVVGVLVVIAGIPILFWNRYRQGKA

SEQ ID NO: 1780 - protein, 292 aa, Exiguobacterium sibiricum 255-15
MKDIATLHRTKEILAKHGFSFKKSLGQNFLIDLNVLGNIVGAANLTPDSGVLEIGPGIGSLTEQSAKQAKKVVALEIDQRLLPILEDSLAPYPHVKVIHGDALELDLETIVDEEFTQQGITDLAVVANLPYYVTTPIIMRILEARTPFRTLIMMIQKEVAERIGAQPGTKAYGSLSIAIQYYAEAEVCFTVPKQVFIPAPNVDSAVIRLNIRKEPAVKTLDEKLFFEVTRASFAQRRKTILNNLSSHFGKAEKEAVEAALHEAGIDPRRRGETLSLQEFAQLADALLPIKKR

SEQ ID NO: 1781 - protein, 148 aa, Solanum tuberosum
MASKRILKELKDLQKDPPTSCSAGPVAEDMFHWQATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 1782 - protein, 214 aa, Medicago truncatula
MDAAGEIFRSNLTELMEESPSGAGELHVLAVDDSLVDRKVIERLLKISSCKVTVVESARRALQFLGLDGENSDVAFDAVKVNLIMTDYSMPGMTGYELLKKIKESSVFREIPVVIMSSENVLTRIDRCLEEGAEDFLLKPVKLSDVRRLKDFIMRGEVKDGEKCSLKRMRSSDDCSPCPSLSTTFSPMRHSCDPPSSVFSPLSPSTLSSKKSRL

SEQ ID NO: 1783 - protein, 175 aa, Glycine max
LHEGRTCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 1784 - protein, 256 aa, Agrobacterium tumefaciens str. C58
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 1785 - protein, 1127 aa, Aspergillus nidulans FGSC A4
MSPTAIETVPTGKNNWWKEATIYQVYPASFKDSNGDGWGDIPGVIEKVPYLHSLGVDVVWLSPMYDSPMLDMGYDVSDYENVLPAYGTVVDVEKLVEECHKYGMRLILDLVINHTSDQHKWFLESRSSKDNPKRDWAIGCLRATIGGILQGVHVRSLFPTAGHALIRTGTWDEHTQEYYLHLYAKEQPDLNWDNLETRKAIYDSAVRFWLDRGVDGFRVDTVNKYSKYTDFPDAPITDPKSYIQPAIGMWCNGPRIHEFIREMYDEALEPYGDVVTVGELANTPDPAHVLRYVGASAKQLSMVFHLDIGHIGMGSLEDKYVLQPWKLTEMKSIVAKWQTFIEGTDGWTTAFCENHDNGRSVSRFASDAPEHRERSAKMLALMMVAMTGTLFLYQGQEIGMINAPRDWPIDEYKDIEGLGYYREAQAQVASGVDPMREERIMDGLRVLARDHSRLPMQWDDSPEAGFTTGVPWMRTHDLYREINVKKQEGDPDSVLSFWKKVLLLRKRYRHLFIHGAFEVLDFDNLDTFCFIKSRGEERALVVLNFSAGEQPFTQAEMAADMELLVGNYAEAELFPHPCAGISYYSDRWILVTRFIAEGLAFALLHCNRFSLTSIFPCDACRRRKVKCDGQQPCGRCRDAEISCRTTSVRRKKGRQGATATVLHELRKAPAPVAQVQSVPSPQPTVISDPFIRQPGLLHPSVVQSCAEYFFPRMLGTVPILVPTTFQDHVARIEESLHSYCLVTAFCAFVFAQTGYVSWLNAGNQSASLGRLLLDEAMAARRHLDLFSASTRQGITISFLLYGCQIGMGNQRQAYYFLREATTLYTAGMLDPADADDEDAGNLFWLLLISERAHAIRRHRPITLQVTRDSPILCDTRSDAFSLGFRCLAELYRPFDQTFLSRWNGTDSSATTEQLIQLEDHLLQAVPADVELPDIVLADLRVSQQWLRTMIWQLATSAGFLSSTPSRPCLGFAYPLQIARDLSLATWKLSKESLETHGIGLAEKIFEITCTLTDVMACMTSAGLRSSSFDLGPQDYLKHLCTLIHSLPGGETKFLPLLLAKISQTLPSMLTPVTRHLSLPSCMAEQVSVSPNVGIGSPVSHRDDWSKALNWAEMSRIGDRTPEARRGA

SEQ ID NO: 1786 - protein, 68 aa, Musa acuminata
  misc_feature (17)..(17): Xaa can be any naturally occurring amino acid
  misc_feature (37)..(37): Xaa can be any naturally occurring amino acid
  unsure (1)..(68): unsure at all Xaa locations
FAPFPKGCFFTTSGGLXSFEHPLNELKAMPRVDSQGXVCGATYKVDDQAKKETRMPRVDSAANWSSEY

SEQ ID NO: 1787 - protein, 503 aa, Silicibacter pomeroyi DSS-3
MGGPTNSRRRHAMLDAATDLKSLLKTPDLLATKAYIGGQWVDGDNGTFAVTNPARGDVIAEVADLSRAQVAGAIAQAEAAQKEWAKYTGKERAVILRRWYDLMMEHAQDLGRILTAEQGKPLAEAVGEVAYGASFIEFFAEEAKRIYGETIPGHQRDKRITVLKQPIGVAASITPWNFPNAMITRKAGPALAAGCAFVARPAAETPLSALVLAVLAEKAGIPAGVFNVVPSSRSSEIGKEFCENPGVRKLTFTGSTEVGRILLKQAADQVMKCSMELGGNAPFIVFDDADLDAAVEGAMLCKFRNNGQTCVCANRIYVQAGVYDAFAEKLAAAVAKLNVGDGLSDGVTTGPLINAEAVEKVLEHLGDVTAKGGAVLTGGKPHALGGTFFEPTVVTGVTQEMKVAKEETFGPLAPLFKFDDVDEVIAMANDTIFGLAAYFYAKDLSRVYKVAEALEYGIVGVNTGIISTEVAPFGGIKQSGLGREGSHHGIEDYLEMKYICMSV

SEQ ID NO: 1788 - protein, 483 aa, Pseudomonas syringae pv. syringae B728a
MTVRRTKIVATLGPASNSPEVIEQLILSGLDVARLNFSHGTPDEHKARARLIREIAARHGRFVALLGDLQGPKIRIAKFTDKRIELKVGDKFTFSTAHPLTSGNQQIVGIDYPDLVKDCGVGDELLLDDGRVVMRVDTQTADELHCTVLIGGPLSDHKGINRRGGGLTAPALTEKDKQDIKLAAEMDLDYLAVSFPRDAADMEYARQLRDESGGTAWLVAKIERAEAVANDEVLDELIRASDAVMVARGDLGVEIGDAELVGVQKRIILHARRHNKAVIVATQMMESMISSPMPTRAEVSDVANAVLDYTDAVMLSAESAAGSYPIEAVQAMARICIGAEKHPTGKTSSHRIGHSFTRCDESIALAAMYTANHFPGVKAIIALTESGYTPLIMSRIRSSVPIYAFSPHRGTQARAAMFRGVYTVPFDPAALPPGQVSQAAVDELLKRGLVEQGDWVILTKGDSYHTIGGTNGMKILHVGDPLV

SEQ ID NO: 1789 - protein, 455 aa, Streptomyces globisporus
MAVLAATSPLGGEPLTVFLLQVGLLLACAYGLGRLGTRIGLPPLVGELTAGVLLGPTLLGQISPGLSGRLFPEDISQAHLLDAFCQFGVLLLVAIAGAQFDPRILRKRGGLAARVSLAGLLIPLGLGIATGYLVPASLLADSGERGVFALFLGVAMCVTALPVIAKTLADLNLTHRNVGQLLIAAAVFDDAVGWLLLALVTALASGAAGGPVVLTTMAWTTVFVAAACAVGGPIGRRLSRTGDSRVPVSAVTVGVAVVVLYGALTAAAGMEALFGAFVAGATLLRHIAPVRLAPLRTLVMAVFAPVFLGSVGLRMDLTALAEPSVLLTGLGVLLVATFGKFAGAYVAARSGGMSRYEGLALGAGMNSRGMIEVVIALVGLRIGVLDTVTFTIIVLVALITSVTAPPILRWASSRIVLEEDETERGDRLAGWNTEPALSGGPAPKSAREEKTPDTS

SEQ ID NO: 1790 - protein, 125 aa, Oryza sativa (japonica cultivar-group)
MRQQRGRGVGRGDPGLLTRAVEKVFRLVRLAEFEILFVLFFLIAFVLFKDLMSRPEYNSIFVKKPDLDGRWPGLIIICLMLLAWFLGMGLDSSCLQAYRWNFVKCHAEVTANSPCLHHVAVQFYG

SEQ ID NO: 1791 - protein, 247 aa, Rubrivivax gelatinosus PM1
MTQLVLIRHGESTWNLENRFTGWTDVELTPTGVAQAQQAGRLLKQAGIDFDTVYTSVLKRAIWTAWHCLDGMDRTWLPVIKDWRLNERHYGGLQGLNKADMAKQFGDEQVLLWRRSYDVPPPPLEANDPRSERSDVRYAKLAANQVPLTECLKDTVARVLPLWYGTLAPAIAAGQRLVIVAHGNSIRALVKHLNNISDADIVGVNIPNGIPLVYDLDANLKPTSKYYLGGADAAAQAASVSALQADG

SEQ ID NO: 1792 - protein, 299 aa, Glycine max
MGEATERYAVVTGANKGIGLEIVRQLASAGIKVLLTARNEKKGLQALETLKDSGLSHLVLFHQVDVADATNVASLADFVKSKFGKLDILINNAGIGGVVIDDTDLITTAIMNRGAIPEDNGTKGITHTYELAEECLQINYYGAKKTTESLMPLLQLSDSPRIVNVSSTLGQLESLPKESWARGVFNDVDNLTEEIVDEILNKFLRDFKEGSLESKGWPKYLSAYIVSKAAMNAYTRILSKKYPSFCINSVCPGYVKTDMTANTGFLTVEEGAASPVRLALLPIGSPSGFFYYRSDVASF

SEQ ID NO: 1793 - protein, 160 aa, Petunia inflata
DKEKHRLQFCTSDKYEIFEGSIRSSLDHHWIQLRYDKEYGLEHQPLWHDQYKKHGTCCSNLYDQRAYFLLAMRLKDKFDLLGTLRTHGITPGRRYTFQSIHSAIKTVTQKDPDLKCVEHIKGVLELNEIGICFTPNADGPYDCPQSRSCQKRGYTGILFR

SEQ ID NO: 1794 - protein, 250 aa, Desulfotalea psychrophila LSv54
MSQIIRIAETASTNILAKEYARAGADHGSAIIAENQTAGRGRLGKQWQSIRGTGLYCSIIIRPQQLPRTEYHKLTLVTGLAVALSLEFLTAKSFQLKWPNDVYYKGVGKCAGILCESVLGTNPRSDYLIAGIGINVNTRQEEFDAEVAGRAGSLFSITGEELCIDHVFNSVYEQILAQVDEFFSGNFSSILSQWRQRDMLAGRKSCWLTMAGESVEGIAEGVSSSGQLYIRDASGERHEVLSGDVQLVRA

SEQ ID NO: 1795 - protein, 651 aa, Pyrococcus abyssi GE5
MSALIKRETQVDQILKDIRGIVNQMVPREAKITEIEFEGPELVIYVKNPEAIMKDGELIKDLAKVLKKRISIRPDPDVLLPPEEAEKLIFEIVPKEAEITNIAFDPSVGEVLIEAKKPGLVIGKNGETLRLITQKVKWAPKVVRTPPLQSQTIYSIRQILQSESKDRRKFLRQVGRNIYRKPEYKSRWIRITGLGGFREVGRSALLVQTDESYVLVDFGVNVAALNDPYKAFPHFDAPEFQYVLKEGLLDAIIITHAHLDHSGMLPYLFRYNLFDGPIYTTPPTRDLMVLLQKDFIEIQQSNGQDPLYRPRDIKEVIKHTITLDYGEVRDISPDIRLTLHNAGHILGSAIVHLHIGNGLHNIAITGDFKFIPTRLLEPANAKFPRLETLVMESTYGGANDIQMPREEAEKRLIEVIHQTLKRGGKVLIPAMAVGRAQEVMMVLEDYARIGAIDAPIYLDGMIWEATAIHTAYPEYLSRRLREQIFKEGYNPFLSEIFHPVANSKERQDIIDSNEPAIIIASSGMLVGGPSVEYFKQLAPDPRNSIIFVSYQAEGTLGRQVQSGVREIPMVGEEGRTEVIKVNMEVHTIDGFSGHADRRELMNYVAKVRPRPERVITVHGEPQKCLDLATSIHRKFGLSTRAPNNLDTIRLR

SEQ ID NO: 1796 - protein, 262 aa, Xanthomonas campestris pv. vesicatoria str. 85-10
MNSSFSAPAKKSLGQHFLADRYYIDRIVQAVDPRAGQHLVEIGPGQGAITFPLLRRHGALTVIEFDRDLIAPLTEVAAPIGALSIIHRDVLSVDFTALANGTPIRLVGNLPYNISSPILFHALDHAAAVADMHFMLQKEVVDRMAAGPGSKVYGRLSVMLQAYCEVTALFVVPPGAFRPPPKVDSAVVRLVPRDPATVQINDRRRFADVVRAGFGQRRKTLRNALSTICEPAHFDAAQVRPDARAEQLEVADFIRLANVELA

SEQ ID NO: 1797 - protein, 448 aa, Xanthomonas oryzae pv. oryzae KACC10331
MCRMPHATCAVLRRRRSGEVARAPNTHEFEPTHAWLCATAPSHVVTATSHCAAGNQPRAMLSSADSRFPIPAMRAAPDILSRVSRVIGCRHSVKECRRVSSLYFRSPRSCHRNYMSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVITIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGTLPWPLSFSYGRAMQQAALKLWAKDMTVNFAKAQQVIYERAKENGLAALGKWKG

SEQ ID NO: 1798 - protein, 262 aa, Bacillus cereus G9241
MPMIGLGVYKAKEGDEVKRAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTSAQVILRWDIQSGVVTIPKSVTPSRIQENFSIFDFSLTEEEMTQINTLNRNLHVGTNPDKYDTL

SEQ ID NO: 1799 - protein, 526 aa, Caulobacter crescentus CB15
MTAPRVLIADKLSPAAVEIFKNRGLAFDIKTGLSKDELIAVIGDYDGIAIRSGAKLDKDVIAAANKLRVIARAGIGVDNVDIPAATAKGIVVMNTPFGNSITTAEHAIAMMFALARQIPAADVSTQGGKWEKNRFMGVELYAKTLGLIGAGNIGGIVADRALGLKMKVVAYDPFLSPERAVEMGVEKVELDELLARADVITLHTPLTDKTRNILSAENLAKTKKGVMIVNCARGGLVDEAALRKLLDEGHVGGAAFDVFTVEPAKENPLFGSDKVVATPHLGASTNEAQENVALQVAEQVSDYLLTGAVTNALNSPSITAEEAPKLKPFVALAEKIGAFAGQMVDFGVKAIDIAYEGEVSNLNVKPMTSAALAGVLKPMLAEINMVSAPAIAKERGITVSESRQEVSPTYDSLMRVTITTEKGKRAFAGTVIAGAPRIVEVKGMELDAAFSPAMLYVNNLDKPGFIGALGMLLGEAGVNIATFNLGRVSADEDAIALVGVDQAPDAGLLAKIQALPHVKEARALTF

SEQ ID NO: 1800 - protein, 459 aa, Anabaena variabilis ATCC 29413
MLTQLPNPISVPSWWQLINWIADPIGFQKKYSQKYGDIFSMQLAGIGSFVILGEPQAIQEIFTQDSRFDIGRGNKLAEPLIGRTSLMLMDGDRHRRERKLLMPPFHGEKLQAYAQQICLITHQIASQWQIGQPFVARSAMQKLSLEVIIQIVFGLANGERYQQIKPLFTDWLNMTDSPLRSSMLFLKSLQQDWGNRSPWGQMKYQQRCIYDLLQAEIEEKRTKENERRGDVLSLMMAARDENGQAMTDEELKDELLTILFAGHETTATTIAWAFYQIFRNVNVREKLQQELDSLGENPNPMEIAQLPYLTAVCQETLRMYPVLPTLFPRITKSSINIAGYQLEPNTTLMASIYLIHYREDLYPHPQQFRPERFIERQYSPSEYIPFGGGSRRCLGYALALLEIKLVIATVLSNYQLALAEDKPIKVQRRGFTLAPEGGVRMIMTGKKSLRFEQSNKIFN

SEQ ID NO: 1801 - protein, 382 aa, Xanthomonas campestris pv. campestris str. ATCC 33913
MPVTTKLPKVGTTIFTVMSQLAAEHGAVNLGQGFPDFAVPQRLVDALGQAMAAGHNQYPPMTGVAALRQAIAGKAQRCYGAQVDADTEITVTSGATEAIFNAIHAVVRAGEEVIVLDPAYDCYEPAIDLAGARAVHVALDPQTFAVDWDALRAAITPKTRLLMINSPHNPSGAMLSAADMQTLTELLHGTDIFLLSDEVYEHIVFDGRRHESVLRWPELRARAFVISSFGKTYHCTGWKIGYAIAPPALSAEFRKVHQYNTFTSFGPAQHAFAAMLRDEPEHDEQLGAFYQAKRDRFREQLLTTRLVPLPVPGGYFQLVDYSAISDLPDTEFVKWLTVEKGVAAIPLSPFYETAPAGQRLARLCFAKNDATLDAAIARLQQL

SEQ ID NO: 1802 - protein, 428 aa, Mycobacterium sp. MCS
MDDVTMPQTPAERTWHPQGHQPRPRTFTQSSKLQDVLYEIRGPVHEHASRLEAEGHRILKLNIGNPAPFGFEAPDVIMRDIIQALPYAQGYSDSKGIMPARRAVFTRYELVDGFPRFDVDDVFLGNGASELIQMVLQALLDNGDQVLIPAPDYPLWTACTSLAGGTPVHYLCDETQGWNPDVADIESKITDRTKAIVVINPNNPTGAVYSRETLERIADLARKHQLLLLADEIYDKILYDDAKHISLASVAPDVLTLTFNGLSKAYRVAGYRSGWLVITGPKEHASSFIEGISLLANMRLCPNVPAQHAIQVALGGHQSIDDLVLPGGRLLEQRDVAWEKLNEIPGVSCVKPAGALYAFPRLDPEVYEIHDDELLVLDLLLQEKILVVQGTGFNWPTPDHLRIVTLPWARDLANAIERLGNFLVSYRQ

SEQ ID NO: 1803 - protein, 471 aa, Bacillus cereus ATCC 14579
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLNGFGIHIPTILSSAPGTGKGGIIDLPAVLIILVMTVLLSRGVRESARVNNIMVFIKIAVVLIFIFAGFNYVKPENWTPFMPFGLNGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGIWMVIGIAVYFLYSRKHSALNNSKKEEDVANL

SEQ ID NO: 1804 - protein, 334 aa, Oryza sativa
MASSVPNGHGAATATGEGGTPPPPPPPSSSSLVFLGTGCSSAVPNARCLIQPPDPPCAVCSQSLSVPPELNPNYRCNTSLLIDYCQDENAHKYILIDVGKTFREQVLRWFIHHKIPCVDSIILTHEHADAILGLDDVRIVQSFSPTNDIEPTPIYLSQFAMDSIAQKFPYLVRKKLKEGEEVRRVAQLDWRVIESDLQKPFVTSGLEFVPLPVIHGEDYVCLGFLFGRKSKVAYISDVSRFPPSTEHAISKSGEGQLDLLILDCLYRTGSHNVHLCWDQTLDAVKRICPKRALLIGMTHEMDHHKDNETLEEWSRREGIDVQLARDGLRVYIDL

SEQ ID NO: 1805 - protein, 94 aa, Prunus salicina
PSNYSNPNKPSNCIGSRFKKENVSPQLRAKLVRSWPDAESGNDTRFWEGEWNKHGRCSQQTLNQFQYFQRSYAMWRSYNITNILKMASIVPHPT

SEQ ID NO: 1806 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYVDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQDEAKATHKINA

SEQ ID NO: 1807 - protein, 75 aa, Arabidopsis thaliana
  misc_feature (29)..(29): Xaa can be any naturally occurring amino acid
  misc_feature (62)..(62): Xaa can be any naturally occurring amino acid
  unsure (1)..(75): unsure at all Xaa locations
MASSMLSSIGVVTSPAQATMVVPFTGLKXSVSFPAARKGNRGLTSIKGNGGRVSCLKVGPPXWKAQILQTRARLP

SEQ ID NO: 1808 - protein, 252 aa, Mycoplasma pulmonis
MRAKKRFGQNFLIDQNIINKIVDSSEVENRNIIEIGPGKGALTKILVKKANKVLAYEIDQDMVNILNQQISSKNFVLINKDFLKEEFDKSQNYNIVANIPYYITSDIIFKIIENHQIFDQATLMVQKEVALRILAKQNDSEFSKLSLSVQFFFDVFLICDVSKNSFRPIPKVDSAVIKLVKKKNKDFSLWKEYFEFLKIAFSSRRKTLLNNLKYFFNEQKILKFFELKNYDPKVRAQNIKNEDFYALFLELR

SEQ ID NO: 1809 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYIDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQYEAKATHKINA

SEQ ID NO: 1810 - protein, 472 aa, Pseudomonas aeruginosa UCBPP-PA14
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLANVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 1811 - protein, 330 aa, Trichosporonoides megachiliensis
MSYKQYIPLNDGNKIPALGFGTWQAEPGQVGASVKNAVKAGYRHLDLAKVYQNQSEIGVALQELFDQGIVKREDLFITSKVWNNRHAPEHVEPALDETLKELGLSYLDLYLIHWPVAFKFTTPQELFPTEPDNKELAAIDDSIKLVDTWKAVVALKKTGKTKSVGVSNFTTDLVDLVEKASGERPAVNQIEAHPLLQQDELVAHHKSKNIVITAYSPLGNNVSGKPPLTQNPGIEATAKRLNHTPAAVLLAWGIQRGYSVLVKSVTPSRIESNYDQITLSPEEFQKVTDLIKEYGESRNNIPLNYKPSWPISVFGTSDEAKATHKINTNL

SEQ ID NO: 1812 - protein, 197 aa, Triticum aestivum
MEKGMDPALLDNIIARLLEVKSLKPGKNAQLSESEIKQLCAASKEIFLAQPNLLELEAPIKICGDVHGQYSDLLRLFEYGGYPPQSNYLFLGDYVDRGKQSLETICLLLAYKVKYPENFFLLRGNHECASVNRIYGFYDECKRRFSVKLWKTFTDCFNCLPVSALIDEKILCMHGGLSPELNKLDQILNLNRPTDVP

SEQ ID NO: 1813 - protein, 317 aa, Nicotiana tabacum
MAQNNEQQQQGQGLIEAGVLDDIINRLLEFRNARTVRQVQLSEAEIRSLCSASREIFLQQPNLLDLKPPIKICGDIHGQYGDLLRLFEYGGFPPEANYLFLGDYVDRGKQSLETICLLLAYKIKYPENFFLLRGNHECASINRIYGFYDECKRRFNVKLWKCFTECFNCLPVAALIDEKILCMHGGLSPVLTNLDQIRNLPRPTDVPDSGLLCDLLWSDPSREVKGWGMNDRGVSYTFGPDKVAEFLMQHDMDLVCRAHQVVEDGYEFFAERQLVTIFSAPNYCGEFDNAGAMMSVDESLMCSFQILKPTDRKPRFL

SEQ ID NO: 1814 - protein, 341 aa, Salmonella enterica subsp. enterica serovar Typhi
MKVKAVFINKPGEVETRWVDYPHKKENEVLIKVDAAGICGSDIGAFRGTNPLVTYPRIIGHEVTGIVLQEGTGMPDNIKKGDRVIVDPYIYCGHCYPCSVGRTNCCENLNVIGVHIDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 1815 - protein, 310 aa, Nicotiana tabacum
MAQNGQGIEPAVLDDIINRLLEFRNARTVRQVQLSEAEIRSLCTASKEIFLHQPNLLELEAPIKICGDIHGQYGDLLRLFEYGGFPPEANYLFLGDYVDRGKQSLETICLLLAYKIKYPENFFLLRGNHECASINRIYGFYDECKRRFNVRLWKTNTDCFNCLPVAALIDDKILCMHGGLSPDLTDLDEIRNLPRPTDIPDSGLLCDLLWSDPSREVKGWGMNDRGVSYTFGSDKVAEFLMQHDMDLVCRAHQVVEDGYEFFAERQLVTIFSAPNYCGEFDNAGAMMSVDENLMCSFQILKPTDRKPRFL

SEQ ID NO: 1816 - protein, 472 aa, Bacillus thuringiensis serovar konkukian str. 97-27
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGTEMKDHPFKMPFAPVTNYLTIAFLIMVLIGMWFNDDTRISLVVGIVFLAIVTISFYAFGIGKRPPLDVPNDQEISSK

SEQ ID NO: 1817 - protein, 304 aa, Nicotiana tabacum
MDTAAVDRIIEKLIEVRSSNPGKLVQLSESEIKQLCVASRDIFLKQPNLLESEAPIKTRGDIHGQYSDLLRLFEYGGFPPEANYLFLGDYVDRGRQSLETICLLLAYKIKYPENFFLLRGNHECASINRIYGFYDECKRRFNVKLWKSFTDCFNCLPVAALIDEKILCMHGGLSPDLSSLDQIRNLPRPTAIPDTGLLCDLQRSDPGKDVKGWGMNDRGVSYTFGPDKVSEFLSKHDLDLVCRAHQVVEDGYEFFAESELVTIFSAPNYCGEFDNAGAMMSVDENLLCSFQILKPAEKKNKFVM

SEQ ID NO: 1818 - protein, 308 aa, Gibberella zeae PH-1
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 1819 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 1820 - protein, 160 aa, Petunia inflata
DKERQRLQFCTSDKYEIFEGSIRSSLDHHWIQMRYEKEYGLQHQPLWRDQYKKHGTCCKNLYDQTPYFLLAMRLKDKFDLLGTLRTHGITPGKRYTFQKLHSAIKTVTRMDPDLKCVEHIKGVLELNEIGICFTPNADSPYDCPQSRSCQKRGYTGILFR

SEQ ID NO: 1821 - protein, 398 aa, Desmarestia viridis
MSLKKKVFSKKLQHFTINFGPQHPAAHGVLRLILELNGEVVQRADPHIGLLHRGTEKLIEAKTYFQALPYFDRLDYVSMMCQEHTYALAVENLLQVSIPKRAQYIRVLFAEITRILNHLLAVGCHAMDVGAMTPFLWAFEEREKLMEFYERVSGARMHASYFRPGGVSQDISIGLIDDIYSFAVQFGQRLDEMEEMLTENRIWQERLVDIGVVTAQEAIDWGFSGVMLRGSGVRWDLRKNEPYEVYSDLKFCEVVGKTGDCYDRYLVRVEEMRQSLSLIHQCLNKMPQGSVKIDDAKISPPSRTEVKQSMESLIHHFKLYTEGVLVPAGETYTATEAPKGEFGVFLVSDGSNRPYRCKIKAPGFAHLQGLNFMANSHMLADVVTIIGTQDIVFGEVDR

SEQ ID NO: 1822 - protein, 525 aa, Mesorhizobium sp. BNC1
MTIRAEPVPARNLSDQISVLRCPSKRLSMNAATAKIDLSAKLDLLHDKSLLRELAYVDGRWVTGHEPVNFEVRDPATGAVLAYVASLNAAQVDSAIDAAARAFLSWKRLLPQERAATLRAWYELIVAAKEDLALLMTLEQGKPLAESRGEIDYAASFVEWYAEEAKRLNVESVTSHLPGAEMMVRREPLGVVGVVTPWNFPSAMLTRKAAAALAAGCTIVAHPSSETPLSALALAELGERAGLPAGVLNVVTGDAATIVGRMCGDSRIRAMSFTGSTEIGRLIAAQCAPTMKRLVMELGGHAPLIVFEDAPLDKAVDIAIGAKFATSGQDCLAANRIYVQRGIYGAFCEAFAARIATLKVSDGLDETGDIGPLMHERAIAKVEEQVTDALGRGARCLIGGERHPAGRLFYQPTLLADVPDAALIMREETFGPVAAAVPFDTEDEVVRRANNTEYGLVAYVVTENGARQLRMGRALDYGMVAINRVKITGAPIPFGGVKQSGIGREGARHGLEAFTDLKYLCLDAA

SEQ ID NO: 1823 - protein, 163 aa, Petunia inflata
DNTSRRLNFCSGDKFNTIQDEDKQNALEYRWPNLTTTEAVSKKAQIFWENQYNKHGTCCSELYDKEAYFDLAIELKDKFDLLKILRMHGITPGTSHHTSNQIKNAVKAVTKGVPNVSCFDNFRGTLTELLEIGICFNRAADRVIDCPLPKSCRPKGTKGITFP

SEQ ID NO: 1824 - protein, 161 aa, Petunia inflata
DNQHVMLNNCAKTFQKITNVRKIKELDDRWPDLQKSKSEATRTQSFWQYEYNKHGTCCTERYDRQAYFDLAQNLKDKYDALQILKNHGIIPGKSYAVDKIEEAIRDATQAYPNLNCIGDPQKTMELKEIGICFVPDATKATACHRRRTCNPINNKEIDFPL

SEQ ID NO: 1825 - protein, 472 aa, Thiobacillus denitrificans ATCC 25259
MTIHPVILSGGSGTRLWPLSRAALPKQLLPLASERSLLQDTVLRLADFPDMAAPLMVCNVEHRFMIAEQMRQIGVHPSAIVLEPVGRNTAPAIAVAALRLSREDADALMLVLPADHLIGDIAAFHAAITRAADAAKHGYLATFGIVAATPETGYGYIRKGDALAEAAGAHAVAGFVEKPDLATAQQYVASGDYFWNSGMFLFRASDFLKELETLRPDILSASRAALDAAKPDLDFVRLDPVAFEACPSESVDYAVMEHTRRAAVVPADIGWNDIGAWSALWEVAEKDAAGNAVRGDVMLENAANNFVRAETRMVAMLGVSDLVVVETADVVLVANRDQVQDVKKLVDRLKAAKRCEHLVHKQVYRPWGWYEGIDGGDRFQVKRIMVKPGEKLSLQMHHHRAEHWVVVSGTASVTCGDEVMLLAENQSTYIPLGTTHRLENPGKVDLHMIEVQSGTYLGEDDIVRFEDVYKRD

SEQ ID NO: 1826 - protein, 307 aa, Pyrococcus abyssi GE5
MIEVKVLVAAPLHEKAIQILKDAGLEVIYEEYPEEDRLVELVKDVEAIIVRSKPKVTRKVIESAPKLKVIARAGVGLDNIDVEAAKERGIEVVNAPAASSRSVAELAVALMFAVARKIAFADRKMREGVWAKKQAMGIELEGKTLGIIGFGRIGYQVAKIARALGMNLLLYDPYPNEERAKEVGGKFVDLETLLRESDIVTIHVPLLESTYHLINEERLKLMKKSAILINTSRGAVVDTNALVKALEEGWIAGAGLDVYEEEPLPKDHPLTKFDNVVLTPHIGASTVEAQERAGVEVAEKVVKILKG

SEQ ID NO: 1827 - protein, 278 aa, Bacillus subtilis subsp. subtilis str. 168
MKKIGFVGAGSMAEAMINGILQSGITKPEHIYITNRSNDERLIELKETYSVRPCRDKNEFFTHTDIIILAFKPKDAAESIDSIRPYIKDQLVISVLAGLTIETIQHYFGRKLAVIRVMPNTSAAIRKSATGFSVSTEASKNDIIAAKALLETIGDATLVEERHLDAVTAIAGSGPAYVYRYIEAMEKAAQKVGLDKETAKALILQTMAGATDMLLQSGKQPEKLRKEITSPGGTTEAGLRALQDSRFEEAIIHCIEETAKRSAEIKEQFAGAALERHS

SEQ ID NO: 1828 - protein, 89 aa, Triticum aestivum
  misc_feature (40)..(40): Xaa can be any naturally occurring amino acid
  unsure (1)..(89): unsure at all Xaa locations
MAGAAKASWMVAMSVGAVEALKDQAGLCRWNYALRSIHRXAKARANVRGGVSQGARQLPASAAVAEKRRAEKTEEGLRTVMYLSCWGPN

SEQ ID NO: 1829 - protein, 333 aa, Xanthobacter autotrophicus Py2
MTSSALDVLAIGNAIVDVLSRAEEDVLARHGMVKGGMALIDEARAEQVYAAMGPGTEASGGSAANTAAGIASLGGRAGFVGRVKADTLGTVFGHDIRAAGVAYATTAATDGPATARCLILVTPDGERTMNTYLGAAQHLTTADIHAGEVESAAVTYLEGYLWDPPPAKNAFLAAAQIAHGAGRKVALTLSDAFCVDRYRGEFVDLIRGGTVDLVFCNEGELKSLYETADFDAAIVALRRDAKEAVVTRSEKGASFVTSGAVVSVPAHPVAKVVDTTGAGDLFAAGFLTGYTRGLDPATSLRLGALAAGEIIGQMGARPQRPLLDLAREAGLLS

SEQ ID NO: 1830 - protein, 462 aa, Nicotiana sylvestris
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 1831 - protein, 358 aa, Solanum tuberosum
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQTKKPWSLSFSFGRALQQSTLKAWGGKEENVQKAQAAFLTRCKANSDATLGKYAGASNLSEGASESLHVKDYKY

SEQ ID NO: 1832 - protein, 976 aa, Pisum sativum
MKSITCYLLVFFCVLFTPCFSITDLDALLKLKESMKGEKSKHPDSLGDWKFSASGSAHCSFSGVTCDQDNRVITLNVTQVPLFGRISKEIGVLDKLERLIITMDNLTGELPFEISNLTSLKILNISHNTFSGNFPGNITLRMTKLEVLDAYDNSFTGHLPEEIVSLKELTILCLAGNYFTGTIPESYSEFQKLEILSINANSLSGKIPKSLSKLKTLKELRLGYNNAYDGGVPPEFGSLKSLRYLEVSNCNLTGEIPPSFGNLENLDSLFLQMNNLTGIIPPELSSMKSLMSLDLSNNALSGEIPESFSNLKSLTLLNFFQNKFRGSIPAFIGDLPNLETLQVWENNFSFVLPQNLGSNGKFIFFDVTKNHLTGLIPPDLCKSKKLQTFIVTDNFFHGPIPKGIGACKSLLKIRVANNYLDGPVPQGIFQMPSVTIIELGNNRFNGQLPSEVSGVNLGILTISNNLFTGRIPASMKNLISLQTLWLDANQFVGEIPKEVFDLPVLTKFNISGNNLTGVIPTTVSQCRSLTAVDFSRNMITGEVPRGMKNLKVLSIFNLSHNNISGLIPDEIRFMTSLTTLDLSYNNFTGIVPTGGQFLVFNDRSFFGNPNLCFPHQSSCSSYTFPSSKSHAKVKAIITAIALATAVLLVIATMHMMRKRKLHMAKAWKLTAFQRLDFKAEEVVECLKEENIIGKGGAGIVYRGSMPNGTDVAIKRLVGQGSGRNDYGFKAEIETLGRIRHRNIMRLLGYVSNKDTNLLLYEYMPNGSLGEWLHGAKGCHLSWEMRYKIAVEAGKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLTGYPMASVIYMFNIAMMCVKEMGPARPTMREVVHMLTNPPQSTTHNNLINL

SEQ ID NO: 1833 - protein, 487 aa, Desulfitobacterium hafniense Y51
MRALEPLIFELSREGRTGVSLPACDVPEIPLEELIPQEFLRDKEPELPEVSEVDVVRHFTRLSSFNHGVDTGFYPLGSCTMKYNPKVNEKLARLPGFSQIHPYQPEELTQGALGLMVELQEELAEITGMDAFTLQPAAGAHGEMTGILIIKAYHDHRQDVKRRKVIVPDSAHGTNPATGAMAGYDIVQVPSNERGGVDIEALRQVANEEVAALMLTNPNTLGLFDENILEIAEIIHAVGGLIYYDGANANAIMGIARPGDMGFDVVHLNLHKTFATPHGGGGPGSGPVGVKEFLAPYLPKPVAIRTPEGRYSWDDDRPLSIGRVRAFQANFGVLVKAYAYIRALGGEGLKAASQNAVLNANFLMSILKEHYHLPYDRVCMHEFIITPKNLKNYGIHTLDIAKRLLDYGYHPPTIYFPLIVEEAMMIEPTETESLETLEQFAQVMIQIAEEVKQDAEMVKNAPHDTLVTRLDETGAARKPDLRWRKPQ

SEQ ID NO: 1834 - protein, 446 aa, Desulfitobacterium hafniense Y51
MNYVPNTVDQQEQILTRIGVGSLEELFADIPESVRRQAQLKIREGLSELELVKYMGRLAAENKTVEEYTSYLGAGAYEHFIPSYVDQLLLRSEFYTAYTPYQPEISQGTLQAIYEFQTLVCELTGMDGANASMYDGASALAEAALMSCDATRRKKVLVPQTIHPEYREVLRTYLLPRGVEILEIPYQEGAVDSEALEKALNTEVAAVLIQSPNFFGMIEKAEEIGQMAHAKGGLLVMAVNPVSLGLLKSPGELGADIVVGEGQPFGNPLNFGGPYLGFLACREKYVRRMPGRIVGATKDKNGKKGYVLTLQAREQHIRREKAASNICSNEALCALAFTIHLSGLGKRGLKEMARLNLQKAHYGAEEIGKLPGMSLAFQGPFFHEFVIKTEVSPRKINEALLSHKIIGGLELSRFYPELDQHLLFCVTETKTKEDIDRLVAGMGEIK

SEQ ID NO: 1835 - protein, 353 aa, Oryza sativa
EEEGSGRKEREKKRQRAHSASSEMGIFWSKAEPPPPMVLVPPLFDYPPIAARTRMSVPAYELMFGKLSLQNLFEDYFDHAGNMTSRVMLKPLEDPHVDLITTVSAAADKIDGTQVKGDALFRWQKDLDDPHTFVDLLVSTSNPMLQVRSCAYHPKYRVGAFGTFPLLMGNRIREISFFRVRSEDYGVMGVRYGSENLSFGSSFVPFPGSAELPSGAWLVGRKGSLSAGVQYKPLSGNKHLMPYTDWKNWNCAISYGVGLTSPLSPSFIFSLELARSTELLHSLHRSINTWLFKEGLKTLLKMIRLLESQTTLILGLNWLQGLIKINHQRVPTIPCFSLQQVGKLIRTSYSRES

SEQ ID NO: 1836 - protein, 314 aa, Nicotiana tabacum
MSSSDLVAASIQGNLDEQISQLMQCKPLSEPDVRALCEKAKEILAEESNVQPVKSPVTICGDIHGQFHDLAELFRIGGQCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDNVRSFDRVQEVPHEGAMCDLLWSDPDDCCGWGMSPRGAGYTFGQDISEQFHQTNNLKLIARAHQLVMEGYNWSHEQKVVTIFSAPNYCYRCGNMASILEVDDCRGHTFIQFDPAPRRGEPDVTRRTPDYFL

SEQ ID NO: 1837 - protein, 199 aa, Triticum aestivum
TSLYKKAGWYRSGIPGISSTHASADASLAVVGMICPHLENLDLSGLGAVTDDGLLPLIRSSESGLVHVDLNGCENLTDAAISALVKAHGTFLAHLSLEGCSKITDASLFAISESCSELAELDLSNCMVSDYGVAVLASAERLKLRVLSLSGCLKVTPKSVPFLGSMPASLEGLNLQFNFIGNHNIASLEKQLWWCDILA

SEQ ID NO: 1838 - protein, 324 aa, Oryza sativa (japonica cultivar-group)
MALLIVRQTFIRVHGSLHVSPVAMETRVAVVTGGNRGVGLEICRQLASNGILVVLTARDEKKGSQAVKALEQSGLSGVIFHQLDVTDRSSIMLLVEFIRTKFGKFNILVNNAAIGGTTIDPERLRELLEQDPKASFQEDLMGFLNSYMGSLQQNYEMAKECLEINFYGTKDVTDCLMPLLLLSNSGKVINLTSKISQLQFISNEGVIKVLSDIDNLSDEKLKDVASIFLKDFKDGNLEAHGWQPVVSAYAVSKTLVNAYSRLLAKRHPSLEVCCVNPGFVKTDMNYGIGLISVEEGANAPVRLALQEACSDSCLYFEQCEISEF

SEQ ID NO: 1839 - protein, 418 aa, Archaeoglobus fulgidus
MKLDKSRKLYAEALNLMPGGVSSPVRAFKPHPFYTARGKGSKIYDVDGNAYIDYCMAYGPLVLGHANEVVKNALAEQLERGWLYGTPIELEIEYAKLIQKYFPSMEMLRFVNTGSEATMAALRVARGFTGRDKIVKVEGSFHGAHDAVLVKAGSGATTHGIPNSAGVPADFVKNTLQVPFNDIEALSEILEKNEVAALILEPVMGNSSLILPEKDYLKEVRKVTAENDVLLIFDEVITGFRVSMGGAQEYYGVKPDLTTLGKIAGGGLPIGIFGGRKEIMERVAPSGDVYQAGTFSGNPLSLTAGYATVKFMEENGVIEKVNSLTEKLVSGIADVLEDKKAECEVGSLASMFCIYFGPTPRNYAEALQLNKERFMEFFWRMLENGVFLPPSQYETCFVSFAHTEEDVEKTVEAVSESL

SEQ ID NO: 1840 - protein, 424 aa, Neurospora crassa
MAQGEASERVREAQKVVSTDPRQAEQIYKDIISKPPSVTSDAAIREYETALIHLGELYRDEKNSQGLVDLVTQSRTVLSSFAKAKTAKLVRQLLDLFEAIPDSLDIQISVTKSCIEWATSERRSFLRQNLETRLVALYMAKQSYYDALTLINGLLRELKRMDDKLVLVEVQLLESRVYHALGNIAKARAALTSARTSAASVYTPPLLQANLDMQSGMLHAEDKDFNTAFSYFIEALDGYHTQEEPQRAQAALQYMLLCKIMLNLADDVNQLMTSKQAVKYAGKSLEAMKAIARAHSNRSLEEYERALAAYRYELGSDTFIRNHLRRLYDAMLEQNLIKVIEPFSRVEIDHIAKMVGLDTQQVERKLSQMILDKVIIGVLDQGAGCLIIYDETHRDEAYDAALKTIEKLSNVVDVLYTNQASQLE

SEQ ID NO: 1841 - protein, 83 aa, Zea mays
  misc_feature (30)..(30): Xaa can be any naturally occurring amino acid
  misc_feature (62)..(62): Xaa can be any naturally occurring amino acid
  unsure (1)..(83): unsure at all Xaa locations
ICVLFCQSSPASVPVCELVNKNYDDNKSPXPSLPWHGRECTGVPHKIRARSHMGVERCVTFXGLTEATIIKRCTGRPRSPSPL

SEQ ID NO: 1842 - protein, 161 aa, Petunia inflata
DNESNLLNDCLPKSYQDITDMPTKIKLDNRWPDLKTTKQLCMQDQEFWRYEYNKHGSCSLGPYNQKTYFDLAIKLKDKFDLLAALQNHGINPGSTHTVKEIGSAIESVTKVYPNMKCIGNPAGTMVLLEIGICFVPDATRVIPCYRPVICHNNENKRINIP

SEQ ID NO: 1843 - protein, 142 aa, Thiobacillus denitrificans ATCC 25259
MAVQRTFSIIKPDAVAKNVIGKIVSRFETNGLKVVASKMKHLSRQEAEGFYAVHKDRPFFKDLVDFMVSGPVVLQVLEGEDAIAKNRTLMGATDPKKAEPGTIRADFAESIDANAVHGSDAPETAAVEIAYFFPASEVYAGR

SEQ ID NO: 1844 - protein, 161 aa, Petunia inflata
DNWSKPLQNCDPLATIDGVLDIEKRSQLDVRWPQLKHSKDDGMNLQPLWKGEYKKHGTCCNNMYNEQAYYDLAMNLKDRFDLLKILSSQGITPGKSYIVQKVQDAIRTVTHQLPRLKCVEYPGLELSEIVICFEPKGKNVVSCRRPGTCFKNGKMGTILYR

SEQ ID NO: 1845 - protein, 397 aa, Bacillus cereus G9241
MFHRIEEALEDLKQGKVVIVCDDENRENEGDFIALAEYITPETINFMITHGRGLVCVPITEGYAERLQLEPMVAHNTDSHHTAFTVSIDHVSTTTGISAHERATTIQELLNPASKGADFNRPGHIFPLIAKEGGVLRRAGHTEAAVDLAQLCGAEPAGVICEIINEDGTMARVPDLIQCAKQFDIKMITIEDLIAYRRHHETLVTREVEITLPTDFGTFHAIGYSNSLDTKEHIALVKGDISTGDPVLVRVHSECLTGDVFGSCRCDCGPQLHAALTQIEREGKGVLLYMRQEGRGIGLLNKLRAYKLQEEGFDTVEANEKLGFPADLRDYGIGAQILKDLGLQHLRLLTNNPRKIAGLQGYDLEVIERVPLQMPAKEENKTYLQTKVNKLGHLLNL

SEQ ID NO: 1846 - protein, 213 aa, Buchnera aphidicola str. Sg (Schizaphis graminum)
MNQTLLSEFGNPIERVKKAISALQLGEGIIILDDEKRENEGDLVFSSETMTVEQMALTIRYGSGIVCLCITESKRKKLNLPMMVKHNTSTYRTGFTVTIEASKGVSTGVSAKDRLTTIKTATADDAQPSDLNRPGHVFPLRANGGGILARAGHTEAAIEIVSLAGFKPYGVICELTNKDGSMSRTPEIIKFSKSKKMKILTIKDLILYVQNKK

SEQ ID NO: 1847 - protein, 483 aa, Prochlorococcus marinus str. MIT 9313
MQWGMQQIDGLTNTPRWVAQAVVYQIFPDRFRCSGRVLAHQHLALRCWGSDPSEQGFQGGDLYGVIEALDHLQALGISCLYLTPVFSSAANHRYHAYDYLQVDPLLGGNAALEALIEAVHRRGMRIILDGVFNHCGRGFWAFHHLLENGEASPYRDWFEVRQWPLHPYPRRGQDCGYSCWWNDPALPKFNHAHAPVREYLIAVARYWLEQGIDGWRLDVADEVPAEFWLEFRHMVKAVNPDAWILAEIWGDARPWLQGQHFDGVMNYRMGWSSLCWVAGKRLRRRYRNPAYPLDPLSGEAFVELLATTLGWYRPEVNRSQLNLLDSHDVPRALHTLQGDLAALKLALLLLFLQPGAPCIYYGTEAGLQGGPEPGCREGFPWHTPWPADLRDFIQSLSDLRQRCPALSDGGLQWQPIGADALHAWLMQPEPGTTQKETPIQVWVNRSRRSWLRMKGSSTDPLWLEGALECNGRGLGPQSAVLFH

SEQ ID NO: 1848 - protein, 273 aa, Idiomarina baltica OS145
MNDIRKIAFIGAGNMTQSIVGGMCKSGYPADHVFVSNPSPEKLEKMKSNLGVNTSQDNIEVIEQADVIVLSVKPQLMEQVCADIKSKVSNLADKLIITIAAGIRMPKYRTYLGDDITIIRVMPNTPSLVGQGMSGLVTDSADDKDKAYVTDVFDGVGDTLWVADEDQLDILGAVAGSGPAYFFEFMDSLAKGATELGFDPEKARAMVQQTCLGAAQMAKESDLTLEDLRKQVTSKGGSTAKGVEVYQQRDLHNISADAVKAAVKRNQEMADLF

SEQ ID NO: 1849 - protein, 267 aa, Blastopirellula marina DSM 3645
MSKIGFLGAGQMAQALASGFVRADLVHPADIIAVDPFPAARTSFGQLVPGASVSDSAAKLAAEVDVIVLAVKPQMLQAAIAGLGLIGDNVLLVSIAAGTSLARLAEWTRSTRIIRVMPNTPCLIGESASAFCAGEGATTDDVALVEKLLGAVGVVRKVDEKLMDAVTGLSGSGPAYVYVLIEALADAGVRVGLPRDAALQLAAQTVRGAAGMVLQTGDHPGVLKDRVTSPGGTTIAGLQALEAGGFRSAAYDAVIAATARSKELGAE

SEQ ID NO: 1850 - protein, 141 aa, Rubrivivax gelatinosus PM1
MAIERTLSIIKPDAVAKNVIGQIYARFEGAGLKIVAAKLVHLSRGEAEQFYAVHKARPFFKDLVEFMISGPVMIQALEGEGAIAKNRELMGATDPKKAEKGTIRADFADSIDANAVHGSDAPETAAVEVAFFFPGMNVYSR

SEQ ID NO: 1851 - protein, 229 aa, Pyrococcus abyssi GE5
MNIEEMKKIAAKEALKFIEDDMVIGLGTGSTTAYFIRLLGDMIKKGEVSDIVGVPTSYQSRLLAIESGIPVATLDQVDAIDVAVDGADEVDPNLNLIKGRGAALTMEKIIESRAGMFIVLVDERKLVDYLCQKMPVPIEVIPQAWRAIVEELSIFNAEAKLRMGVNKDGPVITDNGNFIIDAKFPRIDDPLDMEIELNTIPGVVENGIFADIADIVIVGTKEGVKTLER

SEQ ID NO: 1852 - protein, 469 aa, Escherichia coli O157:H7 EDL933
  misc_feature (222)..(222): Xaa can be any naturally occurring amino acid
  unsure (1)..(469): unsure at all Xaa locations
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEXATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 1853 - protein, 420 aa, Methanothermobacter thermautotrophicus str. Delta H
MKSEELFRRASNVLPGGVSSPVRRFDPHPFFAAGGSGCLLESVDGESYIDYCLAYGPLILGHAHPRVVEAVNEQIKRGTTYGVPTEGEIELAEAIIERVPCAEMVRFTNSGTEATMAAVRLARAFTGRDRIVKFEGSYHGAHDYVLVRPGSGAATAPDSPGIPVDTVRNTLTVPFNHEEAMAELIEGAGEDIACILVEPVMGNIGCIEPENGYLQFLRDITRENDIILIFDEVITGFRLAPGGAQEYYRVEPDLVTLGKIVGGGFPMGALAGRREIMENISPAGNVYQAGTFNGNPVSVTAGRETLRLLDGRMYSDLERKGSTLRAGLRDLLSDLDLEYQVTGPASMFQLYFTGEEVRNYGDAKKSDTVLFMEYFHGLLERGVFIPPSQFECCFISAAHESEHIEATLEAAEEVLSGLKN

SEQ ID NO: 1854 - protein, 341 aa, Photorhabdus luminescens subsp. laumondii TTO1
MKALSKLKAEEGIWMIDVPEPELGHNDVMIKIRKTAICGTDVHIYNWDDWSQKTIPVPMVVGHEYVGEVVAIGQEVKGFKIGDRVSGEGHITCGYCRNCRGGRTHLCRNTIGVGVNRAGCFAQYLVIPAFNAFKIPDNISDELAAIFDPFGNAVHTALSFDLVGEDVLVSGAGPIGIMAAAVCKHVGARHVVITDVNEYRLELARKMGVTRAVNVSQENLTDVMAELGMTEGFDVGLEMSGAPAAFRTLLNTMNHGGRVALLGIPPSDMAIDWNQVIFKGLFIKGIYGREMFETWYKMATLIQSGLDLTPIITHRFSIDDFQKGFDIMRSGQSGKVILNWD

SEQ ID NO: 1855 - protein, 388 aa, Thermoanaerobacter tengcongensis MB4
MNPNKYISDVVKKIPPSGIRKFFDLVTNSKDIISLGVGEPDFVTPWEIRKEGIETLCRGNTTYTSNLGLLELRIAISYFLKTHYDLNYDPEKEIMVTIGASEAIDLALRALLNDGDEVLIPEPSYVSYAPCVILTRGVPVFIPTDEKNNFILTPDDLRSKITSKTKALILLYPNNPTGAIMKKEDLEEIVDVIIEKDLIVISDEIYSELTYEGKHVSIASLPGMKERTILINGFSKAFAMTGWRLGYIAAEHEFIEAMNKIHQYTTICAPITAQYAAIKGIYECEEDIIKMRETYDQRRRFIVNGFREIGLDCFEPKGAFYIFPSIKKTGMTSEEFCEKLLKEEKVAVVPGNAFGPSGEGYVRVSYAYSIDKIAKALERIKRFAEKIL

SEQ ID NO: 1856 - protein, 221 aa, Glycine max
VVYFRRALKLNKNFLSAWTLMGHEFVEMKNTPAAVDAYRRAVDIDPRDYRAWYGLGQAYEMMGMPFYALHYFKKSVFLQPNDSRLWIAMAQCYETDQLRMLDEAIKCYRRAANCNDREAIALHNLAKLHSELGRPEEAAFYYKKDLERMESEEREGPKMVEALLYLAKYYRAQKKFEDAEVYCTRLLDYTGPERETAKSILRGMRSTQSNFPSMDVEHFPP

SEQ ID NO: 1857 - protein, 270 aa, Synechococcus sp. RS9917
MRPADLIRFKQSGQAITMLTAWDALSAALVQAAGADLVLVGDSLAMVVLGHATTLPVTLEQMLQHTQAVCRGLNGPLERQPLVVCDLPFLSYQCGEERAVAAAGTLLKNSGAAAVKLEGAEPEIVQVIDRLVRMGIPVMGHLGLTPQAVHRLGYRRQAEDPRSQDTLLRQAETLEANGCFALVLEHVPAQLASRVRQALRIPVIGIGAGDDCDGQVRVSADLLGLTPPATALQPRPDPGAATAGGGASGLGDCTTAAGRVSHQRTTSTST

SEQ ID NO: 1858 - protein, 377 aa, Coleochaete scutata
MADGEEVSALVCDNGSGMVKAGFAGDDAPRAVFPSIVGRPRHQGVMVGMGQKDAYVGDEAQSKRGILTLKYPIEHGIVTNWDDMEKIWHHTFYNELRVAPEEHPVLLTEAPLNPKANREKMTQIMFETFSVPAMYVAIQAVLSLYASGRTTGIVLDSGDGVTHTVPIYEGYALPHAILRLDLAGRDLTDYMMKILTERGYAFTTTAEREIVRDIKEKLAYVALDFEQEMQTAQNSSSLEKSYELPDGQVITIGSERFRCPEVLFNPALIGMESAGIHETTYNSIMKCDVDIRKDLYGNIVLSGGTTMFPGIADRMSKEITALAPSSMKIKVVAPPERKYSVWIGGSILASLSTFQQMWIAKSEYDESGPSIVHRKCF

SEQ ID NO: 1859 - protein, 270 aa, Synechococcus sp. CC9605
MQPAFGVIGLGRMAQALVLPLLERGRIPADQLLAVVGESVSLEQRRGALPAGIGLVAADDPSAQQVWTAPVQLLAVKPQQLDAVAAVSGPVVGEPLLISVLAGVSLARLQHLFPGHRCVRAVPNTPALVGAGLTALAWGEGIDPEQQDQVRQLFADVGEVLELAEAKLDAFLALTSSGPAFVALVAEAMADGAVAAGLPRDLALRLSHRTLAGTAELLDRRDLHPAQLKDMVTSPGGTTIAGVRALERIGLRSALIEAVVAAAERSRELA

SEQ ID NO: 1860 - protein, 417 aa, Zea mays
  misc_feature (222)..(222): Xaa can be any naturally occurring amino acid
  unsure (1)..(417): unsure at all Xaa locations
MAAAEEEEEWEDGRSVMPEEEDGDIEDVPPPPLLGRNFGSEDEDEDEAGSLNSQSQWWPRSFREATDTYTIAAPPGLRHLVVGDCNGLGSDLKLPLLSDKLDGRQDSSNNLLPVADPFGSVLSEGRFSDRVQQAPTTPGCNLTQTVFNGVNVLAGIGIFSAPYTIREAGWASLVVLAFFAVVCCYTGVLLKYCFESKDGVKTFPDIGELAFWRIGRFLISIXLYTELYSFCVEFVILEGDNLASIFTSTTFDWNGIHADGRHFFGILFALVVLPSVWLRDLRVISYLSVGGVFATLLVFLSVGVVGATGNVGFHLAGKAVKWDGIPFAIGIYGFCYAGHSVFPNIYQSMSDRTKFNKALYICFAICTTIYGAIAVIGYLMFGDKTLSQITLNLPKDSFVAKVALGTTVVNTNRVFGL

SEQ ID NO: 1861 - protein, 384 aa, Methanococcus maripaludis S2
MLNNSVKHLKMDNMENKIPMRRMVHKIIYECNIVLLVVDARDPETTRNRALEEYTIEKNKKLIYVINKSDLVPKKILEKWKNKFKSENPDSSVVFVSAKEKLGTKMLRDEIKTYLNSNNIKYGQVGIVGYPNVGKSSIINALTGKKSARSGLTAGLTVGEQWVKLTKDIKLLDSPGIIEPKDEDELVISGALRYEKADDIISPALKILNRIHTFDNTILKEYYGFEIGEEINIELLEKIGTKLNFLTKDGKIDIDRTSKSIIREFQNGKLNYHRMNLKKYEQKRTKNIDFITKHLKDFPFINDADQIILHLENINELGKLNTRPVIGIKELDDAFVIISFSEKSRDTGRKKVEELARTSDIELYSLGDGRVGKHRIYVGVGEKR

SEQ ID NO: 1862 - protein, 463 aa, Bacillus anthracis str. 'Ames Ancestor'
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 1863 - protein, 140 aa, Anaplasma phagocytophilum HZ
MQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIFKR

SEQ ID NO: 1864 - protein, 140 aa, Francisella tularensis subsp. holarctica
MTKQRTLSIIKPDAVEKNVIGEIYSRFEKAGLRIIAAKMKHLSKAEAEGFYAVHKDRPFFSALVEFMISGPVMIQVLEGENAIAKNRELMGATNPKEAKAGTIRADFADSIDANAVHGSDAEDTAAQEIRYFFSDTEIFG

SEQ ID NO: 1865 - protein, 163 aa, Petunia inflata
DNTTTRLNFCGGEKFNTIEGDNKRNALEYRWPNLTTTEAVSKQGQVFWENQYNKHGTCCSDLYDQDAYFELAIDLKDKFDLLKILGKHGITPRTSYHTSNNIKMAIRAVTKAVPNISCLDNFRGSLTELSEIGICFNREADRVIDCPLPKSCRPKGTKGITFP

SEQ ID NO: 1866 - protein, 142 aa, Glycine max
MKTESPRHLRNPLLVLLFLAAAAAASAAPVVQIAMAAEPEQAPAAQEAAVHIVYVDRPEDADPEEFHIRTLAPVLGSEEKARGAVLYHYKHAASGFSAKLTTEQVEDLKKQPGVLQVVPSQTYQLHGNEGGHASTTRTMGLM

SEQ ID NO: 1867 - protein, 162 aa, Petunia inflata
DNVSVALYNCYPNRKFRPMTDKKDQAELEKRWPDLTSTEYASMRYQSFWKYQYEKHGTCCSDFYSQRAYFDFAINLKDRTDLLTIFRSQGVTPGSTYTGDKINSSIASVTRALPNLKCLYYQGNLELTEIGLCFNRTTVAMMSCPRISTSCKFGTNKAVTFR

SEQ ID NO: 1868 - protein, 524 aa, Helicobacter pylori 26695
MYQVAICDPIHAKGIQILEAQKDIVLHDYSKCPKKELLEKLTPMDALITRSMTPITSDFLKPLTHLKSIVRAGVGVDNIDLESCSQKGIVVMNIPTANTIAAVELTMAHLINAVRSFPCANDQIKHQRLWKREDWYGTELKNKKLGIIGFGNIGSRVGIRAKAFEMEVLAYDPYIPSSKATDLGVIYTKNFEDILQCDMITIHTPKNKETINMIGAKEIERMKKGVILLNCARGGLYNEDALYEALETKKVRWLGIDVFSKEPGIHNKLLDLPNVYATPHIGANTLESQEEISKQAAQGVMESLRGSSHPHALNLPMQAFDASAKAYLNLAQKLGYFSSQIHKGVCQKIELSLCGEINQFKDALVAFMLVGVLKPVVGDKINYINAPFVAKERGIEIKVSLKESASPYKNMLSLTLNAANGTISVSGTVFEEDILKLTEIDGFHIDIEPKGKMLLFRNTDIPGVIGSVGNAFARHGINIADFRLGRNTQKEALALIIVDEEVSLEVLEELKNIPACLSVHYVVI

SEQ ID NO: 1869 - protein, 227 aa, Malus x domestica
MGITGMIYMFTMVFSLIVLILSSSTVGYDYFQFTQQYQPAVCNSNPTPCNDPPEKLFTVHGLWPSNKNGPDPEKCKNIQMNSQKIGNMAAQLEIIWPNVLNRTDHVGFWEREWLKHGTCGYPTIRDDMHYLKTVIKMYITQKQNVSAILAKAMIQPNGQNRSLVDIENAIRSGTNNMKPKFKCQKNTRTTTELVEVTLCRDRDLTKFINCPQPPQGSRYLCPADVQY

SEQ ID NO: 1870 - protein, 955 aa, Bradyrhizobium japonicum USDA 110
MMTAHRKSNGDTTNFARRHIGPSARDVAAMLETVGAKSVDALMAETLPASIRQAAPLDLGKPLSETEAIAHMGELAAQNQVFTSLIGQGYSGTILPAVIQRNILENPAWYTAYTPYQPEISQGRLEALFNFQTMICDLTGLDVANASLLDEATAAAEAMALAERHSRVEAKAFFVDKDVHPQTLAVMRTRAEPLGWNLIVGDPLTDLDKADVLGALLQYPGSSGALRDLRPAIAALKAKGALAIVAADLLALTLLASPGELGADIAIGSAQRFGVPMGYGGPHAAYMAVRDALKRSLPGRIVGLSVDSRGMPAYRLALQTREQHIRREKATSNICTAQVLLAVIAAMYAVYHGPEGLSQIARQVHRRAAVLAAGLRKLGFAPHSDSFFDTLSVDAGAKRAEIVARAAAEKINLGVGETALRIALDETTTPATVEAVWRAFGGQLAYAELDATTREALPEALKRTTAFLTHPVFHAHRSETEMLRYMRKLSDRDLALDRAMIPLGSCTMKLNATTEMMPLTWPEFGSLHPFAPREQAKGYHALFARLEKWLCDITGYDAISLQPNSGAQGEYAGLLAIRGYHAARGEAHRKICLIPSSAHGTNPASAAMVGMDVVVVACEKNGDVDVNDLRAKADKHANDLAAIMITYPSTHGVFEEHIREICDIVHGHGGQVYLDGANLNAQVGLSRPGDYGADVSHLNLHKTFCIPHGGGGPGMGPIGVKAHLAPFLPGHPATRGDAPVGPVSAAPFGSASILTISYIYILMMGGEGLKRATEIAILNANYIAARLDAHFPVLYKNARGRVAHECIVDPRALKTTSGVTVDDIAKRLIDYGFHAPTMSFPVPGTLMIEPTESESKAELDRFCDAMIAIRKEIGEVEAGRFKIEASPLRHAPHTVHDIADDAWARAYSRAEGCFPDGVSRTDKYWSPVGRVDNVYGDRNLVCSCPPVSDYAEAAE

SEQ ID NO: 1871 - protein, 623 aa, Oryza sativa (japonica cultivar-group)
MAQVVAAAGTAAAVAAVGRPLGGGGSGADALRPAARLSFAPRWCGGSAGAARARRESAVTSVISRAPRLDAEVLPVSADDDADEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQQNLRPDDNTTLALLASFNCELSELCARHERAIVVILYSLLNMLPCM

SEQ ID NO: 1872 - protein, 433 aa, Synechococcus elongatus PCC 7942
MVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 1873 - protein, 490 aa, Bacillus anthracis str. A2012
MAVPYDVPVVGYETSTVNTLRLWNAEPVPFPQNCKDILKYKRETEAVSEFLYPDDTHDEGKILRLKQQYFLVSASLQNIVRLHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEELFKLSKWWISCK

SEQ ID NO: 1874 - protein, 240 aa, Glycine max
MDTDGFVSFDHVSPEDSHEVHVLAVDDSLVDRKVIERLLKISACKVTAVDSGIRALQFLGLDEQRRTSESDGFVPDLKVDLIITDYCMPEMTGYELLKKIKESTMFREIPVVIMSSENILPRIDRCLEEGAEDFIVKPVKLSDVKRLKGYMTPKEVIKMRSQEDRRSDGYVNGGDGGVVEINNKRKLEEQDTSDVSLSPPSTSTLSSSPSVSSPSPSSSPTSSASVLASPIRRLKMTSTD

SEQ ID NO: 1875 - protein, 140 aa, Schizosaccharomyces pombe 972h-
MNQATQIIPFTTSGSLVDYVDRKVIVVLRDGKKLIGILRSFDQFANLMLQYTIERIYVDDMYGDIDRGVYIVRGENVVLLGELDLDKEYDAVKQLRRMPAEELYPLAKLHEEEKKKNIREKGKYLHSVGFSVDGGHDDLY

SEQ ID NO: 1876 - protein, 559 aa, Zea mays
MMSPASERSLIIQSDDDDDARSGHDVEEPEPEQEQDSDSSSSSSSCATPRRGPSSPPYIQQWPQSYRQSIDILSSVQSPNLSFLGTPTLSRLSNSFLAITDSFRSKAPETISSFIKPLLGPTPSDDQQRQHEGTRKSSEYLVPSRRSSLQQIPEDQKPPVGGHGASHDQNCSYTQGVMNGINVLCGVGILSTPYAIKQGGWIGLAILCIFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGFFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCACFLAILKTKVGWHQIAACSFIIVVGVCCAYVGTYSSLSKIIQNYA

SEQ ID NO: 1877 - protein, 642 aa, Cryptococcus neoformans var. neoformans B-3501A
MPRIRKKTSNRQNTRDRAKITKKAAEQKRKDRKASKKDQTWKSKKKADPGVPNSFPFKDQVLAEIAEEKRKSEEDKIARREAAKAQKSTGAEDEADTPGVSSLGRTVLNRVPLTATSAAVVTPTEDSDIPELIDTALPTLQEALDRADVICEVVDARDVLGGRSGYIERLVKEAEGRIILIINKIDLVPREVLQSWVSQLDIPTFLFKSALPVPPTPSSSRNPGPSFFLEPSVILGREQLIAAAKKWSAEKKKSRKSDEPLVLALMGLPSVGKTSILNSLLPSTANKSRHVVAPLIPSGQSAKSLQPTTKSPVEVEIDVDGLKIKVIDTPGWEPVEDEKDEDEDEEEDEQIPEKWDRLEAKLSGDLLRRNLGRVDRVKDVFPLVSYIVERSNHQDLMLAYNIPFFEKGDLEAFLTGLARAQQRIRKHGEPDLEGAARVLLRDWAHNNFPYYSLPSSTSASKMDVDASKAIDKYDMTAILEKCRGKKEMKKESSKGMIRFKGGEIDEREIILDDDYTAMMTVTSDDDEQEEIDDEEDIDDEDEDEDEDGIELASASDDEPVIIGSDEGEVLELSEGKEPSESESSPEPEPRLPSPSSSKPKKRRISEASVAPAKKAKRVSFARNVPDGEERNIRGGKKGKGRK

SEQ ID NO: 1878 - protein, 434 aa, Fusobacterium nucleatum subsp. nucleatum ATCC 25586
MVFKNSIDLYKKAVELIPGGVNSPVRAFKSVNREAPIFIKKGQGAKIWDEDDNEYIDYICSWGPLILGHNHPKVIEEVKKIIENGSSYGLPTKYEVDLAELIVDIVPSIEKVRLTTSGTEATMSAVRLARAYTQRNKILKFEGCYHGHSDALLVKSGSGLLTEGYQDSNGITDGVLKDTLTLPFGDIEKVKEILKNKDVACVIVEPIPANMGLIETHKEFLQGLGKVTEKTGTILIFDEVISGFRLALGGAQEFFGITPDLTTLGKIIGGGYPVGAFGGKKEIMDLVAPVGRVYHAGTLSGNPIASKAGFATISYLKENPNIYKELEEKTNYLIDNIEILAKKYSVNVCVNSMGSLFTIFFVDIDKVENLEDSLKSNTENFSIYFNTMLENGIVIPPSQFEAHFLSMAHTKKELNRTLEVIEMAFKKIGEKSGK

SEQ ID NO: 1879 - protein, 410 aa, Hordeum vulgare subsp. vulgare
MAAMWSPIIGLLLLLLPLGPSSAIKFPLEGNVYPVGHFYATLNIGEPAKPYFLDVDTGSNLTWLECHHPVHGCKGCHPRPPHPYYTPADGNLKVVCGSPLCVAVRRDVPGIPECSRNDPHRCHYEIQYVTGKSEGDLATDIISVNGRDKKRIAFGCGYKQEEPADSPPSPVDGILGLGMGKAGFAAQLKGHKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTLSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 1880 - protein, 542 aa, Geobacter sulfurreducens PCA
MKIIVTDEVAQEGLALLAQDPRVELDVKLGLKKEELLAIIGDYDVIITRSGTTVNRELLDAGKKLRLVARAGVGIDNVDVDYASSRGVIVVNAPFGNTNSAAEHAMALLLSFCRNVTRANGSLKSGEWKRAPFTGYELKGKTAGVIGLGKVGGRVATRLKAFECDVLACDPYIAVKRAHDLGVKLVSHDEIYKNCDIITVHTPLTDETRNMIGERELAMMKDGVIIVNAARGGIIEEAALLKYLESGKVAGAAVDVFSEEPPKSEYLKKLIGHERVVVTPHLGANTFEAQVNVAVDVSREILNYLDDQPLENAVNIPRFDLALMDQMRPFLNLMNTLCEFGIQLLDANISKIVFGFSGSIAHYDCTPLTVCGLASILNRMVDQDVNMVNASLIAEGMGIVVEESKTTHADAFSNLITIVVEGEGGKRRTISGTLFEGLPRIVRLRDYSMDFAPEEHMLLLHYADRPGMIGKIGTIMGQHEINIASMNLGRSEKKGEAMVILSLDSAVPPQVLEEVRAATDATFIKAIHMPGARCSRSCGCTA

SEQ ID NO: 1881 - protein, 457 aa, Sulfitobacter sp. EE-36
MTDIIKCKAAVAWAVNEPLSIEEIDVMPPKAGEVRIKIIASGVCHTDAFTLSGEDPEGLFPVILGHEGGGIVESIGEGVTSVAVGDHVIPLYTPECGECKFCKSGKTNLCQKIRETQGRGLMPDGTSRFYKDGQPILHYMGCSTFSEYTVLPEISLAKVNPDAPLEEVCLLGCGVTTGMGAVMNTAKVEEGSTVAIFGMGGIGLSAVIGATMAKASRIIVIDINESKFDLARKLGATDFINPKDHDKPIQDVIVEMTDGGVDYSFECIGNVNVMRSALECCHKGWGESVVIGVAGAGQEISTRPFQLVTGRVWRGSAFGGVKGRSELPDYVERYMNGEFKLNDFITHTMGLEEINEAFDLMHEGKSIRSVIHFGEGSSAGRAVCRRGRGDLEALLESLKSAHLAPLCIPDQRCHSVEPMRHLGERREQEKRQHRAEMYNQKTRHPAGAPCRIEQQTR

SEQ ID NO: 1882 - protein, 1365 aa, Aspergillus nidulans FGSC A4
MGVYLFSSSLWATLLLAILIYRLVRITYNLYFHPLSGIPGPSAWAASRLPFVYALIRGTIIQDFQKLHEQYGPIIRIAPNEVTFAHPEAYTDIFQPRPEKSQGQFLKDPLWWARQPGHPDSLLSVINPERHAQMRRVLSPGFTARALRKQEPFVQKYVNLLVAQLQDLVSKSPSAHINMTPWFNYTTFDIFGDLGFGESFDCLQHSRYHPWIALLFDSVKAAGFVIATRYYPLIEAVLLKCVPPSMRKIQRDHYQQIVDKVQRRLGWELQRPDFMSYVIDERGGLRLDAGELYATFMILTTAGSETTATALTGTLNYLVNHSPESLQRLENEIRGAFSGLDAITLDAVRNLPFLNAVIQEGLRLCPPIPWVLPRLVPQGGSMICGTWLPGGTPVSIQAYTLNRDPTLFNRATSFLPERWLASSTSDSSSCFFNDQRQVVQPFSTGPRACLGQHLAWAEMRLILAKLVWVFDFGAIDGQGVNWEDLRTYLLVERKPINAVADVAHLWPGALEGVQACTVYWYPSSITESHPQKVHRECIDYLPALVLKPCVSFCLPYPIICSTSFTFTPSRKGEQRRGSHTSLGTRGTLSHHLQYQYHYRLYFPPLAKFPGSRIAAATGCHDPDFYNELYVTESKRRTNHYDVFCKGIEFEFDGSHLLTVDHTLHLKRRKPLEPFFSRKSIQKPQPTLAEVTLKFEQPLRASSGTGMVVQLDHACAAFSGDIIAKICLDDVAEGDRFLDHPEFAPYCGTMLADHDRIFSQTHNNSKPVTSLFPHVAQSDMPESDRSPERLAKEAQVLLGGGTASTARTIAFASFYIADSPDIRSSLRDELWETMAGWPERVPSGLSSRDLPICRPLLKSLSGIYCLYESPSTMMAIDPERAGTTEKAWTRFLQLAAHPRSRPLRTLEAYLPSRVIDAGELIWFGTLTFAMAISIRNEELELCLKLARPGYAAVSLTNDNYTWNKNCEEAQRLGIDYVYNAVWVIMQEQSVGEEEAKRVCAEQIRYYIKQYFQVVEQEKRCWWLSDDLKTYLEAVKATPATAREMGAQFSQFFPPHPTFTSENLSEQQGKVFLITGGTSGIGLELAKILYCHGGKVYITARSEEKAEKAIQEIQASAPNHHGELDFIILELDDLRSIKASVEAFKAQESKLDILWNNAGVSQPPLGSVSKQGHELQLAVNCFGPFLFTQMLLPLLDAAVASSVSPGSVRVIWTSSQVAELSSPDEGIIMSELTSPPKDNVRNYVNSKTGNWFLSAEFARRYGSRGIVSVALNPGAANTNLLKDARLMKILSYPLLHRAGLAAHTELYAGFSPAISLQNNGCYVIPFGRIHDQVADALLSAMKVAEDGGSGRAKEFWEFCEARTKDYL

SEQ ID NO: 1883 - protein, 357 aa, Geobacter sulfurreducens PCA
MYVVILAGGSGTRFWPLSRKAHPKQLMSVFGGKSMLQRTVERVIPLNPKRILVVTNHLQADETRRQLEYLRGIRIDVIEEPMGRNTAPAISLAATLIARHDPEAVMAVLPADHYIADEDAFCAALQRGREPAMNGWLVTFGILPDRPETGYGYIEADRHLRGDGPYPVKRFVEKPDAATAAQYLAAGGFYWNSGMFMWRADVILDRIANHMPDLARAFAGIAFDADIWEPADLAPQIEAVYAMVSGQSIDYGVMEKADNVLVLPASFGWSDVGSWSALPGLIAPDGDGTVRLAGETVISVDSAGCVVRGEKLVALVGVRDLVVVDTPDALMVCARDGAQDVRKIVEELERRGLKQYL

SEQ ID NO: 1884 - protein, 525 aa, Cryptococcus neoformans var. neoformans B-3501A
MASPPIPTFQNGRSICLATSTATLVEPTERTPLLKEVQNGTGKPVSPPQYDHEEEGAEGKEVELLVPGKSNFSQTLLNVLGDLIGTGLLACPIAIAHAGWVLGPLLLCLVSGITLWTLKILIRIIEKDRSMRNFADVARYSLGARAEKWTTAMFVSDCCIWIIALIVLFSDSFEVVLPMFTSNQWKVIGLVVIVPLNFIPLRFLAWTSALGITSTWTLVAILIFTGLATPNSPGSVLDPAPTDLWPAHGLVKLGLSFGLLISGFGGHFLVPNLIRDMKHPEQAERVCEVGYGICIIVYALVSVFGYLMFGRDVSDEISRDLAKTSAFSPLMAQIAVWMVAINPLTKLPLGLRPLTDIVYSALRLQSTTFVPKIHVSYAESSEPDEEDDELCSPITSNSPTVLSSFSASTISAATSITLENEHYSHALSTAQRRHDRREQLKAIFRALITIVLLGVFVLGALAFPSFETLMSIMGGGMSIITCILIPIAAGANIWGWRWYSILLFGLSAVVCVIGVVCACLNNGDA

SEQ ID NO: 1885 - protein, 162 aa, Lycopersicon peruvianum
HGLWPDIKGTILNNCNPDAKYASVTGGKFVKRNKHWPDLILTEAASLNSQGFWAYQFKKHGTCCSDLFNQEKYFDLALILKDKFDLLTTFRNKGIIPKSTCTINKIQKTIRTVTGVVPNLSCTPTMELLEVGICFNRDASKLIDCDQPKTCDTSGNTEIFFP

SEQ ID NO: 1886 - protein, 697 aa, Geobacter sulfurreducens PCA
MQNGTLQCSTEAFVEFQILRDMEILFGLAVFTVVLLRRLMFPSIIGFLATGILAGPSALGLIKNTHQVEQMAEIGVVLLLFTIGIEFSLKELMRIKHLVFWGGGMQVGVTIAIVAALAFAFGIPPSQATFFGFLVALSSTAILMKLLMDKGEMDAPHGKVALGILIFQDLCVVPLMLFTPFLAGAGNGWTGILLVSLKAVAVVVVAHFGSRFLVPWIFEQVVKSRSRELFILTIIFIGFGTAWLTAQVGLSLALGAFIAGLAISESEYSHQALGDIIPFRDAFMSLFFISVGMLLDLSVLVRQPVLVASLVLTILVVKFLVTGGAAMALGIPARVGIVTALALAQIGEFSFILSQTGMQYGLLSKDMYQVFLAASVATMALTPLCLKVGAPVASYLVGVLPTPLTRGRGVLRGKEKKLSLTDHVIVVGYGVNGRNLSRVLKVQKIPHVVIETNPFTVSTEKSKGTRIMFGDATRPEVLTHSAVERARSIVIAISDAAASRRVVALARQMSPTIHIIVRTRYIAEMEPLYKLGANEVVPEEFETSIEIFSRVLRNFLIPQDQIDQCVGEIRRGSYDMFRTMSRRHSHAVGIAGYLSGAEIATFRVKKGAPIEGESLRQGTLRTRSGATLLVIKRGDEVTPNPDPVWVLQEGDIVLLLGTPEQLAAASRLFEAPAVEGGPVAPPPADSSRHDTSNRRDQ

SEQ ID NO: 1887 - protein, 466 aa, Oryza sativa (japonica cultivar-group)
MNLAGFLATPATATATRHEMPLNPSSSASFLLSSLRRSLVASLRKASPAAAAALSPMASASTVAAENGAAKAAAEKQQQQPVQVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 1888 - protein, 516 aa, Triticum monococcum
MAMAMELLVSYPEVLLAIVSYLCLSLLRLILRCQKSGIPVKWPVVGMLPFLVRNRHHIHDKFAHALHEAGCNLMFTGPWFLDMDFFLSCDPATVNHCLSANFNNYPKGGEFAEMLDFLGNGIIVSDSESWEYQRHMAMHILGSRAYRTFSMSTITTKAGATLLPYLDGMARRGSEVELEGVFMRFLLDVTYTSAFATDLDGLSMSLPIPAFGQATKTAEEAVMFRHTVPRSLWKLLRALKVGSEKKMAGARVVIDRHIYQEIAKRKAHLLQGEEGDVLSMCIKWPMDPSMSEQHKTQFLRDTLLGFIFAAKDLTAVTLTWFFYMMCNHPHVEARIIEEITALLQLQSTTMPAGSLSVLDGDMLRQAVYLQAAFLETLRLFPASPFEEVEAVNDDALPNGTRLSKGTRIVFSLYAMGRLEGIWGKDCAEFRPERWLSKSGRLRHQPGYKFPAFNAGPRSCVGKDLALGSMKMIAASIIYNFKVQLVEGHAVMPGSSIVLHTRNGIMVSLKRREAAAA

SEQ ID NO: 1889 - protein, 236 aa, Burkholderia vietnamiensis G4
MSFKSVSSAPADAFADLPLLESEPVPPRIAAALDALRAGRAVVLQDDHDRENEADLIVAAERITPETMALLIRECSGIVCLCLTDDKVRALELPPMVQTNESRNGTAFTVSIEAREGVHTGVSAADRVTTIRAAIADDAKPYDIVRPGHVFPLRAQPGGVLARRGHTEGTIDLSILAGLRPAGVLCELMNPDGTMTRGDDVERFAQQHGLPMLTIAELVEFREALAAARERCCEPA

SEQ ID NO: 1890 - protein, 619 aa, Pyrococcus abyssi GE5
MDELVKALERAGYLLTPSAYYLLVDHFKEGKFSLVELVKFAKSKGVFIIDGDLAYEFLQFLGLGVPQEIKESYISTGEEAEKTVESQETRASELEEGGVSQVSSGELQELKEESPEISTTEEEIGGLELVQSSISTGSEVEYNNGENGESVVVLDKYGYPILYAPEEIGEEKEYSKYEDVVIEWNPSVTPVQIEKNYEVKFDVRQVKLRPPKVKNGSGKEGEIIVEAYASLFKSRLSKLKRILRENPEISNVVDIGKLNYVSGDEEVTIIGLVNSKRETNRGLIFEVEDKTGIVKVFLPKDSEDYREAFKVLPDAVVAFKGFYSKKGIFFANKFYLPDVPLYRKQKPPLEEKVYAILISDIHVGSREFCEKAFLKFLEWLNGHVESKEEEEIVSRVKYLIIAGDVVDGIGIYPGQYSDLVIPDIFDQYEALANLLANVPEHITMFIGPGNHDAARPAIPQPEFYKEYAKPIYKLKNAIIISNPAVIRLHGRDFLIAHGRGIEDVVSFVPGLTHHKPGLPMVELLKMRHLAPTFGGKVPIAPDPEDLLVIEEVPDLVQMGHVHVYDAVVYRGVQLVNSATWQAQTEFQKMVNIVPTPAKVPVVDVESARVVKVLDFSGWC

SEQ ID NO: 1891 - protein, 273 aa, Arabidopsis thaliana
MTSNLIQPPSMAASRGAISRRTGNVKVLVSFTSSNSKTLSFSDNSFRLRPMFIGKVTEQSSCSSLNEQQQDEEQEQEEEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYLDEDLQVGRDGKGNVFVLERIEKP

SEQ ID NO: 1892 - protein, 280 aa, Prochlorococcus marinus str. MIT 9313
MASNHSMPCSLGVIGLGRMAQALVLPLLKQGELAPQQLVAVVGCGASVERLADQLPIGLRLKAADDPTAAEAWMAPIQLLAVKPQQLDQIAASAARLKKTADGPHLLISVLAGVSLARLQQAFPAHACVRAVPNTPALVGAGLTGLSWGEGVTPEQRLAVERLFLPVSEVLELPESQLDAFLALTSSGPAYVALVAEAMADGAVAAGLPRSLAHHLAHRTLAGTAALLKQQKLHPAELKDMVTSPGGTTIAALRKLERAGVRSALIEAVVAAAQRSRELA

SEQ ID NO: 1893 - protein, 171 aa, Glycine max
NLDPLAYTVALQGIRIGERKLNISPAVFRADAGGSGQTMLDSGSEFTYLVNEAYDKVRAEVVRAVGPRMKKGYVYGGVSDMCFDGNAIEIGRLIGDMVFEFENGVQIVIPKERVLATVEGGVHCVGIANSDKLGAASNIIGNFHQQNLWVEFDLVNRRMGFGTADCSRLSN

SEQ ID NO: 1894 - protein, 263 aa, Photobacterium sp. SKA34
MKKITIADLNNWKKLGEKFASITAYDASFSKIFEEQGLPVIIVGDSLGSVIQGKPTTLDVSIDELVYHTKCVRAGSPNAFIISDLPFMSYHTPDSACESAAKLMKAGANMVKIEGGSWLTSTVKMLTERAVPVCAHLGLMPQAVNLYGGYKVQGKTEEQATEMLETAKELQRAGAQILVLECIPAKLARQITLELHIPVIGIGAGNDTDGQVLVMHDILGVSANYIPRFSRNFLAETGSIEAAVTKYIDEVKQQTFPEEKHSF

SEQ ID NO: 1895 - protein, 268 aa, Thermoanaerobacter tengcongensis MB4
MAIAFITGATDGIGREVAKRLAFHGYDVIIHGRNELKLEKVADEIRDLTGKSVFKIKADFSSLKDLKKLVKEIKDNFSKVDLLLNNAATFEKERKVTEEGFERTFMVNYLAPFYLTISLINEGVDIKYVLNVSSMAHASSIEFEDLQLEKGYDGYKAYSLSKLYITLFTYYLAEMLKGKIYVNCLHPGVINTKLLMENWGAIGASIEEGAKNVIDAIKYIEAHNVTGVYFDNGKPSKSKPITYDREVQRKLWEKTLKLLKINERDLKF

SEQ ID NO: 1896 - protein, 480 aa, Idiomarina baltica OS145
MSSLTKQDCFIEGHWVPTEKRFAVTNPANGEVITEVADADGDLTKRAINAAEVALAKWRATSTQERAALLRKWYQAIMDNKQALGELMSAEQGKPVPEAVGEVEYGASFVDWFAGEAERINGDILPITDNSKRVMVIKQPVGVCAAITPWNFPNAMITRKVAPALAAGCTIVVKPPQLTPLSSLALAQLASEVGIPDGVINILPTTDSKTVGEILATSKQVRKLSFTGSTGVGKILMKQCAENVKKISLELGGNAPFIVFDDADLDAAAEQLMACKFRNGGQTCISANRVLVQDSVKEEFIKKVVSKVKALNVGPGDKEDVDLGPLIDQDAVDKVQRLVISAKSDGAEIEEGGSVMTDLGDLFYAPTVISGVTQDMEITQEEIFGPVIAISSFETEEEAIQQANDTPFGLASYFAAKDTARIFRVSEGLEYGMVGVNTGGISHAYNPFGGIKESGIGREGSKYGIDEYLEIKTITLGGLE

SEQ ID NO: 1897 - protein, 221 aa, Enterobacter cloacae
DLLDAEYMAYMLKYDSTHGRFNGTVEVKDGHLVVNGKTIRVTAEKDPANLKWNEIGVDVVAEATGIFLTDETARKHITAGAKKVVLTGPSKDNTPMFVKGANFEKYAGQDIVSNASCTTNCLAPLAKVINDNFGIVEGLMTTVHATTATQKTVDGPSHKDWRGGRGAAQNIIPSSTGAAKAVGVVLPELNGKLTGMAFRVPTPNVSVVDLTVRLEKAASYE

SEQ ID NO: 1898 - protein, 404 aa, Frankia sp. EAN1pec
MRAVVWHGVGDIRLDTVTEPKIEQPTDAVVRITTAAICGTDLHFVRGTVPGMKPGLIIGHEGVGVVEEVGQSVRNFRRGDRVLLSAVLGCGSCTYCRSGYFAQCDDINPYGRRTGSAFYGAPRDNGSFDGLQAEYARVPYAHTNLFRLSDSISDDQAIPLSDIYPTGYFGAVIAEVSDGDVVAVWGCGPVGQFAVLSSFQRGAARVIAIDGHADRLDRAQALGAEVVNFNEEDPVEAILDLTRGIGPDRAIDAVGVDAESPKSGPAAARAREQDDQHREELRQIAPETHAHNGHWKPGDAPTQAHSWAVESLAKAGTLGIIGVYPPTDRFFPIGTAMNKNLTINMGNGNHPRYIPKLLDMVESGVVHPQKMVTQHEPMRDVLAAYEEFDLRRPGWLKVALDLTS

SEQ ID NO: 1899 - protein, 102 aa, Arabidopsis thaliana
  misc_feature (12)..(12): Xaa can be any naturally occurring amino acid
  misc_feature (32)..(32): Xaa can be any naturally occurring amino acid
  misc_feature (38)..(38): Xaa can be any naturally occurring amino acid
  misc_feature (44)..(44): Xaa can be any naturally occurring amino acid
  misc_feature (47)..(47): Xaa can be any naturally occurring amino acid
  misc_feature (49)..(49): Xaa can be any naturally occurring amino acid
  misc_feature (61)..(63): Xaa can be any naturally occurring amino acid
  misc_feature (65)..(66): Xaa can be any naturally occurring amino acid
  unsure (1)..(102): unsure at all Xaa locations
WLSSMLSSAAGXTSPAQATMVAPFTGLKSSAXFPVTRXTTKALXTPXAXNGGRVSCMKGVXXXIXXKKFETLSYLPGPAGQASRPFLQQGGFLGSGYLFTLF

SEQ ID NO: 1900 - protein, 253 aa, Borrelia burgdorferi B31
MVGTFLGTGASSGVPMLNCSCKVCTSSYSKNKRLRSSFFLESSSGIKLLIDTGPDIRQQLLREKIDRLDLVLYTHEHYDHIMGFDDIKFYTRCAPLNIYARDTAMAHIRNAFPYNFTSKPSLSGKADIIANVIRDFEPFFFKSLKIVPIPLIHGDIISLGYRVGNLAYLTDVKFIPEASYDYLKNLDLLIIDAMRIKPHPAHLNFSEAFCVIKKINPKISYFTHIAHDIMHEEFDYLEKDNIYLAYDGLKIYI

SEQ ID NO: 1901 - protein, 279 aa, Bacillus cereus G9241
MSIQNISFLGAGSIAEAIIGGLLHANVVKGEQITVSNRSNETRLQELHKKYGVKGTHNKKELLTDTNILFLAMKPKDVAEALTPFKEYIHHNLLIITLLAGVSTHSIRNLLEKDIPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 1902 - protein, 425 aa, Xylella fastidiosa Temecula1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 1903 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 1904 - protein, 331 aa, Rhodobacter sphaeroides 2.4.1
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 1905 - protein, 496 aa, Triticum aestivum
MTSVLPRRVSTIIPEPDEITDDLMQLASSYEASGGRRLEGSNITRRIRSSQENNAKFVSAFCQSNCGDVSPNVLGTFCIDTHLPCDFNHSTCNGKNELCYGRGPGYPNEFESTRIIGNRQFLKAVDLFNSASEELQGKFDYRHTYLDFSQLKVSVSTSTGGPQVVKTCPAAMGFAFAAGTTDGPGAFDFKQGDDKGNPFWRLVRDLLKTPGKEQVECQAPKPILLDTGEMKEPYDWAPAILPIQIIRIGQLVILCVPGEFTTMAGRRLRDAVKNVLISGSNGDFGTNIHVVLAGLTNTYSQYVTTFEEYQIQRYEGASTLYGPHTLSAYIQEFQKLATAMVENKEVPTNIQPPDMLEKQIGLLPGVMYDSTPPGVHFGDVSSDVAANSNFRKGTTVNATFYSACPRNDLLTEGTFALVEKLNGNDWIPVYDDDDWSLQFKWSRPSKFSPRSFATLEWTIPEDAASGVYRLRHSGASKPLIGSIKHFTGTSRAFAVR

SEQ ID NO: 1906 - protein, 327 aa, Pseudomonas fluorescens PfO-1
MLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 1907 - protein, 127 aa, Triticum aestivum
MRTNNYCMHTYPEKVDDSSLLGGYRKKKKKKNGIMFLSGAQSELEAPMHLNAMTKSANPWHVSFSYARALQNSVLKTWQGQPENIEAAQKALLVRAKANSLAQLGSYTGEGESDEAKKGMFQKGYTY

SEQ ID NO: 1908 - protein, 751 aa, Triticum monococcum
MEFRNSDEAWAFWLTYSGQKGFEVRKRYTNRRPTDGKVTSCRFVCANEGHRWQDKRDHLTKCPRAETRTECQVFMNLKTDRKKGNLKVSELSLEHNHTLHLPETLHLMVSQRKISEVQSFEIDTADAAGIGPKAAQELASRQVGGPLNLSYTLRDRKNYLRTKRQREMAYGEAGSMLKYFQDKVAENPSFQYALQMDCEEQIANIFWADAKMIMDYAHFGDVVSFDTTFGTNKESRPFGVFVGFNHFRETVVFGAALMYDETFDSFEWLFKTFLKAHNGQHPKTFYTDQDTAMGNAAGEVFPETWHGLCTFHIMQNAIKHLHEEKNEENNEEKTAGKNGEQNEGKNEDKNEGKKQKKHEGKKKKKNEGKKIEKNEEPSILSDFSACMFEYEDMIEFEQKFDLMREKVSKQTWLDSIYKVKEKWAECYMKDVFTLGMRSTQLSESLNNDLKIHFKSDFDIIRFFKHFERVVQGKRNNELDSEFDSRKKLPKLCMRRPPPMLVQASKLYTHVIFEAFQGEFERSLAACTKALDGNNEYLVGDFTYEEEYKVTGDPLKETAVCSCRQFDRIGILCAHALKVLDLMNIKSLPPQYVLKRWTREARSGTIKDNMGRNVMENPNMAAMLSYRFVSHKFHNLAHRATNFPEAITLVDNTLDILGKQVEEIINGCTSTSGDAGIVSADASAPNPNDLLSTARLKKKEVQTKTSRRKRNWLDKKHKAMKKRQSKATSQVGEEACNDGAHVQSAHISMVCC

SEQ ID NO: 1909 - protein, 305 aa, Candida glabrata CBS 138
MSIVSLLGIKVLNNPAKFTDPYEFEITFECLEPLKNDLEWKLTYVGSSRSLEHDQELDSILVGPVPVGVNKFVFTADPPSAELIPASELVSVTVILLSCSYDGREFVRVGYYVNNEYDSEELRENPPQKVQVDHIVRNILAEKPRVTRFNIVWDNENEADIYPPEQPGVDEEDEAEEEEEEEEEEEEEEEAEDEEEEVEVDVDGEVDLENEDDKTDKIIDGEEAEDDDDGEEIGDEEDEDDEDDEEGDAQTETAAPNDKTTDTEKEVRLHDRDEDEKADSSKKLKTENDTAKEPDTAPTPQDSTN

SEQ ID NO: 1910 - protein, 353 aa, Glycine max
KFVIIEISEEILVDTIQVANFEHHSSNLKAFELLGSLSFPTDVWVFFGNFTASNVRHAQRFVLQEPKWVRYLKLNLQSHYGSEFYCTLSAVEVYGVDAVERMLEDLIHTQDNLYAPGDGDADKRTVSPHPNPPESEDVHQNNFGDPASDISSANHEKVNSNVPDPVEETHQQVGRMPGDTVLKILMQKVRTLDLNLFALERYMEDLNSRYVNIFKEYSKDMGGKDILIQNIKDGIRNLVDRQDAITKGASDLKSWKSHISMQLDHLLRDNAVLRSEVNEVRRKQTSLENKGVLVFLVCCIFSLLVILRLSLDMATSVYRVVLSVNRTDCSRKFCAVSSSWFLLLLNCIIVIFK

SEQ ID NO: 1911 - protein, 482 aa, Treponema denticola ATCC 35405
MSELIFEKSVKGHKFAEAKLTVPEYKLDSKYLRASDAKLPEVSELEFVRHYMELSKRTHGVDNGFYPLGSCTMKYNPKLNEEVADLPNFTNIHPLQPEHTMKGCIEAMGDLGKKLGEITGMDAFSLQPSAGAHGEFTALLVIRAYHEKRGDHARNKILVPDSAHGTNPASAAMVGCEIVNIPSDKDGNVDIEELKKTVGNDTAALMLTNPNTLGLFETHIKEIAEIVHKAGGLLYYDGANLNAIMGRLRPGDMGYDIVHLNLHKTFSTPHGGGGPGSGPIGCKKFLEEFLPVPVVTGSDGSYKLDYNRPDSIGRVRNFYGNFLVFLRAYAYILTLGSEGIRESSGYAVLNANYLKKKLEKEYDVAFDRICMHEFVLTLEKIKEETGVSALDIAKGLIDDGIHPPTMYFPLIVHEALMFEPTETESKSTLDFTAEVMIKLKKEAYSNPEKLHGYPYTRPIGRVDETKAAREPVLRYKACCCCK

SEQ ID NO: 1912 - protein, 158 aa, Candida glabrata CBS 138
MAEKKEDSKTKITEGEADLYLDQYNFTTTAAIVSSVDRKIFVLLRDGKLFFGVLRTFDQYANLILQDCVERIYVQENGEYAEEDRGIFMIRGENVVMLGEVDIDKEDEPLKSLKRIPFEEAKKLKQLKEEKRCKEEFATGKELARYGLSHDFHKQDLY

SEQ ID NO: 1913 - protein, 158 aa, Brassica napus
  misc_feature (74)..(74): Xaa can be any naturally occurring amino acid
  misc_feature (143)..(143): Xaa can be any naturally occurring amino acid
  unsure (1)..(158): unsure at all Xaa locations
KTPQLKFICRRNLILSINIDKNTERDLQLSVESAARRLSEEKIEVIDFSSHVDVTTEPGHYVIFWEVSGETEEXVLQDCCNCLDRGFIDAGYMSSRKCKTIGALELRVVERGTFRKVQEHFLGLGSSAGQFKMPRCVKPSNGXVLKILCENAVSRFFS

SEQ ID NO: 1914 - protein, 434 aa, Treponema denticola ATCC 35405
MSNYIPHSAEETKEMLDLIGVKSIDDLYSFDNKGCKKVDIGEGKTQAEVEKFFQNLSSENTVFKSILRGAGAYNHYAPAAVRHMASREEFLTAYTPYQPEMNQGELQAGFEYQSMICELTGMDVSNASVYDGGTAVADAIVMSLGRKQNKVLISECVEPSSIEIAKTYLKHSGVEFVMIPRDGYKTDVSKIKGLLDESVGAVVMQQPNRFGTIEDCEAVGKLVEGTKTQFVMSCNPISLAILKTPKECGASIALGEGQALGLPLGAGGPYLGFLSTIEANMRKIPGRIIGQSTDHDGRRAFVLTLQAREQHIRREKASSSICSNQALCALRASMFMTAYGKEGLKTVAKVSVSNAHYLADELKKIGLTVKNNGEFFHEFVTDGKGKADAILSNLEKNNILGGLKICDDSILWCATDVLCKCELDKAVKIIKEVL

SEQ ID NO: 1915 - protein, 974 aa, Anabaena variabilis ATCC 29413
MVSYASIRQSSDEADSTVDASQKLDARKQDLNNFIQRHIGPSSADIQHMLDVLGFSSLDDLIEKTVPSTIRLHKKLQLPTAQTEYAALAKLKQIASKNQVFRSYIGMGYYDTITPPVIGRNILENPGWYTAYTPYQPEIAQGRLEALLNFQTMIIDLTGLEIANASLLDEATAAAEAMSMSYGVSKNKANAYFVSHDCHPQTIDVLQTRAKPLGIEIIIGDHQTFDFQKPIFGAVLQYPASDGTIYDYRAFIETAHAQGALVTVAADPLSLTLLTPPGEFGADIAVGSTQRFGIPLGFGGPHAAYFATKEEYKRQVPGRIVGVSKDVNGKTALRLALQTREQHIRREKATSNICTAQVLLAVMASMYAVYHGPEGLKQIAENIHQLTVTLAEGLKRLGYKISSEHFFDTLRVELGTNNLETILAGCQARNINLRIFDETAVGISLDETTTPEDLIDLWQIFAGEDNLPFTPEELISSLNLPLRSSSYLTHPVFNRYHSETELLRYLHRLETKDLSLTTSMIPLGSCTMKLNATSEMIPVTWEEFGRIHPFAPLTQTRGYQILFQQLEAWLAEITGFAGVALQPNAGSQGEYTGLLVIRQYHESRGETHRNVCLIPTSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVRFLPGHPVLGSGKNPQNIGAVAAAPWGSASILVISWMYIAMMGADGLTQATKVAILNANYIAKRLETYYPVLYKGQNGLVAHECILDLRALKKSANIEIDDIAKRLIDYGFHAPTVSWPVTGTIMVEPTESESQAELDRFCDALIAIRQEIAAIEAGKMDTHNNLLKNAPHTIESLIVGEWLHPYSREQAAYPVSWTREYKFWPSVGRIDAAFGDRNFVCSCLPMEAYN

SEQ ID NO: 1916 - protein, 221 aa, Escherichia sp. Souza-57
DLLDAEYMAYMLKYDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARIEKKATYK

SEQ ID NO: 1917 - protein, 402 aa, Frankia sp. EAN1pec
MAAMSRISHRIAGIAPSATLAVDATAKAMRAAGRDVIGFGAGEPDFPTPEHIVAAAEKACREPRMHRYTPAAGLPELREAVAEKTRRDSGLVVEPSQVLITNGGKQAVYQAFATLLDPGDEVLLPAPYWTTYPEAIRLAGGVPVDVVTGPEAGYRVTVEQLEAARTPRTKVLLFCSPSNPTGAVHTPEEVRAIGRWAAEAGIWVLSDEIYEHLVYGDARFASMPVEAPELADRWVVVNGVAKTYAMTGWRVGWLIGPLDVVKAATNLQSHATSNVSNVAQAAALAAVAGPLDAVHEMRTAFDRRRKTMHEMLVQIPGVRCPLPDGAFYAYPSLEGVLGRTLRGRTPATSADLCQFILEEAGVAIVPGEAFGTPRFARLSYALGDTDLVEGVRRLGALLSEAV

SEQ ID NO: 1918 - protein, 221 aa, Escherichia sp. Souza-207
DLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYQ

SEQ ID NO: 1919 - protein, 375 aa, Acidobacteria bacterium Ellin345
MTLSQPELLRYSRHLSLPEFGLEAQERLKQTKVLCIGTGGLGSPLAMYLAAAGVGTLGLVDFDIVDYTNLQRQIIHTTPDVGRPKVESAAEKIDVLNPFVNVVPINAKLTSANALELFSQYDIIADGTDNFATRYLVNDACVLTGRPNVYASVFRFEGQASVFATKSGPCYRCLYPEPPPPGTVPSCAEGGVLGVLPGLLGIIQATEVIKVACGIGQPLIGRMLLVDASTMKFQELRLKRDYQCPACGTRTLKELIDYDQFCGIRGQESSVAGDITVEELKRRLDAGEKPFILDVREPHEYQIANLGGHLIPLNDLPKRIGELDPTQEIITHCKMGGRSQQAVDFLRQQGFKNAKNLTGGINAWSEKVDPKIPKY

SEQ ID NO: 1920 - protein, 221 aa, Escherichia sp. Souza-273
DLLDADYMAYMLKYDSTHGRFNGTVEVKDGHLVVNGKKIRVTAERDPANLKWDEVGVDIVAEATGLFLTDETARKHITAGAKKVVLTGPSKDNTPMFVKGANFDKYEGQDIVSNASCTTNCLAPLAKVINDNFGIVEALMTTVHATTATQKTVDGPSHKDWRGGRGASQNIIPSSTGAAKAVGKVLPELNGKLTGMAFRVPTPNVSVVDLTVRLEKAASYE

SEQ ID NO: 1921 - protein, 343 aa, Photobacterium sp. SKA34
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAINVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQEGFDVMRSGQSGKVILDWE

SEQ ID NO: 1922 - protein, 70 aa, Arabidopsis thaliana
  misc_feature (12)..(12): Xaa can be any naturally occurring amino acid
  misc_feature (33)..(33): Xaa can be any naturally occurring amino acid
  misc_feature (36)..(36): Xaa can be any naturally occurring amino acid
  misc_feature (52)..(52): Xaa can be any naturally occurring amino acid
  unsure (1)..(70): unsure at all Xaa locations
TITSSILSSATXISSPPQPTMVSPFNRLKSSPXFPXTLNANNNITSITSNRXRVHCLHVSPPIVKTTSNT

SEQ ID NO: 1923 - protein, 466 aa, Pyrococcus abyssi GE5
MINMTKWDEIKKYTSKKVDENLKIVELDEEYLPRAIGFKYYPLVIERAKGSRVWDKDGNEYIDFLTSAAVFNVGHAHPKVVEAIKEQVDKFLNYTIGYLYTEPPVRLAELLSEMTPGDFEKKVTFGFSGSDAVDSSIKASRAYTKKVHIISFRHSYHGMTYGALSVTGIVDEKVKSIVQPMSNVHIVDYPDPYRNPWNIDGYENPSELANRALDEVEKKIKELNGDVAGIILEPIQGDAGVVIPPLEFIKGLKKLTDEYGMVFIDEEVQTGMGRTGKWWAIEHFEVVPDLLVSAKALGGGMPISAVVGRAEIMDSVPSPLFVFTHVGHAVNASAAIATIKVIKEEKLVERAKELGDYALKRFRELQEEYPIIGDVRGKGLMIGVDIVKEGTKDPNRELAQKICWRAWEKGLIIITFGKHGNVLRIAPPLTISKEDFDRGIEIIEEAIKDAINGKVPDDVIKFLRAW

SEQ ID NO: 1924 - protein, 277 aa, Rhodospirillum rubrum ATCC 11170
MTALPFPPVSAADLVRLPKVERRQGTIGRTVFHLAEVDSTNRLMGGLARDGALPGTVVVADHQVAGRGKGERPWFSRPGEGLCLSILLSPKRPIEEVPQLTLVIAVAVAEAITRATGVQPRVKWPNDLLVDGRKLCGILCELLSSADGDVHHVIAGIGLNTGLSVDDFPGSLQAIGTSLAIESGRAIDRFAVLPVLLDHLEAWVELWEREGFAPVRDAWVRLSCTLGKDITLESEGTRCHGVAVDLGIDGSLSIRDESGEVHHFHYGETRLSSAIAG

SEQ ID NO: 1925 - protein, 351 aa, Arabidopsis thaliana
MLKYSNVKQKQKRDYRRELSLTIEFIEEALSLSQNLFFSVLEQWGMLLSKKNHRLRCLKVSGAVDGRVEGDFVGNAEFRWQRVLLMRSSAYYPKYGIGAFAVYPLISKITGKSSEEYRIMGLRYGSTNLSVGATVTPFSANNELPKHAWLVSKMGSLTVGVQYEPLHGSKDLAKYTDPRNWSCAAGYGVGSQSPLTPSFNIGIELARSSQFSTSLAQYEIDLMDLEQVQNPFEENQVVGITNYIDFGFELQSRFFIAGGCVLAGQQELFAEATTNHRTGNVQCGFGLRVDNLREASYQRADPNFVMLTPNKEHLAEGIVWKMGKRPMYQADVDAENFSELPKELRPSQKIL

SEQ ID NO: 1926 - protein, 175 aa, Triticum aestivum
MAPTVMVSSATSVAPFQGLKSTAGLPVSRRSNGASLGSVSNGGRIRCMQVWPIEGIKKFETLSYLPPVSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 1927 - protein, 482 aa, Shewanella sp. MR-4
MLLKDPSLLRQQCYINGQWCDAQSKETVAIANPATGVVIASVPVMGQAETQAAIAAAEVALPAWRALTAKERGAKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPTVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGASVVAGGKPHSLGGNFFEPTVLTHVDSSMRVAREETFGPLAPLFKFTDVDDVIKQANDTEFGLAAYFYGRDISLVWKVAEALEYGMVGVNTGLISTEVAPFGGMKSSGLGREGSKFGIEEYLEIKYICMSV

SEQ ID NO: 1928 - protein, 678 aa, Oryza sativa (japonica cultivar-group)
MAMHPCTTTLLLAFLAVALPGGAKAWHFCGSSGDVFAPRSTYQSNLALLSAGLAKNASASPALFAAGGVGDPPDTVYGLALCRGDTTNATACGACVAAAFQDGQQLCAYAREATVFYDPCYLRFSGRNFLAADGDNFAAYFSKVRNVTAPAEVFDAAVVALLNATADHAAASSPRRFATGVEAFRGWGVRDIYALVQCTPDMSPAGCRSCLAGIISWVNDPDYFSGSPTGRVLGVRCNYWYDVHPFFPGSPLLRLDAPAFDVSPPAPSPAPVAADTTPPADRAVDRDLKFFSYTFSVSQCSVFICLKRRKASKNQNTPIIPAPNKIKRGNCAIFDLPTLQIATDNFSNSNKLGEGGFGTVYRGKLGNGQKVAVKKLSQAQYTREGLNQLHNELQLLAELQHKNFVRLLGFCSHQDEMMLVYEHIKNGSLDIFLFDTSRAKTLNWEQRYNIILGIAKGILYLHEDSSIRIIHRDLKANNILLDENMNPKIADFGLGRLLGGGHTQTKTATVVGTYGYMAPEYALFGKVSPKIDIFSFGVLVLEIVTGRRNSGFDTTYNAVNLLTEVWNCWTKGTALQLADQSLDGYSDSKVLRCIHIGLLCVQESPIDRPSISSVILMLTRRRIKLQQPRQPAFFFGGDFSSVYQQQHRHRNYMYDKSGVIVEDKFSVNDVTNTDPYPR

SEQ ID NO: 1929 - protein, 310 aa, Gloeobacter violaceus PCC 7421
MRVLVTCPPMLRRIEHFKDHFEARGAEVYCPPVVQTLSVAELVDLLPGFDGWIIGDDPATRAVFAAGVRGRLKAAVKWGVGVDNVDFAAARALGIPIANTPAMFGAEVADVAVSYVTALARETFSVDREVRAGGWPKPCGVSLAGKTVALVGFGDIGKATARRLVAAEMRVIAYDPRYVPEAGSEAVEPALWPERLGEADFIVFTCALTPENRHMLGVAAFGLTKPGVRVVNVARGPLIDEQALIVALASGRVHSAALDVFEVEPLAADSPLRAHERCIFGSHNASNTADAVERASFKAMALLFGFLGID

SEQ ID NO: 1930 - protein, 623 aa, Magnetococcus sp. MC-1
MAWYPHSHGFTSLSLPLAIPFTTPVVSSLARSPRDKQQPQKIGNKPMHDGILLELLIIFALSVSVVYLCHRLGIAPIIGFLLTGAVAGPFGLTLIDSIEQVELLAEIGVMLLLFTIGMELSLTKLVEMQRAVFVGGGLQVGLTVAVGALLAVALGFPLNQSLFFGFLLAHSSTAIVLKTLQSRGEVGSAHGGAAVGVLIFQDLIVVPMLLLVPLLAGKAENPMLEMGLFSLKFVGIGFALWFGARRLIPAMLNAIVRLRDPELFLLFIIAIGLGIAWLTAAAGLSLALGAFLAGLIISESEYGHQAFASVLPFRDVFTSLFFISVGMLMDVGFLWNHLGLILTLTLLAILCKALLTSGAVLSAGIGFAAAAGAGLTLAQIGEFAFVLARSGVDEGLLSQQAYQTFLAVSVLTMSMTPLLAGRAGRWGRKLAHMPLFRRLALGAEAANPTKDTLHNHLIIIGFGENGHTMAQLARYHGIDHLILETNPETVRREKLAGAHIQFGDASRASILKHAGIDHAKALLITVPDAAATRHILHTARHLRADLPIIARTSFKNEVEALETLGATHVVAMQLEASVVLCQHTLRHLEIPQEQILLDLDDIRHHRLPGATHPPEAPQPPAHG

SEQ ID NO: 1931 - protein, 123 aa, Zea mays
RPAVTVNRKTWCLNGGQTLLQDNGLVPIVEPEILLDGDHGIERTLEVAEKVWSEVFFYLAQNNVLFEGILLKPSMVTPGADHKEKASPEAIAKHTLTMLRRIPSGCVLHVARAPCSQSMLQAC

SEQ ID NO: 1932 - protein, 673 aa, Oryza sativa (japonica cultivar-group)
MATFARHRVLLCRLAAALLLAPVAAAQPWQFCGQGGNYSANGTYQSNLAGLSATLPKNASASRTLFAKDSLGAVPDIVYALALCRGDVANATACESCVATAFQDAQQLCPYDKDAFIVYDLCYLAFSNRNILAAAADDDGSPRFLMNTQNASAPAEVFDAAVATLLNATSSYAAENSSRRFATGEEAFDAAAATPTIYGLSQCTPDMSPDDCRSCLGRIIALIPRYLSRRKGGRAIGMRCNFRYEVGPFFAGGSMLRLPAPANSTPTAPTGGRKKNKSGTALAIALPLVVILLATVVICLSVQRWRKRSRSKQQSSYSIQMAEDIESTDSLFIDLSTLRAATGNFSESNRIGEGGFGSVYKGVLPSGEEIAVKRLSMSSGQGIEELKNELVLVAKLQQKNLVRLVGVCLQEHEKLLVYEYMPNRSIDTILFDLEKRKELDWGKRFRIINGIARALQYLHEDSQLRIIHRDLKASNVLLDSDYNPKISDFGLARLFEGDQTREVTSRVVGTYGYMAPEYAMRGHYSVKSDVFSFGILMIEIVTGRRSSGSYSFDQSYDLLSRVWEHWTMGTILEMMDPSLTSHAPRDQMLKCIHIGLLCVQDNPADRPMMSTVNIMLSSNTVSLQSPSKPSFFIPKSGTDSNIYSESYPQTSQPTHRSGMMSVNDVSVTELEPR

SEQ ID NO: 1933 - protein, 332 aa, Ralstonia metallidurans CH34
MTIKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEMARVVAK

SEQ ID NO: 1934 - protein, 312 aa, Aspergillus oryzae
MAVADTRFKLNTGAEIPALGLGTWQSQPGEVEKAVSHAISVGYRHIDGAFCYQNEEEVGKGIRDALASGKVKREDLFVTTKLWCTYHSRVEEALEKSLKNLGLDYIDLYLMHWPLAMNPNGNHPLFPKHEDGSRDIDHSHSHVQTWKNMEKLLATGKVKAIGVSNYSVRYLEQLLPEATVVPAVNQIENHPSLPQQEIVDFCKKKGIHITAYSPLGSTGSPLFTAEPIVEVAKKKGVTPATVLLSWHIARGSSVLAKSVTPSRIEDNRKLVQLDESDMATIAKYTDDLAARKAFQRFVYPPFGVDFGFPDKS

SEQ ID NO: 1935 - protein, 337 aa, Rhodobacter sphaeroides 2.4.1
MKAAIFDGSPTLRLTDLPIQEPGPDEVLIRIDSATICGTDQHILEGKFWAKPPVVLGHEFAGYVERVGERVQNCRPGDLVSVEPHVYCGCCKPCRLGKPHLCLDRLAWGINLNGGFEQYATVRMDTVYQVPEGIGPEEAALGEITGCCMHGIDRVGVELGDLVVILGGGAAGLILARLAELRGAARIVISEPNAARREQIRAFGYPDVVDPLNEDLAARIGALTDGLGADVVIEAAGRAETAAQAVELVCHGGRVLFFGVAAPGTMAAIEPNRIFAREITVVGSIRNPYTHHRVMEILPRLRLKDIVTHRFPLENIAEAFDAAHRGEGLKICIKPNG

SEQ ID NO: 1936 - protein, 450 aa, Mycobacterium avium subsp. paratuberculosis K-10
MARGSRRGLLVGLTAASVGVIYGYDLSIIAGAQLFVTEDFGLSTRQQELLTTMAVIGQIGGALFAGVLANAIGRQRSVLLILSGYAVFALLAAFSVGLPMLLTARLLLGLTIGVTVVVVPVYVAESAPTAVRGALLTAYQLAIVSGLIVGYLSGYLLADTHSWRWMLGLACVPAVLLLPLVFRMPDTARWYLLKGRVDDARRALLRVEPVARVDDELAEIDRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 1937 - protein, 150 aa, Brassica napus
ITVDAKEGITTGVSAKDRAKTVMTLASPYSKPEDFNRPGHIFPLKYRDGGVLKRAGHTEASVDLAVLAGLPPVGVLCEIVDEDGSMARLPKLRLFAEKNNLKIVSIADLIRYRRKRDRLIERASVARIPLRWGNVRAYCYRSVIDGIEHI

SEQ ID NO: 1938 - protein, 239 aa, Treponema denticola ATCC 35405
MDTSQLKERVAYHAIDTLFSEGKIFDGMKIGLGTGSTAMPAVHRLAQLLSSGKLKKIYAVPTSFQTSIECEKLGIPIYSLSSQQIGGSLDLAIDGADEIDPDKNLIKGGGAALLKEKIIAYNSKEFVVIADERKKVKSMGKGFALPIEIIPEARLSITKALEAQGIEVFLREGVKKMGPVVTDNGNFIIDVKWPKAADVDPKALEESLNKITGVVENGFFTKNTPRVFIVHQDGNIEDL

SEQ ID NO: 1939 - protein, 571 aa, Enterococcus faecalis
MSEVYKKKERLMKNYPVKKNDVIEVEIIDLTHEGLGVAKVDHYPLFIENALPGEKLEIKVLKTGKSFGYGKVLTVLKSSEQRVPVKDENFTKVGISPLQHLAYGAQLSFKTQQVENVMQRVAKLQEVPVLPTIGMNDPWHYRNKAQIPVRKIDNQLQTGFFRKNSHDLIPMEHFYIQDPEIDAAIVKIRDIMRKYSVKPYNESDNTGNLRHIVVRRGYHTGEMMVVLITRTPKLFPISKIVPDILEAIPEVVSIVQNVNPKRTNVIFGDETILLHGSEKITDTIFDLKFEISARSFYQVNPQQTEVMYQKVKEYAALTGNEIVVDAYCGIGTIGLTLAQDAKQVYGIEVIEEAVKDAENNAKLNNIENATFTAGLAEELLPKLVENGLQPDVVVVDPPRKGLDGQLVNTLIETQPERIVYVSCNPATLARDIALLTEGGYEAKEIQPVDNFPQTTHIETVVLLSHKKPDGHINVKVEFGEGDGKVPLDNIAKRAESYKPKERVTYKMIKEYIEAKYGFKVHTAYIAEVKRDLGLPMYDAPNAVEELKQPRKHPTPEKVEAIKDALKHFEVI

SEQ ID NO: 1940 - protein, 274 aa, Sinorhizobium meliloti
MAALDGLPPLRDVIQRHGLDAKKALGQNFLLDLNLTQKIARTAGPLEDVTVIEVGPGPGGLTRAILALGAKKVVAIERDSRCLPALAEIGAHYPGRLDIIEDDALKVDFEALADGPVRIIANLPYNVGTQLLVNWLLPGLWPPFWQSMTLMFQREVGLRIVAGADDDHYGRLGVLCGWRTKARLAFDVPPQAFTPPPKVTSTVVHLEPVEAPIPCSPAVLEKVTQAAFGQRRKMLRQSLKPLGGEALLAKAGIDPQRRAETLTVEEFCRLANCL

SEQ ID NO: 1941 - protein, 583 aa, Thermoanaerobacter tengcongensis MB4
MRRTKIVCTIGPASEDYNILRKLIEKGMNVARLNFSHGDFEEHGARIDNIKKIREELGLPVAILLDTKGPEIRTGKFKNGGVELKEGQTFTLTTRDVIGDETVVSVSYKGLPQDVSRGTQILIDDGLISLRVVDVKGEDIICVVENSGFLGDHKGVNVPGVKLNLPALTQKDIEDIEFGIKKGIDMIAASFVRKAADVLAIRRLLEDNKADHIQIIAKIENREGVENIDEIIRVSDGIMVARGDLGVEIPLEEIPIVQKMIIKKCNEAGKPVITATQMLDSMMRNPRPTRAEVTDVANAILDGTDAIMLSGETAQGKYPVEAFETMARIAEKTEVYVQYRDIVGVGTERNVSITNAISHATCTTARDIGASAIITCTKSGYTARMVSRYRPSSPIIATTPSEQVARKLSIVWGVYPLVTKEVSTTDEMIDVAIESALKAGLIRNGDIVVISAGIPVAMTGTTNMLKVHIVGDVILRGIGIGSKSTTGTVCIIHDIGKDRDKFREGDIIVTTKTERDFMPLIEKASAIITEEGGLTSHAAIVGLNLGIPVIVGCEGATSKLQDGMTVTVDTTRGLVYKGIVNIK

SEQ ID NO: 1942 - protein, 454 aa, Streptomyces avermitilis MA-4680
MADRTPPLGVEELHALVAGGEIDTVVLAFPDMQGRLQGKRFAARFFLDEVLEHGTEGCNYLLAVDTDMNTVDGYDMSSWDRGYGDFAMHPDLSTLRQVPWNAGTALLIADLAWNDGSPVVAAPRQILRRQLDRLAALGYTAQVGTELEFIVFKDTYEQAWDAGYKGLTPANQYNIDYSVLGTGRIEPLLRRIRNEMQAAGLTVESAKGECNPGQHEIVFRYDEALVTCDQHAVYKTGAKEIAAQEGVSITFMAKYNEREGNSCHIHLSLADADGTNAMAGDGPGGMSDVMRHFLAGQLAALRDFSLLYAPNINSYKRFQPGSFAPTAVAWGYDNRTCALRVVGHGRSMRFENRLPGGDVNPHLAVAGLVAAGLYGIEHKLELPEACAGNAYAAEYEHVPTTLREAAELWENSPIAKAAFGDDVVAHYRNMARVELKAFDAAVTDWELRRSFERL

SEQ ID NO: 1943 - protein, 267 aa, Sulfolobus tokodaii str. 7
MEKVTIRDFLKKKEKKEKIIMLTAYDYPSAKIISQTNLDGILVGDSLGMVVLGKENTLKVTMRDMLIHLDAVVKAKPPQLIVADMPFLSYETSIKDAVKNAGLLARHGADAVKLEGGEEMRDVVRAIVRAGIPVMGHIGLTPQRFLRIGGYRILGKREKEEEQLLKDAKTLEEAGAFSIVIENTYSDVAKKITESISIPTICIGAGPYCDGQILVIHDLLGLSDFTPYFAKKYIDLRGLIRRAIEDYISEVKEGKFPGKEHYKSRDS

SEQ ID NO: 1944 - protein, 547 aa, Magnaporthe grisea 70-15
MAGSINKPKKPMSKRTPVRLRNKIEKASKAKQRKDRKLAKKNPQWVSKVKKDPGIPNLFPYKERLLQQIEEAKIQKQEETRRRKEAAKAAKAQQNGDAAKEDGADSDAEDMDDDMMDEDIDESNPMAALIASARAAAEKYDEDLQTDDDDGMDDDSDASSGSEGESGAIEVSGGATSRKAFDKVFKQVVEQADVVLYVLDARDPEGTRSRDVERSVMAAASGGKRLILVLNKVDLIPPPVLRGWLTHLRRYFPTLPLRASNAAPNAHTFNHRDVTVQSTSTALFRALKSFAAGRNLKRAVSVGVIGYPNVGKSSVINALLSRMSGTRGQRSACPAGAEAGVTTAIRSVKIDSKLTLLDSPGIVFPSTSSTSTSFVPKNKTEAHAHLVLLNAVPPKHIEDPVPAVTLLLKRLSASPDLLKKLTDVYDLPPLLADASGDATTDFLVQVARKRGRLGRGGVPNIASAAMTVVTDWRDGRIQGWVDAPVLAVATADSSATGAGSSVTTVNDEATMPDQKQIVTEWAKEFKIEGLFGDGEEDAVDQEDSMME

SEQ ID NO: 1945 - protein, 595 aa, Neurospora crassa
MAQYTASTGSSLRASPNLRQHHADTSAAPDTTEKFPDFDTSQTTNGYPSGNGRSTNAGSNAPSDQWRPRRESKVTWAPRDSPGPVNAYSHGRGHSRQTSISNAIHRMRSGSMSQNAHEIAEALRAPVSYKLIGLCMMWYWSSALTNTSSKSILTTFDKPATLTLIQFAFVCSYCLLASWLASTFPKLRTAVPALKHPIRKPSRDVIVTTLPLAAFQIFGHLLSSSATSKIPVSLVHTIKGLSPLFTVLAYRLIFDIRYPRATYYSLVPLTIGVMLACSGKHSFGEGQFLGILYALIATIIFVTQNIFSKRLFNEAARAEQEDGHSNGHRSKKLDKLNLLCYSSGMAFILTGPIWLWSEGFSIIGDFLWDGSVDLSETPNSFDHGRLTLEFIFNGTFHFGQNILAFVLLSMVSPVTYSVASLLKRVFVIIIAIIWFRSPTTNVQAVGIALTFLGLYLYDRSQEKNKADQRARSLSRSKMHESILPLNTKQTTETSSQYQPSSSLNTQIGGYGYMPSIQPTTSSADLGANKKDDGPNPSSVSTTAGGGRQRGASMAKANGGWLPPGTRQEHTWRVGDGRGQNGGAEVSGPAGVAVMS

SEQ ID NO: 1946 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVRFIAFNPPGCDESGKA

SEQ ID NO: 1947 - protein, 190 aa, Oryza sativa (japonica cultivar-group)
MQARRHRGFRLGRKLLGLWRWALCHRRRRRGRGYLRLQPCPGAAGGRSPLLAAGSVKKQPPPPQQQIVVHQRGGEKAVLKWGRSLARRMRLLRRRGSERLLEESPGEATTPKGQVAVYVGGGEPGESMRYVVPVVYFNHPLFGELLREAEEEFGFAHPGGITIPCAAARFERAAAVAAAGGGGRKVPTWW

SEQ ID NO: 1948 - protein, 602 aa, Agrobacterium tumefaciens str. C58
MAVEANGNDLAQVVVLLAAGVIAAPIFKRIGLGSVLGYLAAGLVIGPYGLGFFSDSQAILHVAELGVVMFLFIIGLEMQPSRLWSMRQDIFGLGALQVLVCMGGLTLVGVSLGFPVIMSFVAGTGFVLTSTAIVMQMLQERNSMSSLKGQRIIAILLFEDLAIVPLLALVAFLGSGGEHVTASERWLSIGIALAAVGALILAGRYLLNPFFRLLAASGAREVMTAAALLVVLGSALLMQVSGLSMAMGAFLAGVLLSESSFRHQLEADIEPFRGILLGLFFLGVGMAIDLAVIASNWQLVVVSVAGYMLLKAFLIYGVARALGTTRRESLERAVLMAQGGEFAFVLYSAAVSAGILDREANAILTATIIISMVLTPLMVILHDRLVPAAVPNTDDLDVPENVEGSILLIGFGRFGQIVSQPLLARGYTLSLIDKDADFVRDAAEFGFKVYYGDGSRAEILHAAGASTARAVLICVDDKDAAVRIAEIVKHEFPLVPVLARAYDRGHAIDLLKAGVDYQIRETLESALNFSEEVLGAMGEEREDAARLVEEFRDRDEERFAMEVVGGIYAGRSLIRGNAQPADLVAARTARERAEREKAEAEE

SEQ ID NO: 1949 - protein, 481 aa, Rhodobacter sphaeroides 2.4.1
MTDFRREKILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKYTAMGGLGR

SEQ ID NO: 1950 - protein, 478 aa, Pseudomonas fluorescens PfO-1
MNNSYDQLYLFIGGEWIDAQGRSTAAVVNPATGREIGRVPLATAGDLDRALEVSRVGFEQWRQTVPDQRAKILKRAADLILERAPHIAAQMTLEEGKPLSESMDEVVRAAEYFEWFAESARRIDGRVVPANRPGVLQLVKRQAIGPVAAFTPWNFPAITPARKLSAALAAGCSVILKPGEESPSTALALARALDDAGLPKGVLQVVFGVPDQVSSQLIASAIIRKVTFTGSVPIGRLLSARAAEGVKPITLELGGHGPVLVFADADVEKAAVEGVANRFRGTGQVCISSTRFIVQRGAYQAFVDHFVTATKALKIGDGFDPQTQVGPLANPRQLVKMEQLIADAVEKGARVLVGGEALPGDGFFFQPTVLADVPMNARIMHEEPFGPIAVLMPFDELADGLQEANRLPYGLSAYAFTSNARTAIDVADGLEAGMIGINQYRIVATELPFGGMKESGHGSEGGVEGIEHYLTHKFISQV

SEQ ID NO: 1951 - protein, 432 aa, Bacillus cereus E33L
MKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNIETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 1952 - protein, 260 aa, Sulfitobacter sp. EE-36
MTKTILITGATDGIGLLTAKTLTAEGHNVLLHGRSADKLEAAAREVGGNPETYRADLSLLGDVNALVADVRAKHDTLDVLINNAGVLKVPNTQTDSGLDVRFMVNAIAPWALTVGLLPIIPKDGRVVSLSSAAQAPVNIKAMRVEQQLGHNEAYAQSKLALTIWSQELAREHPDGPMFVSVNPGSLLATKMVKESYGMAGNDLRIGADILRRAAVSEEFANASGQYYDNDAGRIARPHPAAADRAHVAQLMAAIRELAGA

SEQ ID NO: 1953 - protein, 237 aa, Pyrococcus abyssi GE5
MLGLKTSVIGRTIIYFQEVASTNDYAKAENLEEGTVIVADRQIKGHGRLERKWESPEGGLWMSVVLTPRVSQEDLPKIVFLGALAVVETLREFSIDARIKWPNDVLVNYRKVAGVLVEAKGEKVILGIGLNVNNKVPDGATSMKQELGSEIPMLNVFKTLVKTLDSLYLKFLESPGKILERAKRSMILGVRVKVLSDGEVEAEGIAEDVDEFGRLIVRLDDGRVKKILYGDVSLRFL

SEQ ID NO: 1954 - protein, 567 aa, Dehalococcoides ethenogenes 195
MEELGSSFGLDLIIVLVSAVLAGLLARRFRLPLLLGYLGAGIAIGPNGFGLVQSPGVIESMATVGVILLLFTLGLDFSLDELKRVGKVAVLGGLIQIVVTAGFGFLLGRGLGWDINASIFFGFMVSLSSTLIVLKILMDKGEAEAPHGRVMLGILLVQDICLIPLMIILPALGGEGGDIGLTIGVAFAKAAAFILAMFGLGFWVFPRLLGRVASHSHELFLLSVITLSLGAALGATALGLSPAVGAFIAGLLIGQSMYAKQALADIIPLRDIFGALFFVSLGMLANLNFAVENIGLVLLVVVFLLVIKSLVAGAVPWLFGYTFQTSFTTGIGLMQIGEFSFVLAGVGLASSVISDSIYAITISSAVITMIITPFALSFSGAAYRKVSQWPLASKLVSLRTSGQAEFMDLDISNHAVICSQGGVAKTLTRVMNRRNFPFLVIDLDPQTIAELRRQKAPAIYGDAANPEILRFARLDKARLLICAMPGFADTEQVVKNARKINDRLDIVARVSSDIQAEKLKKMGVSEVVQPEFEVGLELSRHAMHRFGMTTIEIQYILNSLRNMGKPE

SEQ ID NO: 1955 - protein, 247 aa, Triticum aestivum
  misc_feature (173)..(173): Xaa can be any naturally occurring amino acid
  unsure (1)..(247): unsure at all Xaa locations
MGGLSVQHPWAFTFGLLGNVISFMTYLAPLPTFYRIYKNKSTQGFQSVPYVVALFSAMLWIYYALLKSDEYLLITINSAGCVIETIYIVLYLAYAHKQARIFTAKILLLLNVGVFGLILLLTLLLTAGERRIVMLGWVCVGFSVSVFGAPLRVIRLVVRTRSVEFMPFSLSLXLTASAVVWFLYGLLIKDKYVALPNILGFAFGVIQMGLYALYRNATPRPAPQGGGRPRVRPRWCRQGARARRQHL

SEQ ID NO: 1956 - protein, 1023 aa, Oryza sativa (japonica cultivar-group)
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKSNNILLDSDFEAHVADFGLAKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVFDLVVPAESAEANEAKEQQQQQLNSPSSPPPDLISI

SEQ ID NO: 1957 - protein, 368 aa, Blastopirellula marina DSM 3645
MVNLAATMKDVIHLSIGQPDFQCPQHIVEAHIDALRAGHLGYTMDAGLPELLTELAKYYTARTEREITEDNILITTGATEAMYLAISVTSAPGRQFLIPDPTFPLYAPLVRMHGGEVKAIPTRAENGHQLDPQEVIDAIGPRTFAIILNSPSNPTGTVYPPETIEAIVQEAAYQGIRVISDEVYDHLILDDLEYASVLRHTSDLDHVMIASSFSKTYAMPGLRIGWIISSQGAIKMLRRYHMFTTTVANTPAQWAGVAALQGTTACVDEMVREYRRRRDRVVQLVSETPNLTGYWPQGGFYIFPSLPRTCNGSTLALRMLEEIGVCVVPGEAFGESCINSLRISYSTSMETIEEAFQRMIPWMAKQEM

SEQ ID NO: 1958 - protein, 225 aa, Amaranthus tricolor
KWHVIMACRDFLKAERAAKSAGMAKENYTIMHLDLASLDSVRQFVNNFRQSGRPLDVLVCNAAVYLPTAREPTYTAEGFELSVGTNHLGHFLLSRLLLEDLKKSDYPSTRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRFLFPPFQKYITKG

SEQ ID NO: 1959 - protein, 227 aa, Pyrococcus abyssi GE5
MRCIAPGPKFRILEMLKAGKRVSGELIARELGISRIAVWKHVKMLKSLGYEIDARRNGYRLVKIPDEPFPWELGVNYLYCLKVRSTMDSAWRNFGTYDGVIAKEQTKGRGRSDPWISLPGGLYLSACFPRISSVSMVETLANDIAESLSERYSLNVQAVEGKLFLNGKKLGGVLIEVRGNYKAVVGVGINVRNPVPRNFARLENASLREVAEIVIKVLQRYNRRERT

SEQ ID NO: 1960 - protein, 303 aa, Blastopirellula marina DSM 3645
MPKFQNQTISFLTKRFREVGLRPVSKHGQNFLIDMNLLDMIVSSADLGPQDVVLEIGTGTGSLTTRMAAAAGHVITVEIDEHLFTLASEELFEFDNVTMLQFDVLKNKNAFRPEVMETIKEKLAEIPDSRLKLVANLPYNVATPILSNLLRSEITPFSMTVTIQKEVAERIIAVPSTKDYGALSIWMQSQCRCEIVRIMGPGVFWPRPKIDSAIIHLQVDDELRGRIPDREFFHHFTRAIFFHRRKFLRSVLMSAFKEQLTKTQVDEVIAENGLQPDARAEQFTPDEVLAMSEMFRLKLQAVG

SEQ ID NO: 1961 - protein, 224 aa, Amaranthus tricolor
KWHVIMACRDFLKAERAAKRIGMPKDSYTVMHLDLASLESVRQFVENFRRSGMPLDVLVCNAAVYLPTDKEPTFTAEGFELSVGTNHLGHFLLSRLLLDDLKQSDYPSKRLIIVGSITGNSNTLAGNVPPKANLGDLRGLAGGLNGVNSSPMIDGGEFDGAKAYKDSKVCNMLTMQEFHRRFHEETGITFSSLYPGCIAETGLFRNHVALFRTLFPPFQKYITK

SEQ ID NO: 1962 - protein, 348 aa, Gloeobacter violaceus PCC 7421
MDTTPLTPLTKGITLYQHILSQQALNPDATGEFSGLMVQISLAAKLISRQLAQAGLVENVLGFTGETNVQGEAVRHLDQYANETFIRVFQNTNLVCLLVSEELEDPLPLSNQCPIGSYALVIDPVDGSSNIDVNVSVASIFSVQRRNPRATDETSSLLQKGTGQVAAGYVLYGPNTMFVYTSSQGVHGFTLDAGLGEFVLSHPNIRIPERGDYYSINDAYSAEWQPGTRAFIDYLKQAKSRGEKAYSARYIGSLAADVHRTLLTGGIFLYPGTVAKPKGKLRLLYEAQPLALIAEQAGGKASTGTERILDIEPKTLHQRVPLVIGSPYEVDLAVAFARGEKQTVVAGS

SEQ ID NO: 1963 - protein, 473 aa, Leptospira interrogans serovar Lai str. 56601
MSRTPSEVIAYAKANNVLFYDFRFTDIKGAWHHVSYHAGSINEDSFKGLPFDGSSIPAWQPIDRSDMQLIPDTSAIFLDPFTADSTLVVFCDVFDIYKGTLYEKCPRSIAKKALKYLESSGLADTAYFGPENEFFIFDNIKVRDAINVQYYEIDSSEGIWNSHTDFPGSTNTGHRPGTKGGYFPVAPVDSQVDLRADIVKTLHQIGMETFVVHHEVAQGQGEIGVKFGTLIEAADNVQKLKYVVKMVAHKYGKTATFMPKPLYGDNGNGMHCHQSIWKNGVNLFAGKGYQNLSDTAMHYIGGVLSHAKSCAAFTNASTNSYKRLLPGFEAPSILAYSAQNRSASCRIPFVNGDKARRVEFRFPDSSANPYLAFAAMLMAGIDGVQKKIDPGPPREEDLFELSLDEIREKGIQQMPHTLRESVEHMLLDKEFLKKGDVFTEEFIQTYKAYKFETEIWPWEGRPHPFEFLTTYSC

SEQ ID NO: 1964 - protein, 574 aa, Thermoanaerobacter tengcongensis MB4
MIKEAIFHKSDIPYAYPVNKDQLKIVLRTAVFDVDRVYILFKDRYDWLGKFKIKPMTLVHTNELFDYYETTLELNKRFLYFFYLVSETGEKLYYTEAGFFKKRPEDSFWGFFHYPYIREKDIFSPPDWANECIVYQIFPDRFNNGDRTNDPENVKPWGEKPTADSFFGGDLQGIIDKIDYLKELGINAIYLTPIFLSPSTHKYDTTDYYTIDPHFGDTEKAKELVRKCHDNGIKVIFDAVFNHCGYDFFAFQDVVKNGPKSKYWDWFNVYEWPIKTHPKPTYETFGENVWRMPKLMTKNPEVQKYLLEVAEYWIKEVDIDGWRLDVANEIDHHFWRKFREVVKNAKKDAIIVGEVWHDASPWLRGDQFDSVMNYPFRNAVVDFFAKRKISAVKFNTLITEQLMRHMDSVNRVMFNLIGSHDTERFLTLANGMVARMKLALVFQFTFVGVPYIYYGDEAGMVGGFDPDCRRCMIWEEEKQNKGLFEFYKKLIRIRKEHEELKYGNFTTLYAVGRVFAFRREYKGNSIVVIINNSSKEEVIFLEEAGGKEDILKMGELKRSGNLLYLKPNTAYILK

SEQ ID NO: 1965 - protein, 466 aa, Mycobacterium sp. MCS
MIDARTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYQPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 1966 - protein, 249 aa, Thermoanaerobacter tengcongensis MB4
MYKVVLLRHGESIWNMENRFTGWTDVDLSPKGIEEAKQAGKILKEKGFTFDAAFTSVLKRAIRTLWIVLDELDLMWIPVYKSWRLNERHYGALQGLNKAETAKKYGEEQVKLWRRSAEVRPPALTKDDPRYPGNDPRYADLSEDEIPLTENLIDTINRVIPYWESTIAPTIKSGKRVIIAAHGNSLRGLVKYLDNLSNEEIMELNIPTGIPLVYELDENLKPIRHYYLADEEELKKKQQEVAEQGKARA

SEQ ID NO: 1967 - protein, 360 aa, Clostridium perfringens SM101
MDIISSINTRFLSKSEQSKKEIFNKIDNIVKGGGNIIRMNLSHGKHRDVECCIDYIRSNHKNVKILLDLQGNKIRVANNIYGTFKVNSGDLVYFCSEETYDVYLKNVDRNKLIPLNIKNKFIYNNTFKKIYMKDATMEFIVISNNNGLIKTKVKLGGVVRKEKGCNLPNLDRKNWGVSEKDLEDIKFAIDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKGV

SEQ ID NO: 1968 - protein, 542 aa, Alkalilimnicola ehrlichei MLHE-1
MAGPAVHRPGDAHPIGATTRKDAPSWCGYTAWRRGAGPLTRRGSGNLTIGMQPACKGLHRHSELIIFRRYRMARTAADVLKLIQDEDVKFVDLRFTDTRGKEQHVTIPAHELDEDMFEDGKMFDGSSIAGWKGINESDMIMMPDPETATLDPFFDDPTINLTCDIIEPSTMQGYEKDPRSVARRAEAYLKSTGLGESALFGPENEFFVFDDVRWGADMSGSFYKIDSEEAGWNSERVYGDGNMGHRPKVKGGYFPVPPVDSLHDLRAAMCEALEDLGLTVEVHHHEVATAGQCEIGVGPNTLVKKADEIQKLKYAVHNVAHAYGKTATFMPKPLVGDNGSGMHVHQSVMKDGNNVFGGDSYGGLSEFALYYIGGIIKHARAINAFANASTNSYKRLVKGFEAPVLLAYSARNRSASIRVPYVPNPKARRIEVRFPDSTANPYFAFAAMLMAGLDGVQNKIHPGEAMDKDLYDLPPEEERDIPKVALSLNEALEALDQDREFLKQGGVFTDDTIDAYIELKMEEVERLNMTTHPVEFDLYYSV

SEQ ID NO: 1969 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 1970 - protein, 140 aa, Sinorhizobium meliloti
MAIERTFSMIKPDATKRNLTGAITKMLEDAGLRVVASKRVWMSRREAEGFYAVHKERPFFGELVEFMSSGPTVVQVLEGENAIAKNREVMGATNPANAAEGTIRKVHALSIGENSVHGSDAPETAAEEIAYWFSGTEIVG

SEQ ID NO: 1971 - protein, 721 aa, Medicago truncatula
MTSEKEQPIYTHMVVVPELRITNLVDLNNLPNNEPCGNSESGVVELSSNEQEAITIENDFEPFIGQCFLSEEEAFKFYENYAKRSGFSIRKGRFVNKNGIMHRRDLFCHRGGFPDKKIQDPSKEQRNRPSSRCGCKASMTIKLKKSFEIFPEEWQVFEFISNHNHDLLPSDQVHFLASYRKISKEEEKRILLLKEADLSVKQIMRVMELEKNVKHGDLRFLEKDIHNFFNKIHQDNMNGDANDLLQLCKLSKEENSCFQFEFTVDKEKRLENIFWSPPHCFELYQQYGDAVAFDTTYKVNTYNMPFGIFVGVDNHGRTILFGCALIRNETVSTFQWLMKTFVTLMKKPPKTIITDQDPWMTQAIAFEMPSTKHAFCIWHITAKFSGWFTSILRNRYFSWCADFYKLYKLDNIDDFEEEWIIIVSKYNLEANKHIKGLYEVKQHWVPAYLRGHFFGGMTTTGRSESINGFLKRFTSSRSCLTQLFKQVDLAIEDIGQKQLHHTMLDTYRGSSLRSLSPLEEQVYNIFSKYAFKKFQEEFERATQYKICEENHVEFTVKYYKEQHSQKHKVLWDGDVVGCSCKHFEFWGILCRHVLTIFLHKDCFEIPTSYLPLRWCRDEFQRPVEVNMMLSEGGPIENVENTVDLIKNPPRSNTKGRPKTKRSKGGMELSKRARSCTFCKRRGHNVTTCPDKESYVQPTITKKRKNEDQTQQNLNPVFYLKS

SEQ ID NO: 1972 - protein, 291 aa, Aspergillus nidulans FGSC A4
MVFGSRPPALTEANIGDQSGKNNGTVYLAARNAKKTAEVIADLKQRFPASRGRLDSISLNLSDLSTIKKSAEEFLAKETRLHVLWNNAGVMFPPAGSTTSQGYELQLGTNNVGPHLFTKLLYPTLAATAKEAPKNTVRVVWVSSDAASWAPKPAIDFNNLDYRRNESDRSKYGRSKAGTVMQAVELARRARKDGSGIVSIALDPGIANTGLQRDMGRLMSTMVKLIANKPEIGAYTQLFAGLSPEITAEVAEKEWVVPPGKIGCPRRDLFTDTETSRKWWEWNEEQVKAYL

SEQ ID NO: 1973 - protein, 798 aa, Lactobacillus plantarum WCFS1
MKLTCAQFKKDFLSEIETLYSTSLSDTSTIGQFIALGQLVRRYNSQSWTRTAKFYRDHHQKQVYYFSIEFLPGRLLASNLLNLNLLTTVKKGLTELGLDFETISQAEPDPALGNGGLGRLAACYMDAMASLKIAGNGNGIRYRYGLFKQVFMDGYQVELPDDWLHHGNVWETRRDNKSCIVQFGGNVWLQPQADGSLQPQSENTEDVLAVPYDVGIVGYHNDITNTLRLWSAELPPSATYSSQDQRDRISEITKVLYPDDSNSAGQQLRLRQEYFFSSAGVQSIVRDFCATHHGIKLLGKKVAIHINDTHPTLVIPEMMRLLMDEHHCSWEVAWTLTTQVMSYTNHTILQEALETWPIDMFKNLLPRIYQIIAEIDRRYREQQTPIFGKALVDQTAPLGNGQVRMAYLAVIGSHSVNGVAPLHTELLKTDVLRGLYQVYPERFNNKTNGIATRRWVQLANQPLAQLIDQTIGSDWRRQPDLLQTLLPYQQDDHFLYQLGQVKLTNKQALAAYVQRTMGIKIRTDAIYDVQIKRLHAYKRQLLHVFEILREYFAIKDHPQQPVVPRVHIFGAKAAPSYHYAKAIIKLINVVADMVNQDPAIGDRLKIVFIPNYGVSIAELIIPAADVSEQISTASKEASGTSNMKLMANGALSLATYDGANIDIMQAAGAENEYPFGLKVNEVYDYYHRGNYHAADFYDADPELKRLLDSLIDGTIPGIPTVGREIYDSLLRYNDEFFVLADYRAYVTQQQQISRDFQNQPTWQQRSLANIAASGHFAADLAVARYADDIWQVPHERLN

SEQ ID NO: 1974 - protein, 304 aa, Geobacter sulfurreducens PCA
MVVTGLGQCCWDTLAEVEEYPSPDSKAESGQWVEQGGGPAATALVTVARLGLQCRFAGVVGDDAAGALIRHALHAEGIDVTHLLTRPGAASQRAFIMVERTGGRRTIVWQRPTGAHLAPAELEEPFWSGSAFLHLDGLMEEASLHGVREARRRGIPVMVDAGRMRPGMRELAKLCDYLVAAEQFFLDLGWDGSEEQFARLADGLGAPTVTVTLGDRGSLTRHDGTTCHVPAFPVTTLDTTGAGDVFHGGYLFGLLKGWPLRETVIFASAAAALSCLHLGAQRGAPRLDEVIRFLVDRGIPVPAV

SEQ ID NO: 1975 - protein, 237 aa, Aeropyrum pernix K1
MGGCDPMDEAARGALDLLGRIGGELGVLGVGTGRTVMRFLREASARGVEPGVAVPSSFETAVELAGLGWSVGDPRVYRGVNVYVDGADEAEPGRGYMVKGGGGALLGEKILSSRSKLNIFIVGEDRLVGRLGEKTPVPVEVEPGFVSMVLASLEELGLNPRVRTSPGKRGPVVSDWGGVIVDLLTGPLEDPRGLESMLRNVPGVRETGLFLGLADYIVVGLSSCGYRVLGPYRGRAV

SEQ ID NO: 1976 - protein, 255 aa, Salmonella typhimurium LT2
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 1977 - protein, 505 aa, Aspergillus oryzae
MTTSSPCPMAYYLVTLCCVFTTLGSFLFGYDSGVISSTLDQEDFQNRFNHPSDAATGGGAILGSALVSYISDPYGRRPVIFIGGLLGSLGAALQAGAVTVAMLIAGRLIAGLAVGLMSSAIPVYCSEVSPPRIRGFLGSMQQWMIGLGFVVAQWTGYGCSLHTGAITWRLPLAIQAVPAVILCFGVWLLPESPRWLIEKGRAEAGREILARLHSNRDRSNIHMVEAEIAQINDSIAEERRSAVHSWRELLSKARWRHRLLLACGIQAFTQCSGTNIISNYNPGLYRTLGLKGTTPLMLQGIWGALAQFWNTVFMLFIDRVGRRKLLIPSLLGMGATMCIEAALAQANGGFRDPSANPDAVRAAIAMFFVFSIFFTSLGLISWIYPSEIFPTAIRARGSSLATATNWSLNLVFAQCTPIARSTMGFNYFYCFFAFNWVAAAITWAFYPETAGKSLEDVEHIFSSSSRDDFPHPVPDLKNDVVAVANPADSDWSRENLELSCHAKMS

SEQ ID NO: 1978 - protein, 146 aa, Arabidopsis thaliana
  misc_feature (13)..(13): Xaa can be any naturally occurring amino acid
  misc_feature (22)..(23): Xaa can be any naturally occurring amino acid
  misc_feature (28)..(28): Xaa can be any naturally occurring amino acid
  misc_feature (30)..(30): Xaa can be any naturally occurring amino acid
  misc_feature (33)..(33): Xaa can be any naturally occurring amino acid
  misc_feature (38)..(38): Xaa can be any naturally occurring amino acid
  misc_feature (44)..(45): Xaa can be any naturally occurring amino acid
  misc_feature (51)..(51): Xaa can be any naturally occurring amino acid
  misc_feature (54)..(54): Xaa can be any naturally occurring amino acid
  misc_feature (57)..(57): Xaa can be any naturally occurring amino acid
  misc_feature (88)..(88): Xaa can be any naturally occurring amino acid
  misc_feature (90)..(90): Xaa can be any naturally occurring amino acid
  misc_feature (110)..(110): Xaa can be any naturally occurring amino acid
  misc_feature (121)..(121): Xaa can be any naturally occurring amino acid
  misc_feature (123)..(123): Xaa can be any naturally occurring amino acid
  misc_feature (132)..(132): Xaa can be any naturally occurring amino acid
  misc_feature (139)..(139): Xaa can be any naturally occurring amino acid
  misc_feature (144)..(144): Xaa can be any naturally occurring amino acid
  unsure (1)..(146): unsure at all Xaa locations
MASSMLSSTAVVXPPGFKQQWXXQFTGXKXSAXFPVTXKANNDXXSITSNXGRXSCXKVWPPFGKKKFETLSYLPDLSDVELAKEVDXLXRNKWIPCVEFELEHGFVYRXARETLPGYYDXPXNWTMWKLPXFGCTAPXQVLRXKK

SEQ ID NO: 1979 - protein, 257 aa, Prochlorococcus marinus subsp. pastoris str. CCMP1986
MLPSELVKYKKKSQKIIALTAWDSISGSLAEHSGADIVLVGDSLAMVCLGYKSTLPVTLENMIYHTNAVSRGFSKEIEEQSLLVCDMPFLTYQCGENKAVEYAGKIIKNTYAKAVKVEGADPEVQNVISRLIRMGIPVMGHLGLTPQSYLNLGFKQQGNNSESHEKIKRDALSLEKLGCFSIVLEHIPELLAKEIQTELEIPTIGIGAGKFCDGQVRVTADLLGLNDKQPPFCRPIIDGKKIFGEKLKEWVAAEKLN

SEQ ID NO: 1980 - protein, 235 aa, Brassica rapa
MSSQICRSASKAARSLLSSAKNARFFSEGRAIGAAAAVTASGKMPLYASNFARSSGSSKSWITGLLALPAAAFMVQDQKVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATDPQKFEPGTIRGDLAVVVGRNIIHGSDGPETAKDEINLWFKPQELVSYTNNAEKWIYGDN

SEQ ID NO: 1981 - protein, 408 aa, Yersinia pseudotuberculosis IP 32953
MILNVYVVISIFIMNAMSLLSVEVSNFTFVDLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKIGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVQVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 1982 - protein, 102 aa, Arabidopsis thaliana
  misc_feature (21)..(21): Xaa can be any naturally occurring amino acid
  misc_feature (47)..(47): Xaa can be any naturally occurring amino acid
  unsure (1)..(102): unsure at all Xaa locations
MASSMLSSANMVASPAQASMXARFNGVRASAGLRGTGRGSCDMNSVXEDGGRDNCVLVGAPSVKTKFETRGYIPDLTDAAWAWGAEGLIRHWGSPLRKHSKC

SEQ ID NO: 1983 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 1984 - protein, 293 aa, Zea mays
  misc_feature (43)..(43): Xaa can be any naturally occurring amino acid
  unsure (1)..(293): unsure at all Xaa locations
KYPKFPNRVTPASQKPNSRSRSSPQPRAAPSPPPSPWSAPPPXPPPSGKPTQDELKRLAAHRAVELVEPCMTLGLGTGSTAAHALDRLGDLLRAGALPGVSGVPTSLKTEAHAARVGIPLLPLDAASIALSIDGADEVDPDLNLVKGRGGSLLREKMVEGAGARFAVIVDESKLVPRLGCTGAVPVEVVPFGAPHTLGLIRGLFHGLPGFHARLRTTTVPEGEQGSEQQPFVTDNGNYIVEMFFDGGIRGDLRDISDRLLRITGVVEHGMFLGMATVAIVAKKDGTVAVMERK

SEQ ID NO: 1985 - protein, 488 aa, Bacillus subtilis subsp. subtilis str. 168
MSNQDQALIFELSREGRIGYSLPELDVPEIELGDLLSDTYIRDEDAALPEVSELDIMRHYTALSKRNHGVDSGFYPLGSCTMKYNPKINEKIARIPGFAAIHPLQDEDTVQGALELLYDLSKHLEEITGMDEVTLQPAAGAHGEWTGLMMIRAYHEARGDFKRTKVIVPDSAHGTNPASATVAGFETVTVKSNEKGLVDLEDLKRAVNEETAALMLTNPNTLGLFEEQITEMAEIVHQAGGKLYYDGANLNAVLSKARPGDMGFDVVHLNLHKTFTGPHGGGGPGSGPVGVKQDLIPYLPKPVLVKKEGRFTFDYDRPHAIGRVKPYYGNFGINVRAYTYIRSMGPDGLKAVTENAVLNANYMMRKLAPYYDLPFDRHCKHEFVLSGKRQKKLGVRTLDIAKRLLDFGYHPPTIYFPLNVEECIMIEPTETESKETLDAFIDAMIQIAKEAEENPELVQEAPHTTIVKRMDETKAARHPVLRYEAEER

SEQ ID NO: 1986 - protein, 528 aa, Synechococcus sp. WH 5701
MTKVLVSDPIDQTGIDILSQVAQVDVRTGLPPEQLQQIIGDYDALMIRSGTQVTAAIIEAATRLKIIGRAGVGVDNVDVEAATQRGVLVVNSPEGNTIAAAEHALAMMLALSRHVPQAHVSTMAGGWERKKYVGNELYKKKLGVVGLGKIGSHVARVAKAMGMEVLAYDPYISAERAQVLQVRLMAIGPLFAEADFISLHLPRTPDTENLVNAELLATMKPTARLVNCARGGIVDEKALAEAVSSGTIAGAALDVYGNEPLEVDSPLRKVGDRLILTPHLGASTEEAQENVSVDVAEQIRDVLLGLPARSAVNIPGLTPEVMERLKPHLQLAETLGLLLSQLAGGSIQDLEVRLQGEFAHHPSQPLVVAALKGLLSSALGDRINYVNAGIEARSRGIHVLEVKDDASRDFAGGSLQLTCRGGNGSHSVTGAVFADGDLRITTIDEFPVNVMPTRHMLITRHRDMPGIIGNIGSLLGEHNVNIASMQVGRRIVRGDAVMVLSLDDPIPPSLLISIHGINGIQEAHPVTL

SEQ ID NO: 1987 - protein, 552 aa, Lycopersicon esculentum
MASINISFPSTTFHSRSQANFKLFSGLHSGDVVSLNGVSSGSFIRLNARPHLTIKSDFKITSALLSGEGDIRFQSRGEKTLFSSLSTGTETQPDAVTFATLEADGVQTTSGFLSDDDECDLDRPTEGFSSVPEAIEDIRQGKMVLVTDDEDRENEGDLVMAASKATPEAMAFFVKYGTGIVCVSMTEEHLERLQLPLMVNDKKNEEKLCTAFTVSVDAKHGTTTGVSAHDRATTVLALASGDSKPEDFNRPGHIFPLKYREGGVLKRAGHTEASVDLAVLAGLDPVGVICEVVDDDGSMARLPMLRQFAKEHNLKIISVADLIRYRRKTDQLVEHASAARIPTMWGPFTAHCFKSIIDGIEHIAMVKGDIGDGQDILVRVHSECLTGDIFGSARCDCGSQLATAMKQIEAAGRGVLVYLRGHDGRGIGLGHKLRAYNLQDAGRDTVEANEDLGLPVDSRNYGVGAQILRDLGVPTMKFITNNPAQYSWLKGYGLAISGMVPVVTPFTNHYDTYLETTRAKMGHVYGLNLIRPATSTSTTNGKPNSENTSTIR

SEQ ID NO: 1988 - protein, 469 aa, Xanthomonas oryzae pv. oryzae KACC10331
MSVENVEKLIKDNKVEFVDLRFVDMRGVQQHITFPANIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALDALDKDREFLKAGGVMSDDFIDGYIALKMQEVTKFRAATHPLEYQLYYGN

SEQ ID NO: 1989 - protein, 142 aa, Triticum aestivum
GASTYNTFSSCPNPHQFDLDNVKFIGTSGQNIGDDLYRYSDAKDRLEFMERTLKWRHLAPTAPNSLGCYPYTDKDPFLVETCPHVYFVGNQDRYETRLLKGTEKQQVRLISIPRFCESGIAVMLNLRNLECSTLSFSTSFDA

SEQ ID NO: 1990 - protein, 498 aa, Yersinia pseudotuberculosis IP 32953
MSEYHEKNNALFKSITALDGALFINGEFRKGAGGRLPVENPATGKVIGHLAAATPEEIEEAVAAARRAFPAWAAERPKARANALHRLGDLIAADALNMARIMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVAACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYIYARDLAAIHRLSAALDYGNVAINNVDASMMNAPYGGRKQSGVGYEHGREGLLEYFNFKHIRLYHGIGD

SEQ ID NO: 1991 - protein, 249 aa, Candida glabrata CBS 138
MSLSREDSVFLTKLAEQAERYEEMVENMKDVASAGQELSVEERNLLSVAYKNVIGARRASWRIVSSIEQKEESKENSEHQIKLIKDYRAKIEAELTKISDDILSVLDKHLIPSASSGESKVFYYKMKGDYHRYLAEFSQGDVRENATKASLDAYQKASEIATTELPPTHPIRLGLALNFSVFYYEIQNSPDKACHLAKQAFDDAIAELDTLSEESYKDSTLIMQLLRDNLTLWTSDMSEADDQKNEESK

SEQ ID NO: 1992 - protein, 274 aa, Aeropyrum pernix K1
MPGDKVTARRILKMKGSRPIVAVTAYDYPTAWIADEAGVDVILVGDSLGMVVLGYPSTLQVTLDDMVRHTAAVARAAKRPLIVADMPFGSYEPSSSAAVESAVALARVGAEAVKLEGGSEYADRVKAIVDAGIPVMGHLGLTPQRAMRIGGYRPRARGRDEARRLLLDAESLVEAGVFSIVLEFVSEEAAEMVTRRVPVPTICIGSGRRCDGQIIVFHDIVGLSRHTPPFAKKYVDARRIMVEAVTRYAEDVRNGRFPGEEHVVHAKEPLEDIS

SEQ ID NO: 1993 - protein, 236 aa, Yersinia pseudotuberculosis IP 32953
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 1994 - protein, 468 aa, Pseudomonas fluorescens PfO-1
MKSLFPRVNKTNDEVFMNAPFDQLFTWLKDHKITEVECVVSDLTGIARGKIAPTNKFLHERGMRLPESVLLQTVTGDFVDDDIYYDLLDPADIDMVCKPVSDAVYVIPWAIEPTAIVIHDTFDKFGNPIELSPRNVLKKVLQLYTDKGWKPIVAPEMEFYLTQRCEDPDLPLKAPLGRSGRAESGRQSFSIDAANEFDPLFEDVYDWCELQGLDLDTLIHEDGPAQMEINFRHGDALDLADQITVFKRTLREAALKHNVTATFMAKPIGDEPGSAMHLHQSVVEIASGQPIFANADGSMSDLFRHHIGGLQKYIPKVLPMFAPNVNSFRRFLPDTSAPVNVEWGEENRTVGLRVPTSGPEAMRVENRLPGADANPYLAIAASLLCGYIGMVEGVEPSAAVEGRAYERRNLRLPITIEEALTQMEECDTVAQYLGSKFVRGYVAVKRAEHENFKRVISSWEREFLLLSV

SEQ ID NO: 1995 - protein, 226 aa, Zea mays
  misc_feature (123)..(123): Xaa can be any naturally occurring amino acid
  unsure (1)..(226): unsure at all Xaa locations
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGXLDGLGERCKKYYEAGARFAKWRAVLKIGENEPSELSIHENAYGLARYAGIWQENGLVPIVEPEILVDGPMTSTWCAAGTERVPWKKGFSLPGKKFLGGPPRTK

SEQ ID NO: 1996 - protein, 607 aa, Mycoplasma pulmonis
MYKKIFIFLTPLLLLTQTITISCINKNEKNWGDKNFKKNIEKENLNNLTYVDKSLEAKNEAPFIEKQKSNVIYQLTVYSFADGNNDGIGDFIGLKNNIDYFVKLGINTLYLSPIHPASSYHGYDVIDYLDVAPELGGMEAFKEFLKVSHANGIKVVMDLVFNHSSFEHPWFQEALNGNTKYQNYYYFLDENISKDTQGLGIDSQDLRNQFKNLKNKQASNKKYVAHFWPGMPDLNLNNSDLIKELKAIQRYWSKIGVDGFRYDAFYHFFDSNNQHKPRENGNQKINSIFQKLRSTNKEAINDNTQRSSKEPFLFGEWWKSPFEANDYLDIKNQGLDSVIDGRNWKDNINVSINAKEQRALLEFLNKNNSTWMPFLDNHDVERWINKVRRQINKNVASVDKLSELEISLMKYALVSLLSRAGSPILYNGNELNLHGGPKQAGDHFVREAFPWKDRTKQVDFYELRSGKENSRIFLNLSKNEEKIEDAIKNENSTFNLVKQLNEIRNKYQYVVSQDPNTIADLEEILSESEIRKYQNNLNLRKNNQGEYLLYIFGWGNNDISFKIKNNFKIDQILLQKNININTQTREISSSGIGTYAVLKINKKSEAI

SEQ ID NO: 1997 - protein, 544 aa, Mycoplasma pulmonis
MKTKISKWNEKIIYQIFPRSFYDSNNDGNGDLKGIINKLKYLKLLGINAIWLCPIYETDFVDAGYDVSNYKEVWKKFGTINDFKELVKEAKKYDIDIIMDIVLNHTSTNHVWFKKAIESENNPEHNYYIWTKNPKNEESIFGGSAWEYVPNLNKYYFHLFSKEQADLNWESNETISAMVDVVNYWYNLGVKGFRLDAIQHVHKELKDEQFSHSFSSKMVAFLQKFLNQVKKDKDDIFFIAEASGITPEKVLKYSKDEEKIADNFFNFSTWYVGWGKQTGRNGYDPNWTVDNLVNDNFIEYQNNDKIENLMITNFLSSHDTSRAISRWGNENLFWKESAKSLALFQFMQKGLQCILYGEEIGMLNSVFKTRDDFRDIDVYNSYQLFVDKNKVYTEEEMTRFHNINSRDHSRLPMIWNNKTNYGFNDGFKPWIQFGKYFKNASVEEQIEDQNSIFYFYKNLIEARNKYKNILVYGKSFFEFEKDKKLIKITRQDKDNNYIISLINLTPREIEINDQDLGEILLTTYTDKKEFKNILRPYESIMFLR

SEQ ID NO: 1998 - protein, 492 aa, Polaromonas sp. JS666
MPLTLSQTDLLRQQNFINHQWQDAQSGARLPVSDPATGLDFAHVPDSGAADALAAVDAAHAVFPAWRARSARERAQFLKRWHALILANQHDLGRLISREQGKPLAEGVGEVAYAASYVEWFAEEATRTYGDMIPEPARGRKLMVVKEPVGVVAAITPWNFPAAMIARKIAPALAAGCTVVAKPAEDTPLTSLALVLLAQQAGLPPGVLNMVTASREKTPEVVDVWLADARVRKITFTGSTPVGKHLARESAGTLKKLSLELGGNAPFIVFDDADIDAAVNGLMVAKFRNGGQTCVCPNRVFVQDAVHDAFVEKLRARVGALKVGPASAPDSQIGPMINARAVEKIERHVADAVAKGARIAVGGQRMEGAAYASPNYYAPTVLTGAHSGMACSLEETFGPVVPVTRFGSEAEVIAAANDTPFGLAAYFYSSNIARVWRMADALESGIVGINEGALAAEVAPFGGVKESGYGREGSRYGLEDYMHTKYLCQGLV

SEQ ID NO: 1999 - protein, 379 aa, Oryza sativa (japonica cultivar-group)
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 2000 - protein, 632 aa, Ralstonia solanacearum
MQSHDLLANFVIYLAAAVAVVPLARRLGLGSVLGYLLAGVIVGPWGLRLITNVQSILDFSEFGVVLMMFVIGLELEPARLWSLRRSIFGYGGLQLVVCALAVGLAVMAVDHPWRAAVVAGLGLALSSTAIALATLAERNLMRTPAGTASFGILLFQDIAAIPMIALLPLLAPDTGDTAGGHHWLAAAKAVGVVAAVIFGGRTVLRPVLRAIARTNMREMFTSFSLLLVVGIALLMHSVGLSMALGAFIAGVLLADSEYRHALETDIEPFKGLLLGLFFLAVGMSIDFGVLMRQPLAVVLLVAVFLVVKIGALRVLAMRFGIARGQAWLFAFLLSQGGEFAFVMFGPGVAGDVLGAETAATLNLVVALSMAATPLLLLFHDKILAPRLMAGKTRAPDAIGPQGNEVIIAGFGRFGQIVGRLLYSQGYTATVLDHDPDQVDMVRRFGFKVFYGDATRMDLLETAGADTARIMVVAIDDMETSLEVVDRVRERFPRLKLYVRARNVSHVYQLRDRGVEGIEREMFEGSLTLARHVLEGLGKEPYEALRVAQTFRRHALNSMDQLYPVYRDQKKLVPLAQQGREELAEMFRRDRLQRKRLRESGMPWGEGGPHTAGADAQDAGDGDAAGTPAAHEG

SEQ ID NO: 2001 - protein, 308 aa, Neurospora crassa
MADHTEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 2002 - protein, 535 aa, Yarrowia lipolytica CLIB122
NKNSRQECSGIYNKEDWGGKHDVYIEFTPEKLDTDDWLAFAIFEYRDVDKMGSDIPGDTGIKKYVCDQQAIDSNLCTKEQEGTYIIPKEGEVETYAKIETHRVNLREPETYRYDVSKTGYYCIATFSNDDNYKGKIFIQSAYGYLPGSQIPKHPFYGILSICYLVAFLLWMFSYWQHRQDVLPVQNYITGIFGFLVVEVMFVWSYYDIVNETGDSPGSKAFLVIVSILNSMRNAFTFFLLLIVCLGYGVVKPTLGNLMWKCQALGGIHFVFTLIFTIALYLMDPVDASNVILFLIIPLSITLTTFYIWILSSLTATTKYLVERKQHVKAQMYRNLWWILLGSVIVICGFFFFNALIMTSGSMTDTIVSEWKYRWFLFDGWVNVIYFIDFLLIAFIWRPTANNKRFAMSTELAQDENDAQEFEIGSLAGSDDEDDDEERNVGGIPQENPFGDHNRTSIDSMPDDVDLTRSDTKATLSGVYQKKDKEGASSSKSPEIEATDDATLFALDDEDEDDQQGESSRKKKGKGGEEEEGLLG

SEQ ID NO: 2003 - protein, 448 aa, Bacillus subtilis subsp. subtilis str. 168
MKHRYLPATEKDKQEMLATIGVSSIDDLFADIPENVKYKKEHQIKKAKSETELTRELTKLASKNRDTVQYASFLGAGVYDHYQPVIVDHVISRSEFYTAYTPYQPEISQGELQAIFEFQTMICELTGMDIANSSMYDGGTALAEAAMLASGHTKKKKIVVSKTVHPESREVLKTYAKGQYIDVVEVPAADGVTDLDALRQTVCENTAAVIVQYPNFFGRIEPLKDIEPIAHQGKSMFIVSANPLALGLLTPPGKFQSDIVVGDAHRFGIPSAYGGPHCGFFAVTKKLMRKVPGRLVGQTEDENGKRGFVLTLQAREQHIRRDKATSNICSNQALNALAASVAMTALGKNGVKDIARQNLLKANYAKQEAKKAGLTVMFDGPMFNEFVIKLDEPVRAVNKRLLAKGMIGGYDLGLTYPELDCHMLIAVTELRTKEEIDALIQELGDRHE

SEQ ID NO: 2004 - protein, 123 aa, Desulfovibrio desulfuricans G20
MSKHILIVDDSKTVRNLVAFIMKKEGFRVTMAEDGLDGLEKLYSAEETVDLIISDVNMPRMDGFTFIKTVREQDTYRDLPIVVLSTEGQEKDIQMGMSLGANLYMVKPAQPDKMVKNIKMLLG

SEQ ID NO: 2005 - protein, 592 aa, Escherichia coli O157:H7 EDL933
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTDFAWQAAVVGGIGLAMSSTAMALQLMREKGMNRSESGQLGFSVLLFQDLAVIPALALVPLLAGSADEHFDWMKIGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERR

SEQ ID NO: 2006 - protein, 404 aa, Magnaporthe grisea 70-15
MVLNKVDLLPTSVVASWIRVLSKEYPTAAFRSSITNPFGKGSLLGLLRQFSGLLSNRKQVSVGIIGYPNTGKSSLINALRGKKVATVAPIPGETKVWQYITLTKRMYLIDCPGIVPPSNDASPQDLLLRGAVRTEKVENPEQYIPAVLAKTKLRHMERTYDLSGWKDHIHFLELLARKGGRLLKAGEPDVDGVARMVLNDFLRGKIPWFTPPPALEGDAEGVDGREGRLGEMPLKRKRDDAESVADTSMGAPSPTSDDSEDDEVSGDDEFEGFGSDSAPDATPSESEKASVAEQYIQLEASSEDDSDDDAAEDGGVAITGVGGGDDDAEPPKSLSSRNSKPSRQQRKGLHKLVKARVVSTVTFAVPLSDEGMFWPSNPMENPSSGSAIIIHSCGSLLNNAEKGT

SEQ ID NO: 2007 - protein, 341 aa, Glycine max
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYYYISGFFLTVSPDSIQLVAEHAAANNKIFMMNLSAPFICEFFKGALDKVLPYMDYVFGNETEARTFSKAQGWETDNVEEIALKISQLPKASEKHKRITVITQGADPVCVAEDGKVKLYPVILLPKEKLIDTNGAGDAFVGGFLSQLVKQKPIEECVRAGCYAANVIIQRPGCTYPEKPDFH

SEQ ID NO: 2008 - protein, 343 aa, Ashbya gossypii ATCC 10895
MPPKKKQAEPKKKKDNVDKTFGMKNKNKSTKVQKFIKQVQSQADPQKEELKRKKLEEKKLKEAAEAERRALFNPVVEQKVRAGVDPKTVLCAMFKLGNCNKGARCKFSHDLSVGRKVEKRDLYQDARSEKEGDTMDKWDEAKLRDVILSKHGNPRTTTDKVCKYFIEAVENGKYGWFWVCPNGGDKCMYRHALPEGFVLKTKEQKRLEREAIENQPKITLEEFIETEREKLDKTRLTPITVENFAEWKKRRISQKLNAEKENGAKRRPSGREVLLKKYMEDKKFSDMDEDYEDKGSAWDLSEFTKALRDEDGSTGIKDYGDGSNPNFEIKKAVEEGSGSLTAA

SEQ ID NO: 2009 - protein, 146 aa, Triticum aestivum
  misc_feature (96)..(96): Xaa can be any naturally occurring amino acid
  misc_feature (114)..(114): Xaa can be any naturally occurring amino acid
  unsure (1)..(146): unsure at all Xaa locations
MSGEDVRKVSRQDIQLVQNLIERCLQLYMNQKEVIDTLSLEAKIEPSFTELVWQKLEEENREFFKAYYLRLMLKNQITAFNKLLEDQFQLMNKDYXSGIPSMPLTNGSNSTTFXQNLCFFTRSLGPIFCNGQMVGMRQWKFHGGFK

SEQ ID NO: 2010 - protein, 430 aa, Pseudomonas sp. QDA
MMIPVILSGGSGSRLWPLSRKQFPKQFLALTGEHTLFQQTLERLAFEGMDTPIVVCNKDHKFIVQEQLAALKLETQGILMEPFGRNTAPAVTMAAMKLVNEGRDDLMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDADIYDTCVLALERSEEEDEVLSIDEATFACCPDNSIDYAVMEKTQRACVVPMSAGWSDVGCWSSLWDVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPV

SEQ ID NO: 2011 - protein, 498 aa, Arabidopsis thaliana
MVIHKSITPIALMLLLLLAIHAHIQVVGSTTVTSVSLANLKHETSSEINFPVWRRELRGGGGGGRGGGGGHGGGGGEDFALLLRSKNLELLTMETSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGFGLVLFYQDSFFGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 2012 - protein, 258 aa, Rhodospirillum rubrum ATCC 11170
MNARLWIGTSWKMHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 2013 - protein, 299 aa, Arabidopsis thaliana
MFRVAGTLSAASSPAVAAASFSAALRLSITPTLAIASPPHLRWFSKFSRQFLGGRISSLRPRIPSPCPIRLSGFPALKMRASFSSGSSGSSASREILVQHLLVKNDDVELFAELQKKFLDGEEMSDLAAEYSICPSKKDGGILGWVKLGQMVPEFEEAAFKAELDQVVRCRTQFGLHLLQVLSEREPVKDIQVEELHSKMQDPVFMDEAQLIDVREPNEIEIASLPGFKVFPLRQFGTWAPDITSKLNPEKDTFVLCKVGGRSMQVANWLQSQGFKSVYNITGGIQAYSLKVDPSIPSY

SEQ ID NO: 2014 - protein, 445 aa, Mycobacterium avium subsp. paratuberculosis K-10
MGSSDQATAHARAQAASARLFDDACAVIPGGVNSPVRAFTAVGGTPPFITAARGCRLTDADGNHYVDLVCSWGPMILGHAHPAVVEAVAKAAASGLSFGAPTPAESELAAEMIARVAPVERIRLVNSGTEATMSAVRLARGFTGRAKIVKFSGCYHGHVDALLADAGSGVATLGLPSSPGVTGATAADTIVLPYNDIDAVRQAFTEFGDQIAAVITEASPGNMGVVPPAPGFNAALRALTADHGALLIVDEVMTGFRVSRSGWYGIDPVDADLFTFGKVMSGGLPAAAFGGRAEVMERLAPLGPVYQAGTLSGNPVAMAAGLATLRHADAAAYAALDANADRLARLLSDALTNAGVPHQIPRAGNMLSVFFTDTPVTDFASARATQTWRYPPFFHALLDAGVYPPCSAFETWFVSTALDDDAFDRIAAALPAAARAAAGADEGNS

SEQ ID NO: 2015 - protein, 344 aa, Photobacterium profundum SS9
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 2016 - protein, 255 aa, Ashbya gossypii ATCC 10895
MSVTPIEELPSLGDALEDAKRAASYRAVDENLDPAKHRVVGIGSGSTVVYVAERIGKYQASPELKAKVEFICIPTGFQSRQLILDNGLRLGSIEQYPEVDIAFDGADEVDPELNLIKGGGACLFQEKLVSTSSAQFIVVADSRKRSPQRLGTSWTRGVPVEVVPSAYVRVLRDLHGIPGCRSAQLRLGEPGKAGPVVTDNNNLLIDADFGPLEDPAALHARIKALVGVVETGIFAGNAAKAYFGSADGSTQTLAR

SEQ ID NO: 2017 - protein, 220 aa, Leuconostoc mesenteroides subsp. mesenteroides ATCC 8293
MAAKLVLVRHGESTANRDNEFTGWTDVPLTLKGVRQANRVGEVLKRHGLQFDVSFTSFLKRAIITDNIILEEIEQLWLPLHKAWQLNERHYGALRGLNKDYARQQYGANKVALWRRSYTATPPLLEHVIPDRRYPEDLEPRGESLKMASDRLVPYWHSEILPQIQQDKNVLIVAHGSSLRALVKYIEHISDEDIDGLEIDNGEPILYEYEEGFSERIYLE

SEQ ID NO: 2018 - protein, 468 aa, Pseudomonas taetrolens
MSKSVQLIKDHDVKWIDLRFTDTKGTQHHVTMPARDALEDDFFEVGKMFDGSSIAGWKGIEASDMILLPDDDTAVLDPFTEDATLILVCDIIEPSTMQGYDRDPRAIAHRAEEYLKTTGIGDTVFAGPEPEFFIFDEVKFKSDISGSMFKIYSEQGSWMSDQDIEGGNKGHRPGVKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSETALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 2019 - protein, 839 aa, Oryza sativa (japonica cultivar-group)
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSYPPHIAAYRSGLEIDPNISKTDAEDGLRKELSGQRPLRITNKNLIDYLFTCSLEIAVSYHLPMQIHTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAESGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 2020 - protein, 266 aa, Corynebacterium diphtheriae
MSSDSRAPLDIAWLHEQLVENGPYNRLEHTMATGSTNTDLVAAAHAGAPEWTAFLTEHQSQGRGRMGRKYESPVGAQLTLSVLIRPRKESVSRLGTMPLATGLALVDVLGSDPRIGLKWPNDLLCDGRKLCGILAEAVSLGDHPAVVIGLGLNTALTKEELPVAHATSLDLEGIAYERNQLAVDVLNALYKRLNQWIAGDPSLMGDYRRVCTSIGADVRVVLSEDKELLGVAESVTDEGLICVRDASGELHEFMVGDVTHLRLQDK

SEQ ID NO: 2021 - protein, 215 aa, Candida glabrata CBS 138
MSDYKPFPAYQGNSNVSAQGSRLRSSSQVSTGASDPVKDHRRKRSSSIISHVEQETFEDDVDQQLLPNMNASWVNQRGAWIIHIVVIVLLKMFYNILPGITAEWSWTLTNMTYIIGFYIMFHLVKGTPFEFNGGAFDNLTMWEQIDHETLFTPSRKFLLAVPIALFLVSTHYAHYDLNLFLWNLAVTIFVGVVPKLAWAHRLRISIPGVMRAQIS

SEQ ID NO: 2022 - protein, 473 aa, Bacillus cereus E33L
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKRGGDVKDLKFKTPLYPFVPLLALVLNVTVIVGMAFIPEQRMALYCGIPFMIVCLLFYRATRNKAHKVEHIEKTDTTEVESL

SEQ ID NO: 2023 - protein, 297 aa, Yersinia pestis biovar Medievalis str. 91001
MRYAFPTQQLKDNVMQTVKLNNGIAMPLLGFGVFQMTNTAECERAVIDAIETGYRLIDTAASYQNETQVGNALKLSGIARDELFITTKLWLQDTYYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 2024 - protein, 254 aa, Cryptococcus neoformans var. neoformans JEC21
MEEHRKRHGRRLDYEEKKRKRTAREAHKASADAQKIFGHKAKLHHARRHAEKVQMKKTLKAHDERNVKQKDDGAVKEGALPAYLLDRDGQKDAKALSSAVKDRRKDRAAKYSVPLPKVRGIAEEEMFKVIKTGKSKSKSWKRMVNKATFVGEGFTRKPVKLERFIRPMGLRMTKANVTHPELKTTFQLPILGVKKNPQSPLYTSLGVLTKGTILEVNVSELGMVTTGGKVVWSKYAQITNNPENDGCINSVLLV

SEQ ID NO: 2025 - protein, 396 aa, Bacillus cereus G9241
MKQFELSRAAESLQPSGIRKFFDLAANMKGVISLGVGEPDFVTPWNVRQACIRSLEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEVYTSFASIKNMRDHTILISGFSKGFAMTGWRLGMIAAPVHFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKHNTFCP

SEQ ID NO: 2026 - protein, 525 aa, Ashbya gossypii ATCC 10895
MATDIKAPLLVHTEDLEGSGTSSDSARSYYGGVKIAEDVISPVLANEVPQGRHLGLFSTVVMFVSRIVGSGIFATPSTMFVNCGGNALLFVTVWIVAMLAAFSGLYLYLEFGCLLPRSGGPKNFLEAVYDRPRMMMSVAFASFSVLTGFTVSGAIVFGKYVNEDSAMCNYIGAAAVMLIVVIHGSSVKHGIIVQNILGGMKFLLIAVMSVTGIYAVFFFDTRADDQNPAYYVKSHFWESRDSSLITASSLTASFMQAFFCFSGWDGVHSVVSEVKDPVRTMRIAGPFSLLIALGCYMLLNFAYLFVLSWEEIQGAGPLIGSILFSKLYGPTLGGKFVTLCVAVSTASNLFVVIYGTSRMNQEFFREGYLPFSKQMASNWPWGSPLPSLLCCGLITVAWLCFLPPSGAAYDYLVNFEGYSKQFFLMLIAIGLFIYRHRHPDIVAEIRASMIGVAFLAVISVYLMVGPFFGDQSGNGVSWLPPYQITTLLMFLVCFLYWLLKFVLLPRLLGYRIQTLIVTLSDGLEI

SEQ ID NO: 2027 - protein, 416 aa, Helicobacter pylori 26695
MENSTLYIVIAGLWLAVGFGIFLKKLDMPVIIGYICTGTVLAAFFKINDFDLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSNVNLLILKTFISAGIILVLLLLPGKKGANLILEQAKDTRLPEIFIGTILVIVCSAAGLSHFFGFSMSLGAFIVGMAISKSRYKINVQEEFAQLKNLFLALFFITIGMQINVSFFMEKFFVVIFLLILVMGFKTAIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 2028 - protein, 495 aa, Oryza sativa
MASAVAPDIWHWTRSLPNPKHWRGKSYYLQICNSPSTNQSLNLIISWHSETQSFNLSYSICAEHHDPVSLWSSHYSRLKSVNGSDFAIHFFHDIICGVLRYGPYSNKMSPFRLPNVQVSEDTGKIFNLAALTLALMVCIYEAPSTLRRDLIGTVSAQLIRGDMWGAAKKLMLAMGSDMEEQWMRSLNLAVTNWIIETRRSGGTPVSPFTVFSYAVSAIRLWKVELYCPVVAMIMEHPAHQTKDEKLQFSLNYQHLEAVIQFIYRVTFRENWIDVTVNVDNIRCDLIQLVSETLMAKQGYGSDEKHFPSRISLQLTPLVQTDILSLTVSRSTDNPAQEVDTEMGLDATLSAAPATIGITMSAHETVTRTLRPWKFEHSVHGNTAALNWFLHGGAEGREVFSSEPHKRELLQPRSWFRNRYTNPGRPFTRGGGVIFAGDEYGESVCWRMPAAAAGKTVEWEMKGRIWVTYWPNKKRTLHVETRRVEFRELLRLTIRE

SEQ ID NO: 2029 - protein, 557 aa, Zea mays
  misc_feature (203)..(203): Xaa can be any naturally occurring amino acid
  misc_feature (259)..(259): Xaa can be any naturally occurring amino acid
  unsure (1)..(557): unsure at all Xaa locations
MATMKLGSKPEIFVLQDLTWRCTTELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTXSSAAAAAAAAGMDWWYEDVSFLSLPMFKRLIQAMEAKGMRDESIAGAIMFYAGRFXLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGCPQADADSDVEGDAPDGKETITDVKARVSDLEKECKSMKQEIRRLGKPRRSWSLLTRKCGFGAKVQQAQTAMSGK

SEQ ID NO: 2030 - protein, 186 aa, Triticum aestivum
PGSTILCADGTITLTALSCDPEKGLVRCRCENSALLGERKNVNLPGVIVDLPTLTEKDKVDILQWGVPNKIDMIALSFVRKGSDLQMVRSVLGEHAKSIILMSKVENQEGVANFDDILANSDAFMVARGDLGMEIPIEKIFFAQKVMIFKCNQQGKPVVTATQMLESMIKSPRPTRAEATDVANAV

SEQ ID NO: 2031 - protein, 524 aa, Synechococcus sp. WH 5701
MVLAILDGWGFREEARHNAVQGASTPVMDALWEVYPHTLIQASGGDVGLPDGQMGNSEVGHLTIGSGRIIRQELVRIGKAVRDGSLAANPALNELADRLLRDGGTLHLLGLGSDGGVHSHIDHLGGLLQWAASRGLSDVCIHVITDGRDTPPQSAIPYLECIEAQVEAAGVGRISTICGRYWAMDRDNRWERTEKAYRLLSEDGEITSLSFQEAIHAAYAEGINDEFLEPLRLAPGSLKPGDGLICFNFRPDRVRQLIRSLVLDDFDQFERKRISPLHVVTFTQYELGLPVAVAFPPESLDGLLGQVVSAHGLRQLRTAETEKYPHVTYFLNGGIEQPFPGEDRHLVPSPRVATYDQAPAMAADQLTDNCIAFLNKGVYSLVVINYANPDMVGHTGRMDATQQAITTVDHCVGRLVEATNRLGGTVLITADHGNAELMEGEDGRPWTAHTTNPVPVILVEGEKRKIGGHGAAPQLRQGGGLADIAPTLLQILGLPQPSSMTGSSLVEPLDLVSPKAAFAEALQV

SEQ ID NO: 2032 - protein, 348 aa, Arabidopsis thaliana
MKATLAAPSSLTSLPYRTNSSFGSKSSLLFRSPSSSSSVSMTTTRGNVAVAAAATSTEALRKGIAEFYNETSGLWEEIWGDHMHHGFYDPDSSVQLSDSGHKEAQIRMIEESLRFAGVTDEEEEKKIKKVVDVGCGIGGSSRYLASKFGAECIGITLSPVQAKRANDLAAAQSLAHKASFQVADALDQPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSLLRSGMKSIKGALTMPLMIEGYKKGVIKFGIITCQKPL

SEQ ID NO: 2033 - protein, 208 aa, Vibrio harveyi
LAPHREEIGKNIRTMIMGIPNVGKSTIINALAGRTIAVTGNQPAVTRRQQRINLQNGIVLSDTPGILWPKVENPHSGFRLAATGAVKDTAMEYDEVAFYTVEYLAAHYPEKLKERYQIDELPESDIEIMEEIGRRRGALRAGGRVDLHKVSEILLHELRQGTLGQITLELPEMITQELIEVEIETARKEEEKAKRKEERRKRYLRNKR

SEQ ID NO: 2034 - protein, 553 aa, Oryza sativa
MCAGSVVGLGMAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 2035 - protein, 319 aa, Triticum aestivum
MTEVIEGDVDSIIARLLEVRGSRPGKQVQLLENEIRYLCQKSREIFMNQPILLDLEAPIKVCGDIHGQYYDLLRLFEYGGFPPDANYLFMGDYVDRGKQSLETICLLLAYKIKYPENFFILRGNHESASINRIYGFYDECKRRYNIKLWKTFTDCFNCLPIAAVIDEKILCMHGGLSPDLQSMEQIRRVMRPTDIPDTGLLCDLLWSDPDKDIVGWSGNDRGISFTFGADIVSKFLQKHDLDLICRAHQVVEDGYEFFAKRQLVTLFSAPNYCGEFDNAGAMMSVDESLMCSFQILKPAEKKAKTGLNNKQRNTRGRVM

SEQ ID NO: 2036 - protein, 137 aa, Zea mays
  misc_feature (21)..(21): Xaa can be any naturally occurring amino acid
  unsure (1)..(137): unsure at all Xaa locations
EGILLKPSMVTPGAEAKDRAXPEQVTAYTLKLLHRRIPPSVPGIMFLSGGQSEVEATQNLNAMNQGPNPWHVSFSYARALQNTCLKTWGGQPDKVKAAQDALPLRAKANSLAQLGKYTSDGEAAEAKEGMFVKNYSY

SEQ ID NO: 2037 - protein, 429 aa, Sulfolobus tokodaii str. 7
MRKLLRDEVLEVLKSGRVDYVRVVFADILGNSRGRSLRRIEFEKSLNKGIEYSEALLYLDYKDTPIKQRYGDIFAVPDISTFVLIPYLERTARVLSFLTTQDNSPHPLCTRSLLTRSIDKLAELGYNIKVAFEPTFYLINFKDGKPVPADEARAFSSEGLMEQQNFLRDLIKYLESVNIQVQYINKHYAPGQYEITFSMGEALEEADSLITAREIIRDTARLYHLYSTFMPKPFKEYPSSSMDIYIKLVDTQNKSVGVDTSDPRGLGLSKILYSFLAGILEHISSILAIAAPTINSYKRYREVVTPNVAGIGNERHFIIRIPSTYRDLGVFEFRLADPLANPYLLLSSMIFAGIDGIEKGLDIDVNYEVSTLPTNLKEALYKLDSDTKLKYYLGKELVDTFIELKKKEIEDYEKEITEWEINSYLKSGW

SEQ ID NO: 2038 - protein, 415 aa, Oryza sativa
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMKLVSWYDNEWGYSNRVLDLIGHMALVNAKP

SEQ ID NO: 2039 - protein, 575 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSSSCLLIIGLYYALHFCQYETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 2040 - protein, 286 aa, Photobacterium profundum SS9
MDSAIARPRIGRKTSMSSDQVHLGHRARKRFGQNFLNDPYIIDGIVSSINPLPGQNLVEIGPGLGALTEPVGRLVDKFSVIELDRDLAKRLRHHPDLADKLTIYEGDAMRFDFTQLIKPNNKLRIFGNLPYNISTPLMFHLFTFHEHVEDMHFMLQKEVVNRLAAGPGCKAYGRLTVMAQYYSRVTPVLEVPPESFTPAPKVDSAVVRLTPYEVLPHPCTNLKWLDRVCREGFNQRRKTIRNCYKALLTVEQLEDLGVNPGLRPENITLQQFVKMANWLDANHQNA

SEQ ID NO: 2041 - protein, 489 aa, Arabidopsis thaliana
MTETGLILMWFPLIILGLFVLKWVLKRVNVWIYVSKLGEKKHYLPPGDLGWPVIGNMWSFLRAFKTSDPESFIQSYITRYGRTGIYKAHMFGYPCVLVTTPETCRRVLTDDDAFHIGWPKSTMKLIGRKSFVGISFEEHKRLRRLTSAPVNGPEALSVYIQFIEETVNTDLEKWSKMGEIEFLSHLRKLTFKVIMYIFLSSESEHVMDSLEREYTNLNYGVRAMGINLPGFAYHRALKARKKLVAAFQSIVTNRRNQRKQNISSNRKDMLDNLIDVKDENGRVLDDEEIIDLLLMYLNAGHESSGHLTMWATILMQEHPMILQKAKEEQERIVKKRAPGQKLTLKETREMVYLSQVIDETLRVITFSLTAFREAKSDVQMDGYIIPKGWKVLTWFRNVHLDPEIYPDPKKFDPSRWEGYTPKAGTFLPFGLGSHLCPGNDLAKLEISIFLHHFLLKYRVERSNPGCPVMFLPHNRPKDNCLARITRTMP

SEQ ID NO: 2042 - protein, 390 aa, Pseudomonas putida KT2440
MAQPYSARSRAIEPFHVMALLARANELQAAGHDVIHLEIGEPDFTTAAPIVAAGQAALAAGHTRYTAARGLPALREAIAGFYGQRYGLNIDPERILITPGGSGALLLASSLLVDPGKHWLLADPGYPCNRHFLRLVEGGAQLVPVGPDVNYQLTADLVERYWDKDTVGALVASPANPTGTVLGREALACLARTTHERHGHLVVDEIYHGLTYGMDAPSVLEVDDSAFVLNSFSKYFGMTGWRLGWLVAPPGAVADLEKLAQNLYISAPSMAQHAALACFQPEALAIFEERRAEFARRRDYLLPALRELGFRIAVEPQGAFYLYADISAFGGDAFAFCRHFLETQHVAFTPGLDFGRHLAGHHVRFAYTQSLPRLEEAVQRIARGLQSWQG

SEQ ID NO: 2043 - protein, 391 aa, unidentified bacterium
EFQTGDVLRISMDENLEGTKEKIAVTYAGLFDDVQVGGQVLFDDGLLGTTVLEKDVANRELVVRVDNDGILGSRKGVNAPGVSINLPGITEKDADDIRFGLDHGINYIAASFVRKPEDVLEIRGLLKEKNMEHVQIVPKIESQEGIDNLDAIIAVSDGLMVPRGDMGVEIPAENVPLVQKEMIRKMNLAGLPVITATQMLDSMEENPRPTRAEASDVANAVFDGTDATMLSGESANGEYPVEAVATMAAIDEKAESSLPYYGRHQDLHFDETDSTEAVASAVSRIAHSVNAKAIVVSTNSGYTACMVSKYRPEVNILAVTYSERVQRGLTLNYGVLPVVYEAPATIDEMIALAKTAVKEQGLANSGDTIVIAAGVPMSQSGTTNMITVQTV

SEQ ID NO: 2044 - protein, 339 aa, Burkholderia xenovorans LB400
MDTRSELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYEAAQEKS

SEQ ID NO: 2045 - protein, 150 aa, Arabidopsis thaliana
  misc_feature (7)..(7): Xaa can be any naturally occurring amino acid
  unsure (1)..(150): unsure at all Xaa locations
AFPVTRXTNKDIISMASNGERVNCIKVWPPIENKKFETLSYLPDLSAVELAKEVDYLLRNKWIPCVELELEHGFVYREHGNTPGYYDGRYWTMWKLPLFGCTDSAQVLKEVEECKKEYPGAFIRIIGFDNTRQVQCISFIAYKPPSFTEA

SEQ ID NO: 2046 - protein, 175 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 2047 - protein, 236 aa, Zea mays
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQGLKEVQECKTEYPNAFIRIIGFENNRQAQGISFIASKTHRLPRGFNLRWNENFQHKKTPGLQFHLPNGLGSFSPFGFSLFPKNFKIRNCKNWVKEETRN

SEQ ID NO: 2048 - protein, 505 aa, Polaromonas sp. JS666
MSTLRRIAGQCPSPDTSQIPSCQDPNLMTYPNTQLFIAGEWQEAADGRSLAVFNPATGKEIGRVAHAAKVDLDRALAAAQQGFETWRKVPAFERSKIMRRAAGLMRERAGEIAAVLTQEQGKPLAEAKVEAMAAADIIEWFAEEGFRVYGRVVPSRNLATRQLVLKDPVGPVAAFTPWNFPINQAVRKLSAALATGCSIIVKAPEETPAGPAALIQAFADAGIPAGVIGLVYGNPAEISGYLIPHPVIRKITFTGSTPVGKQLAALAGQHMKRVTMELGGHAPVIVAEDADVELAVKAAGGAKFRNAGQVCISPTRFLVHESIRNDFAAALVKHAQGLKVGDGLGEGIQMGPLANPRRLTAMAEFTQDAVQRGAKVAAGGERIGDLGNFWAPTVLTDVPLDAKVFNDEPFGPMAAIRSFNTLDEAIAEANRLPFGLAGYAFTRSLKNAHALSQHVEVGMLWINQPAAPWPEMPFGGVKDSGYGSEGGPEALEAYLNTRAVSIMNV

SEQ ID NO: 2049 - protein, 462 aa, Escherichia coli O157:H7 EDL933
MTANSPLQRVGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 2050 - protein, 307 aa, Arabidopsis thaliana
MYARGIQASWSGGKGTSTEAPATRVAEFVFSGQVNVRNHISNIVPPPSRLCLLVAGFIDKTVRCLGYGASSEERTLAMIKPDGVSGNYTEEIKTIVVEAGFNIVKEMLTQLDKETASAFYEEHSSRSFFPHLVTYMTSVLAIILPQSLLCLHLLMCVNCIFETSGPVLVMVLEKRNAVSDWRDLIGPTDAEKAKISHPHRFDLLPNTILDFANSNVRAKMNIVVSCCSLILFTYNMAFSCFCSIRALCGKNSQKNCVHGSDSTSSAEREIKFFFKDVVSVLHNSGLAQVSGEYVKRPIRLVVYGSYS

SEQ ID NO: 2051 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 2052 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 2053 - protein, 129 aa, Arabidopsis thaliana
MAYFSTATSLLLLVLSVSSPYVHGASDCDTLVITLFPCLPFISIGGTADTPTASCCSSLKNILDTKPICLCEGLKKAPLGIKLNVTKSATLPVACKLNAPPVSACDSLPPASPPTANGQGKWNLFGLFA

SEQ ID NO: 2054 - protein, 186 aa, Triticum aestivum
NKFVQKSRLVPVRNSRDIVDPRVRKKAAIQCLKRKRLYEQQVEQLGNFQLRIHDQMIMLEGAKATTETVDALRTGASAMKAMHKSTNIDDVDKTMDEINDNMENMRQIQDLLSAPMGAASDFDEDELEAELADLEGEELEAQLLAPTTSAPMTAPARVPQQSSRPTAQSSKTEDDELAALQAEMAM

SEQ ID NO: 2055 - protein, 266 aa, Pseudomonas putida KT2440
MPEVTLTTLNGLKAKGEKITMLTCYDATFAKAASQAGVEVLLVGDSLGMVLQGHDSTLPVTTAEMAYHTASVKRGNDGALILTDLPFMAHATPEQAFANSATLMQAGAHMVKIEGAAWLAETIRLLAERGVPVCAHMGLTPQTVNVLGGYKVQGRQEAQARQMRADAIALEQAGAAMLLLECVPSELAAEITNAVGIPVIGIGAGSATDGQVLVLHDMLGLSLSGRVPKFVKNFMQGQPDIHSALVAYVEAVKQVSFPGSEHGFSA

SEQ ID NO: 2056 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 2057 - protein, 466 aa, Leuconostoc mesenteroides subsp. mesenteroides ATCC 8293
MSLLARAFKRESVDNYLSADSHMSRVLTTRDLISLGVGTVIGTGIFILPGHEAADHAGPAVAIAFLIAAIFSGLSGMAFAEFSAAMPVAGSAYSYGGAIYGEIIGWLLGWSLIVEYFLAVSAIATGFSAYLGNLLAIFGIHIPKYLSAGPMEGGIVNLFAVLIILFVAAILSRGLNTSKKVENGAVVIKIAILILFIVGGSFFIKTSNYVPFYPKEFHSGLGGLNGIWAATASIIFAFLGFDTIAAHAAEVKNPQKTMAKGIVGTVIISALLYTLFSIVLTGIVNYKKLGVDDPAAFALQVVHQTQFSIVITIGALIGMFTAVLALIYASSRLTYSFGRDGLLPRSLGKISPGSHLPVNALILAVAVEVIFAGLIPLSTLASLINAGTLTAFAFINFGILILRRRKDLAHDGFKVPGYPIVPFIAGMISLFFITQLSAETLKMFGLWLLLGVIWYFSYGIKHSKLS

SEQ ID NO: 2058 - protein, 257 aa, Crocosphaera watsonii WH 8501
MSIDPRKIQIQLQKPELPLHIFDTVTSTNQVVWDLLAEGNPFPLMAIASQQTAGRGQWGRNWVSAVGGLYLSIGLKLQITAQNAPHLTLFSAWGIAENLPRYGLPVKLKWPNDLILQGRKLGGIKSETRIQQETITHCVIGVGINWCNQTPDPGITIQSYDKPHNIDSLETLAAITTNGVFRGYDHYLSNGIDNLLRNYIEILDSVGRKVIIEGMTGTIIGVSTQGELKVSLQAPGSKTTLKLPPGTLSLGYSQGET

SEQ ID NO: 2059 - protein, 268 aa, Haemophilus somnus 2336
MKSKTHLGHTARKRFGQNFLHDNNIIQNIVMAIYPQKEQFLVEIGPGLGALTEPVAEKVERLTVIELDRDLAERLRHHPFLHQKLNVIEYDAMQFNFEQLYIDENLAEKNQKLRVFGNLPYNISTPLMFHLFKYHAIIQDMHFMLQKEVVKRLCAAPNSKAYGRLTIMAQYFCQVLPVLEVPPTAFKPAPKVESAVVRLIPHKELPYPVKDLYWLNRVTTQAFNQRRKTLRNALSTLFSAEKLTALAIDLEARAEIYLLLIMQDWQII

SEQ ID NO: 2060 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVALPVRIEKGPSSEEIKKAIKAASEAPLKGIMGYVEEDLVSPDFPGDSRSSIFDAKAGIPLNAHFIKLVSWYANEWGYSTRVVALIPPMFKPQ

SEQ ID NO: 2061 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 2062 - protein, 326 aa, Brassica napus
  misc_feature (177)..(177): Xaa can be any naturally occurring amino acid
  misc_feature (188)..(188): Xaa can be any naturally occurring amino acid
  misc_feature (269)..(269): Xaa can be any naturally occurring amino acid
  unsure (1)..(326): unsure at all Xaa locations
MWFFGKKGASGFSARSTAEEVTHGVDGTGLTAIVTGASSGIGVETARVLALRGVHVVMAVRNTGSGAKVKEDIVNRVPGAKLDVMELDLSSMDSVRKFASDYKSSGRPLNLLINNAGIMACPFMLSKDNIELQFATNHLGHFLLTKLLLDTMKNTSRESKRGGRIVNLSSEAHRYSXPEGVRFDKITXTKSSYSSIRAYGQSKLCNILHANELAKQLKEDGVNITANSLHPGAIMTNLGRYFNSYLAGAVGAVAKYVLKTVPQGAATTXCYVALSPQVTGVTGEYFLDSNIAKPISLAKDSELAKKVWDFSTKLTESQSGESSTSN

SEQ ID NO: 2063 - protein, 436 aa, Catharanthus roseus
MATRNVVQVPQQNRDAAPAGMKQKNMAGEGKIRRALGDIGNLVTVRGVEGKPLPQVSRPITRSFCAQLLANAQAAAVAENNKKCKAVNVDGAADGGIIPKGARKPAQKKAATIKPKPEAVIEISSDSEQVKKEKKPSKKDAPTLTSTLTARSKAACGLSKKPKDQIIDIDAADADNELAVVEYVEDIYKFYKIAENESRVHNYMDSQPEINDKMRAILIDWLIEVHHKFELNPETLYLTINIVDRYLAVQTTLRKELQLVGMSAMLIASKYEEIWAPEVNDFVCISDRAYSHQQVLVMEKRILGGLEWNLTVPTPYVFLVRFIKASVPDSNMENMVYFFAELGMMNYSVAMMYCSSMIAASAVYAARCTFNKTPSWDDTLKLHTGFSEYQLIDCAKVLVNLHAMAADNKLKVIFRKYSSLERGSVALLPPAKSLLA

SEQ ID NO: 2064 - protein, 830 aa, Arabidopsis thaliana
  misc_feature (172)..(172): Xaa can be any naturally occurring amino acid
  misc_feature (312)..(312): Xaa can be any naturally occurring amino acid
  unsure (1)..(830): unsure at all Xaa locations
MTTIPFCFLFVAFFFSSSTADQRHHSRHLLHQPFFPVVTAAPPPYQPPVSSQPPSPSPHTHHHHKKHLTTTTPPPHEKHLFSSVANPPPPPPSPPHPNPFFPSSDPTSTASHPPPAPPPPASLPTFPANISSLLFPTHNKQSKPPSNGHIARLVTITALHYPQNRSRVRTLXSSSSSSAIATMLSLSIATPGTAAIFRRGTASATSTSSSFHGVRIQHQVSARVPAAATISSSSPKPSVVMMSKREAELKEIRSKTTEQLQEEVVDLKGELFMLRLQKSARNEFKSSDFRRMKKQVARMLTVKREREIKEGXRKGCRGKKLDRQWKKSIVPRPPPSLHESLKARPPPPPPPPPQVSEVPATMSHSLPGDDSDPEKKVETMKPKLKTLHWDKVRASSSRVMVWDQIKSNSFQVNEEMIETLFKVNDPTSRTRDGVVQSVSQENRFLDPRKSHNIAILLRALNVTADEVCEALIEGNSDTLGPELLECLLKMAPTKEEEDKLKELKDDDDGSPSKIGPAEKFLKALLNIPFAFKRIDAMLYIVKFESEIEYLNRSFDTLEAATGELKNTRMFLKLLEAVLKTGNRMNIGTNRGDAHAFKLDTLLKLVDIKGADGKTTLLHFVVQEIIKFEGARVPFTPSQSHIGDNMAEQSAFQDDLELKKLGLQVVSGLSSQLINVKKAAAMDSNSLINETAEIARGIAKVKEVITELKQETGVERFLESMNSFLNKGEKEITELQSHGDNVMKMVKEVTEYFHGNSETHPFRIFAVVRDFLTILDQVCKEVGRVNERTVYGSMPLHSPSNQTATPLFPVVINNNSRLSPSGSLDDDDGSF

SEQ ID NO: 2065 - protein, 107 aa, Zea mays
  misc_feature (45)..(45): Xaa can be any naturally occurring amino acid
  misc_feature (86)..(86): Xaa can be any naturally occurring amino acid
  unsure (1)..(107): unsure at all Xaa locations
MLYAYRIADELIKNADYIGTPDKGILAADESTGTIGKRLSSINVXNVDENRRALRELLFCCPGALQYISGVILFEETLYQKTKDGXPSVDVLNEGGVLHSIKVDKGT

SEQ ID NO: 2066 - protein, 138 aa, Triticum aestivum
HYRTSLYKKAGWYRSGIPGISSTHASVLILEKLIVLLRDGRKLLGTLCAFDQFANVVLQGACERVIVGELYCDVPLGLYVIRGENVVLIGELDREKDELPSHMTCVSEAEIRTADKAEKEARDLKGTMRKRMEFLDFD

SEQ ID NO: 2067 - protein, 373 aa, Myxococcus xanthus DK 1622
MSHDSEISSIDDAIRDIQEGKFVIVADDEDRENEGDLIMAAEKVTPEHLAFMVRHTSGIVCMPMLAERLDELRLPQMVSDNTESHRTAFTVSVDYRHDTHTGVSAADRAKTIRALVDPSSKADDFLRPGHIFPLRYREGGVLRRAGHTEATVDLSRLAGLSASGILCELVKDDGTMMRMPDLKVFAREHKLSLITIADLIEYRRRKDRLVRREPGQQTVNTRYGEFTALTYSWLPDGVKSLVLVKGDPASRPSTLVRLHAACALGDVFGSPSCNCNVLLDQALARIAREGSGVLVYLPGMHGDDFGIHHKRNNDGSSGPTRGPQESRDLGMGCQILTDLGIHTLQVMTNSDVTYRGLAGFGLTIEKRVPLQPD

SEQ ID NO: 2068 - protein, 978 aa, Brassica napus
MAMRLLKTHLLFLHLHYVISILLLSFSPCFASTDMDHLLTLKSSMVGPNGHGLHDWVRSPSPSAHCSFSGVSCDGDARVISLNVSFTPLFGTISPEIGMLDRLVNLTLAANNFSGMLPLEMKSLTSLKVLNISNNVNLNGTFPGEILTPMVDLEVLDAYNNNFTGPLPPEIPGLKKLRHLSLGGNFLTGEIPESYGDIQSLEYLGLNGAGLSGESPAFLSRLKNLKEMYVGYFNSYTGGVPPEFGELTNLEVLDMASCTLTGEIPTTLSNLKHLHTLFLHINNLTGNIPPELSGLISLKSLDLSINQLTGEIPQSFISLWNITLVNLFRNNLHGPIPEFIGDMPNLQVLQVWENNFTLELPANLGRNGNLKKLDVSDNHLTGLIPMDLCRGGKLETLVLSDNFFFGSIPEKLGRCKSLNKIRIVKNLLNGTVPAGLFTLPLVTIIELTDNFFSGELPGEMSGDLLDHIYLSNNWFTGLIPPAIGNFKNLQDLFLDRNRFSGNIPREVFELKHLTKINTSANNLTGDIPDSISRCTSLISVDLSRNRIGGDIPKDIHDVINLGTLNLSGNQLTGSIPIGIGKMTSLTTLDLSFNDLSGRVPLGGQFLVFNDTSFAGNPYLCLPRHVSCLTRPGQTSDRIHTALFSPSRIAITIIAAVTALILISVAIRQMNKKKHERSLSWKLTAFQRLDFKAEDVLECLQEENIIGKGGAGIVYRGSMPNNVDVAIKRLVGRGTGRSDHGFTAEIQTLGRIRHRHIVRLLGYVANRDTNLLLYEYMPNGSLGELLHGSKGGHLQWETRHRVAVEAAKGLCYLHHDCSPLILHRDVKSNNILLDSDFEAHVADFGLAKFLLDGAASECMSSIAGSYGYIAPEYAYTLKVDEKSDVYSFGVVLLELIAGKKPVGEFGEGVDIVRWVRNTEGEIPQPSDAATVVAIVDQRLTGYPLTSVIHVFKIAMMCVEDEATTRPTMREVVHMLTNPP

SEQ ID NO: 2069 - protein, 424 aa, Xylella fastidiosa Temecula1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAISVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKSRSAAA

SEQ ID NO: 2070 - protein, 80 aa, Schizosaccharomyces pombe
MVNAQQLELLIQNTLEPTHIEIQDMSGGCGQNFEVIIVSPLFEGKSTLARHRLVNHKLQEVIKDIHAFTQVRTLSFRHIR

SEQ ID NO: 2071 - protein, 471 aa, Ashbya gossypii ATCC 10895
MRFKSSRTVERELKALVSSPENANRCGECGATYPTWCSVNLGAFLCGRCAAVHRKVLTGEQGGPESHVKSLTLDRWTVDELEEITNSGGNRRNHHTWNVRNVAFPYDGDDDRSRVEDFIRNKYIVGKFGQGGGRGSGYRPDSSSRRGHDEFADRRSRSASFSRSSNRSYSSLNSASPPRSGGIPLLTHRTVHDHEIGRYGSQLATMKSLGYSDTDAIVEALVLSRGDINVALDILDKDAKLRKESPAPPPPPPRPTSPAASGTRSSPPKPQPAVFDGFNGIQPQTTQAQTFDGGVQQYLDPVTGQIYVDQSQYLQAMQQQQLQQQQLQQQQLQQQQLQQQQLQQQQLQQQQLQQQLQFQQLQQQPTAVDKNALMALYSRPDLYSSPVEIRPDNPQYAALQQQQQQQQQQLRLQQTMNQQQPMLFAQQMPQQMPQFPQQYPQQFPQQYQQSNQGTQPPTASQGAYPGYNYQM

SEQ ID NO: 2072 - protein, 136 aa, Glycine max
  misc_feature (121)..(121): Xaa can be any naturally occurring amino acid
  unsure (1)..(136): unsure at all Xaa locations
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 2073 - protein, 468 aa, Azorhizobium caulinodans
MKTAKEVLDFIKSNDVKYVDLRFTDPRGKWQHVTFDITMVDEDFFAEGQAFDGSSIAAEAINESDMLLMPDVTTACVDPFFSETTLSVVCDVLEPTTGEPYGRDPRGIAKKAMAYLQSTGIGDTVFFGPEAEFFIFDDVKFKADPYNTGFKLDSIELPTNGDTDYEGGNLGHRIKTKGGYFPVPPLDSAQDMRSEMLASMAKMGAKVEKHHHEVASAQHELGLKFGQLVTMADHLQVYKYCIHQVANIYGKTATFMPKPVYGDNGSGMHVHQSIWKDRKPLFAGDKYADLSQECLWYIGGVIKHAKSLNAFTNPLTNSYKRLVPGYEAPVLLAYSARNRSASCRIPYTNNPKAKRVEVRFPDPGANPYLAFSALFMAGMDGILNKIDPGSAMDKDLYDLPPAELKQIPTVCCSLREALESLAKDHDYLLKGDVFQKDFIESYIDLKMQEVARFEMTPHPVEFEMYYSV

SEQ ID NO: 2074 - protein, 180 aa, Triticum aestivum
  misc_feature (52)..(52): Xaa can be any naturally occurring amino acid
  misc_feature (88)..(88): Xaa can be any naturally occurring amino acid
  misc_feature (93)..(93): Xaa can be any naturally occurring amino acid
  misc_feature (104)..(104): Xaa can be any naturally occurring amino acid
  misc_feature (123)..(123): Xaa can be any naturally occurring amino acid
  misc_feature (133)..(133): Xaa can be any naturally occurring amino acid
  misc_feature (146)..(146): Xaa can be any naturally occurring amino acid
  misc_feature (155)..(155): Xaa can be any naturally occurring amino acid
  misc_feature (158)..(158): Xaa can be any naturally occurring amino acid
  misc_feature (161)..(161): Xaa can be any naturally occurring amino acid
  misc_feature (163)..(163): Xaa can be any naturally occurring amino acid
  misc_feature (168)..(169): Xaa can be any naturally occurring amino acid
  misc_feature (172)..(172): Xaa can be any naturally occurring amino acid
  misc_feature (175)..(175): Xaa can be any naturally occurring amino acid
  misc_feature (177)..(178): Xaa can be any naturally occurring amino acid
  unsure (1)..(180): unsure at all Xaa locations
MAPTVMASSATSVAPFQGLKSTAGLPVSRRSNGASLGSVSNGGRIRCMQVWXPIEGIKKFETLSYLPPLSTEALLKQVDYLIRSKWVXPCLEXFSKVGFIFREXHNASPGYYDGRYWDNVGSXLCSGGTDAQXVINEVEESKKGYXPLVRNNGFXKNXQVXWXKFIAXXQPXWKXPXXAK

SEQ ID NO: 2075 - protein, 397 aa, Leuconostoc mesenteroides subsp. mesenteroides ATCC 8293
MPEVKPSLLNNLNQHLKLVGPSAIRAFDIEVSEIPDIIKLTLGEPDFNVPDHIKQAAIRSIEANDSHYAASNGTIHLREAAAGFLADRYDIDYDPTNEIIVTIGATEAIYDTLTTILNPGDKIILPTPIFPLYIAVGLVDGAEPVFIDTSSNDFVLSPEMLKAAIAKHGDDIKAVVLNFPSNPTGVTYNDEQIKAIADVLRGTDIIVISDEIYSELSYENSHVSMAKYLPEQTILLNGVSKSHAMTGYRIGILAGPAQLVQKIAMIHQFATTTASNPAMAAAAEALGTEAGRQDTLVMKAEYLQRRDYVYDTMTQLGFKVAKPDGAFYIFAKIPAGYIQDDFAFARDLAQNNGLALIPGSSFGPGGEGYVRLSYAASIETLQKAMHRLTAYMEENGK

SEQ ID NO: 2076 - protein, 261 aa, Ashbya gossypii ATCC 10895
MPQNEYIEQHIKKHGRRLDHEERKRKREAREAHKISEKAQKLTGWKGKQFAKKRYAEKVAMRKKIKAHEQSKLKGAAKPLEDSGEALPAYLLDREQANSAKAISSSIKQKRLEKADKFSVPLPKVRGISEEEMFKVVKTGKSKTKSWKRMITKHTFVGEGFTRRPVKMERIIRPSALRQKKANVTHPELGVTVFLPILGVKKNPQSPMYTQLGVLTKGTIIEVNVSELGMVTSGGKVVWGKYAQITNEPDRDGCVNAVLLV

SEQ ID NO: 2077 - protein, 267 aa, uncultured proteobacterium RedeBAC7D11
MNKSITIEDFRNHKKKKTKFACLTAYDASLSELMSKAGVELILVGDSLGMVVQGHDSTIPVSMEDLLYHLRCVKRGNIGSHIMADMPFMSYATENLAYDNAMRLMQAGANSVKVEGGEWILKTTELLSQRGIPVCAHLGLTPQSINRLGGYYVQGRDLEDKNRILSEAKQLENAGAEIILLECVPASLAEEISSSLKIPTIGIGAGSATDGQIMVCYDAIGAYIWDDQPQPKFVKNFMNESNSIFEAFEKYVSEVKSSKFPSADHSF

SEQ ID NO: 2078 - protein, 388 aa, Sinorhizobium meliloti
MTIMTSLSPRATAAPESGIVEVVNYARGREGLIPLWVGEGDLPTPDFVSRAAADALMAGETFYTWQRGIPPLREALVRYYQRRFQKALSPENFYVTGSGMQAIKLAIEAVGSPGDEVVLLTPAWPNFAAAADLSGVRPVAVPLQFEGGKWRLDPERLQAAIGERTRALFINTPSNPTGWTATHDDLKAILALAREHGLWIIADEIYALYYYPDGRAPSFLDVMEEDDRILFVNSFSKNWSMTGWRVGWIVAPPAMGQVLENLIQYSTSGVAQFMQRGAVAALDEGDGFVEENIAKAKRNRDTLCDALIATNRVETLKPDGALYAFLKIDGVTDSRAAALDIVDRTGVGLAPGTAFGEGGALFMRACFLRDPLQIAEAADRLQRYILSR

SEQ ID NO: 2079 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 2080 - protein, 361 aa, Glycine max
MPPKQQSKADLAKKQKIVEDKTFGLKNKNKSKNVQKYVQNFKQSVQPRPDTAKVDAKKKKEEEKAKEKELNDLFKIAVTQPKVPVGVDPKSILCEFYKVGQCAKGFKCKFSHDLNVQRKGEKIDIYSDKRDQETMEDWDQETLEKVVESKKTEYNQNKPTDIVCKYFLDAVEKKQYGWFWVCPNGGKNCHYRHALPPGYVLKSQMKALLEEESEKISIEEEIENQRAKVATTTPMTPELFFEWKKKKIEERDANIAAQQAERAKNDRMSGRELFLSNASLFVDDAEAYDVYQREPESYETEENGSRNAAEDGPSSSATAAADGDYLDDIDDDDELDMDELEELEASLSQTSILIKETGAEA

SEQ ID NO: 2081 - protein, 251 aa, Pseudomonas putida KT2440
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 2082 - protein, 271 aa, Haemophilus influenzae 86-028NP
MQHKLIAFIGGGNMAQAIILGLLKQGYPAEQIIVNDPNEEKRAFFANLGVATSENNVESAIKAEVVLLAVKPQMMADVCLPLSAVDFSDKLLISIAAGISTERLNALIPSVKSIVRVMPNTPALVGEGMAGLFAPKNTSENYRTFAQDLLGAVGRTVWVDDETQMHAVTAASGSSPAYFFLMLEAMQQALIKMNIDEKTARELVQQSMLGAAKMVTENPQIALSTLRENVTSKGGTTAAALAVFDAQHFNQTIEQAMQACLSRSQEMETLF

SEQ ID NO: 2083 - protein, 237 aa, Oryza sativa (japonica cultivar-group)
MSMAKLLLVLSVFITVAYMMTWSFVPRFLKLMIQLSSQTNELYQLASVAFCLLLAWCSDYLGLSLELGSFLAGVMISTTDFAHHTLEQVEPIRNLFAALFLASIGMLIHVKFLWNHVDILLAAVILVIIVKSVVVTVVVKAFGYSIRTAFVVGLSLAQIGEFAFVLLSRASHLHLVGGKMYLLLLGTTALSLVTTPLIFKLIPVVMHLGILMRWFPSESSMQNEDKATMLEAYNRSL

SEQ ID NO: 2084 - protein, 241 aa, Oryza sativa (japonica cultivar-group)
MSMAKLLLVLSVFITVAYMMTWSFVPRFLKLMIQLSSQTNELYQLASVAFCLLLAWCSDYLGLSLELGSFLAGVMISTTDFAHHTLEQVEPIRNLFAALFLASIGMLIHVKFLWNHVDILLAAVILVIIVKSVVVTVVVKAFGYSIRTAFVVGLSLAQIGEFAFVLLSRASHLHLVGGKMYLLLLGTTALSLVTTPLIFKLIPVVMHLGILMRWFPSESSMQNELPLQDKATMLEAYNRSL

SEQ ID NO: 2085 - protein, 318 aa, Pachysolen tannophilus
MTLQYYTLNNGRKIPAIGMGCWKLENAADMVYAAIKEGYRLFDCACDYGNEKEVGEGINRAIKDGLVKRKDLFITSKLWNNFHAKENVKKALMKSLSDFNLDYFDLYLMHFPISFKFVPFEEKYPPGFYCGDGDKFIYEDVPIIETWRAMENLVDEGLVKSIGVSNVSGGLLEDLIKAARIKPASLQIEHHPYLQQNKLVEYAQLKGIVVTGYSNFGPLSFLELGNETAKKTQPLYENKTITTIAAKHGKTPFQVLLRWVNQRGIAIIPKSTFPNTLAVNLHVDEFDLTKEDFEEIAKLDRHLRFNDPWTWDKIPTFV

SEQ ID NO: 2086 - protein, 598 aa, Raoultella planticola
MSFITLRTGVAVALSSLMISQACPAVSAAPSVNQNIHVHKESEYPAWWKEAVFYQIYPRSFKDTNDDGIGDIRGIIEKLDYLKSLGIDAIWINPHYDSPNTDNGYDISNYRQIMKEYGTMEDFDNLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSSMRFDTVATYSKIPGFPNLTPEQQKNFAEQYTMGPNIHRYIQEMNRKVLSRYDVATAGEIFGVPLDRSSQFFDPRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQATAPHSTSLSLSPWQAGVYKLR

SEQ ID NO: 2087 - protein, 268 aa, Lycopersicon esculentum
WKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYS

SEQ ID NO: 2088 - protein, 472 aa, Thermoplasma acidophilum
MEFRQAYYDEPLIKDIKSDTSFKLSEDVDENLLPQDMRRTDLKLPQVSEVDVVRHYTRLSQMNYTVDVGIYPLGSCTMKYNPKYADRIASFAEFRNIHPFQPESTVQGTLQIMYELQEFLKKISDMDAVTLQPMAGADGEFTGILIIKKYFEDLHEDRTEIIVPDSAHGTNPASATMGGFDVVEIPSNSEGMVDLNALKAAISKKTAALMITNPNTLGIFEQNITEIAKILHDAGALLYYDGANLNAIFGITSPGLMGFDIVHFNLHKSFATPHGGGGPGAGPVAVKSFLSDFLPVPVVGYDGKRYFLDYGKKKSIGRVSSFYGSFSILLRAWSYVIRNGDDGLKNATIRAVLNSNYLKKKVEGYYEVPYYPLKKHEFVLSTEKTGRRALDIGKYLLDFGIHSPTVYFPLIVKEAMMIEPTETVSKDDLDRYADVLISALKVPEDDLKSRPRNTAVSRIDEVKAARDLKVRW

SEQ ID NO: 2089 - protein, 523 aa, Candida albicans SC5314
MYQHQDQTQHQYYQQYNSYNPSIEDLIASSDDKRYQNGGIGNSLQRPPVAGLPYISSQVNPNTSSANLSKLTSNINNYGYNNNNNSHIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 2090 - protein, 79 aa, Saccharomyces cerevisiae
GSSALLDTDEVGSELDDSDDDYLISEGEEDGPDENLMLCLYDKVTRTKARWKCSLKDGVVTINRNDYTFQKAQVEAEWV

SEQ ID NO: 2091 - protein, 433 aa, Thermoplasma acidophilum
MDELLSMLNFLGMKDPEELFSDIPKSVRKKSIGIGGGLDEYRVIDRAMEIGRKNKTDMINFLGNGIYDRVIPEAVNYILSKPEFLDSYTPYQPEISQGMLQSMFEYQSLISDLMGMDVTNASMYDGYSALGEAARMAYRINGHSKILVPESSYDSKISVLRNYIWGLNMKIMKYRIGEDGMIDLDDLSSKIDSDTSAIVVENPNGYGILDKNIFGVKDIKKDAVLISYVDPISLGVVKPPGEYGSDIAVAEGQQLGIPMNFGGPLLGLMSFKMEHIRRSPGRIIGESIDSNGKRAYVMTLQTREQHIRRAKATSNICSNQALLTLAASAYLSIMGSTGLRKVALLTIKHSRMIKEKLSSIGVKPYFSTESFSDVMFRLERDVMEALASKNILGGLKLRQLISDTPMKDATFFTVTEKTDAAAIEKLAAALEVI

SEQ ID NO: 2092 - protein, 318 aa, Methanococcus maripaludis S2
MKIVVLDGYAMNSGDLSWEDLKKLGELSIYDRTLESEVVERISDSEIVITNKVIIGKEVLEKCKNIKYVGVTATGYNVVDTTLAKDHGVIVTNVPAYSTDSVAQLVFSFILEHCQNVSKYTESVKSGDWVNSKDFSYQKFPIIELAGKSLGIIGFGAIGKKVAEIGNAFGMNVLVNTRTVSKTDEINVNFVSKEEIFKNSDFLTLHCPLNNETDKIVNEKTLNLMKKSAILINTGRGGLVNEKDLANALNLEKIAGAGLDVLSTEPPKEDNPLLNAKNTYITPHVAWASYEARKRLMDVTINNVKSFIDGNPINVVNK

SEQ ID NO: 2093 - protein, 166 aa, Oryza sativa
AAGEGWRRCGRRRAVKETTGIVGLEVVPNAREVLVGLYTRTLKEIEAVPKDEGYRKAVESFTRHRLQICQEEDDWKRIEDRIGCGQVEELIEEAQDELKLIAKMIEWDPWGVPDDYECEVIEDDTLIPKHVPQHRPVALPEEFFKTLDAVKSDPALQGESPPQVKP

SEQ ID NO: 2094 - protein, 473 aa, Leuconostoc mesenteroides subsp. mesenteroides ATCC 8293
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALMVPRGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 2095 - protein, 229 aa, Listeria innocua
MKLVLIRHGQSEWNKLNLFTGWHDVDLSEEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKAGRRVVIAAHGNSLRALVKFLEGISDDEIMELEIPTGVPLVYELNDDLKPVNKYYLDK

SEQ ID NO: 2096 - protein, 179 aa, Oryza sativa
  misc_feature (110)..(110): Xaa can be any naturally occurring amino acid
  misc_feature (117)..(117): Xaa can be any naturally occurring amino acid
  misc_feature (155)..(155): Xaa can be any naturally occurring amino acid
  misc_feature (169)..(169): Xaa can be any naturally occurring amino acid
  unsure (1)..(179): unsure at all Xaa locations
MAPTVMASSGTSVAPFQGLKSTAGLPVSRRSTNSGFGNVSNGGRIKCMQVWPIEGIKKFETLSYLPPLTVEDLLKQIEYLLRSKWVPCLEFSKLGFVYRENHRSPGYYDXRYWTMWXLPMFGCTDATQVLKELEEAKKAYPDAFVRIIGFDKRQXQCQLISFIAYKPPXGCEESGGKLS

SEQ ID NO: 2097 - protein, 470 aa, Photobacterium profundum SS9
MKKTKIVCTIGPKTESVEMLTKLANAGMNVMRLNFSHGNFEEHGQRIVNLREVMATSAQPLAILLDTKGPEIRTIKLENGEDFALVAGQEFTFTTDITVVGNQDRVAVTYPGFAKDLTKGNIILVDDGLIEMEVLETTETEVKCKVLNNGDLGENKGVNLPGVSVKLPALSEKDKADLVFGCEQGVDFVAASFIRKEDDVKEIRALLAANGGEKIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPIEAVTIMAQICNRTDSALKAELGSRLDSSRLRITEAVCKGAVDTSEKLNAPLIVVATEAGKSARSIRKYFPTAKIIAVTTNQKTAAQLCLTKGVTPIVVDAIDNTDAFYSRGKEIALETGLGAKGDIVVMVSGALVPSGTTNTASVHVL

SEQ ID NO: 2098 - protein, 396 aa, Sinorhizobium meliloti
MRYASITSRLAELGSGKWTLHTRARQLKASGAELIELTIGEPDLPPDRALLEECQRAMNAGRYRYSNGRGEPAVVAALTEKYRRRRAAVTAENILCFPGTQTALFAVMFALAEAGDGVLVGDPLYATYEGVIRSTGAHPVFVPLNPENGFHMRAEDLEKAVTPECRVLLLNTPHNPTGAVLTAEEIAAIGEVARRHDLWIVCDEVYEELVFDALFASPFDNPDLAERTVVVSSISKSHAAPGFRSGWAVGPAEFTERLLPISETMLFGQQPFIADMTAYALTHDIDTARQMRESYSRRARRIIDGLAGASGVSVLPPEAGMFALIDVSGTGLSGEAFAWALLEEEGVAVMPGSSFGDKARNFLRVSLTVPDAAIEEACRRIAALAERCTIRKERRA

SEQ ID NO: 2099 - protein, 322 aa, Colwellia psychrerythraea 34H
MQRLAPALRQDNVPLDLISLIKTILAATKEISFRVSQGHLGDVMGSTLDENIQGEVQKQLDVVANELFKDILLESGFVKAISSEEEDHSVAGDENGKYIVSFDPLDGSSNIDINSLIGTIFSIHEAPKDIAAGDDDMFKQAGDKQVCAGYVLYGPSTMLVMTTGSGTHFYVLDRTHGGFLLVERNVQVPADTQEFAVNMSNQRFWQAPMQNYISDLLAGDTGPREKNFNMRWIAAMVGDIHRVLCRGGIFTYPADSRKPEQPYKLRLMYEANPMAFLLEQAGGLAMTSEGRIMDIEPNSIHQRVEVIMGSKNEVEKCLSYYN

SEQ ID NO: 2100 - protein, 109 aa, Triticum aestivum
MGKEKMSAAAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 2101 - protein, 185 aa, Magnaporthe grisea 70-15
MRPLTDTETQTLLAKLANYTGNSLKSLIAPLEDGDRYVFRLHKDRVYYVKLSIANLATTIARDKLMSLGTCLGKFTKSGKFRLHITALPILSEHARYKMWVRSNGEMPFLYGGNVVKAHVGRQTDDCPEHQGIVVYNMQDVPLGFGLTAKSTADARRLDPTGITCFRQSDCGEYLRDEDALFATG

SEQ ID NO: 2102 - protein, 509 aa, Arabidopsis thaliana
MLLHLLLLLCLSSSLKVQASVHEYRSERFVSKGNAFVFHGGSEGIYSSSPSDNFTSDSDSVSFIRFEKIKFQRPEEVSNRSSLSIHAVVFEVEDRENIGGSAYGGQRAVCCTSDLAKLGVCSHGDVIYRPSAKDSGWPQVFGVSLAENEFSVILPTRSIQVTRTGMYNLYFIHCDSDLKDLVVEGKTIWKNPTGYLPGRMAPLMYFYGFMSLAFVLLGIFWFSQCARFWREVLPLQNCLTLVITLGMCEMALWYFDYAEFNETGIRPTVITIWAVTFGSIKRTSARIIILMVSMGYGVVRPTLGGFTSKVIMLGVTFFIASEILELMENVGAVSDLSGKARLFFVLPVAILDAFFIIWIFKSLSATFKKLQTRRLLVKLDIYRKFTNALAVDILVSLGWICYELYFKSKDVYNEHWQNAWIIPAFWQLLSFSLLIVICSLWAPSQNSTRYAFSGSSGDTSAEFEKDDYTLTLIKPSPIPSHEVKNLSETRLLPADEGEPEKDLEEDKRE

SEQ ID NO: 2103 - protein, 295 aa, Panax ginseng
MTYMFKYDTVHGQWKHHELKVKDNNTLLFGEKPVKVFGIGNPEEIPWGEAGADFVVESTGVFTDKDKAAAHLKGGAKKVVISAPSKDAPMFVVGVNEKEYTPDLHIVSSASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLAKKASYDEIKAAIKEESEGKLKGILGYTEDDVVSTDFLGDSRSSIFDAKAGIALNENFVKLVTWYDNEWGYSSRVVDLVVHMASVQ

SEQ ID NO: 2104 - protein, 282 aa, Aspergillus nidulans FGSC A4
MPQNEYIERWTKQHGKRLDHDERVRKREARQSHQQSKDAQNLRGLRAKLYQQKRHAEKIQMRKRIKAQEEKNVKSSAPSEPSKTPLPQYLLDRSEATNAKALSSAIKDKRAEKAAKFAVPLPKVKGISEEEMFKVVNTGKKTHKKSWKRMITKPTFVGNDFTRRPVKYERFIRPMGLRYKKANVTQYVLSLATIGVYLGFTDKFSCSPEMAVTVQLPILSVKKNPQNPLYTQLGVLTKGTVIEVNVSELGIVTAGGKVAWGKYAQITNTPENDGCVNAVLLV

SEQ ID NO: 2105 - protein, 146 aa, Brassica napus
  misc_feature (66)..(66): Xaa can be any naturally occurring amino acid
  misc_feature (130)..(130): Xaa can be any naturally occurring amino acid
  misc_feature (137)..(137): Xaa can be any naturally occurring amino acid
  unsure (1)..(146): unsure at all Xaa locations
MFRVTGSLSPAPSPAAASVSAALRLSAAPTLAFASPPPHPRCLSTFSRSLLGGRFSSLRPRVPFPXPIRLSGFSALKARASASFSSSGSSSPTREILVQHVLGQEGDSALFAELQKRILDGEDMSDLAAXEYSICPXKKEGGLLGW

SEQ ID NO: 2106 - protein, 273 aa, Triticum aestivum
NKFVQKSRLVPVRNSRDIVDPRVRNQDGVGFVDRHGVPLADWSKAADPASCGGGSDDRAAAEGSGVHKNGDAVEGDGDVDDILKSIRVVTDVMESLVKRVIVAESETANEKEKVRIGLEEIRRKTIQVESMSVKVEEMEKFAVGTNGMLNEMRQRVEDMVLETTRQRQRAAENEQELSRVKNDFESLRTYVSTLVSVRETLLSSEKQFETMEKLFDRLVARTNQLETEKAQKEAEVQKVMEENVRLRAMVDKKDAQLQAMSEQCKFMALNRPN

SEQ ID NO: 2107 - protein, 172 aa, Zea mays
  misc_feature (16)..(16): Xaa can be any naturally occurring amino acid
  misc_feature (48)..(56): Xaa can be any naturally occurring amino acid
  misc_feature (144)..(151): Xaa can be any naturally occurring amino acid
  unsure (1)..(172): unsure at all Xaa locations
MTCDENVVYDSFSVRXHIIGENDEFIGKKAAYALSQNVKVIACIGELXXXXXXXXXFDVCFRQMKAFADSISNWADVGIAYEPVWAIGTGKVATPEQAQEVHAAVRNWLTTNISPDVASSTRIIYGGSVNAANCAELAKKEDIXXXXXXXXSLKAPDFATIINSVTAKKVAA

SEQ ID NO: 2108 - protein, 468 aa, Chromobacterium violaceum ATCC 12472
MLRNTKILATLGPSSSAPEKILELARSGVNIFRLNMSHGSHDDHRARLAAIRAAEKTLDRPIGVLVDLQGPKLRIGKFPQPTTVKTGDRYEFVLDETEGNAERATLPHPEAFEALEPGHLILVNDGKLAFEVAEMHPRRIVTRVTVGGELSSNKGFNLPHTVLPLSAITGKDRKDAEFALEEGADWVAMSFVQTAADVKALRDIVGKRVGIVAKIEKPSAVDDLEAIAELADGVMVARGDLGVELPPEDVPVVQRRIVHHCRHLGRPVIVATQMLESMITAPTPTRAEANDVATAVYEGADAVMLSAETAAGQYPLEAVQIMDRIIRRVENAPDYRKVMALDYSAADEPDRTDAIAACVRKVSTLLPVTVAVAFTTSGASCLSLARERPSTPILGISPRLETARRLTLVWGVVAYHGPDAENLEDMVVKTTFCATKLSLAEQGKPMVIIAGVPFGTPGSTNLLRIVYP

SEQ ID NO: 2109 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 2110 - protein, 409 aa, Thermus thermophilus HB27
MREEFLEEIPLDAPPEEAKELRTEVMTLNVGPQHPSTHGVLRLMVTLSGEEVLEVVPHIGYLHTGFEKTMEHRTYLQNITYTPRMDYLHSFAHDLAYALAVEKLLGAVVPPRAETIRVILNELSRLASHLVFLGTGLLDLGALTPFFYAFRERETILDLFEWVTGQRFHHNYIRIGGVKEDLPEEFVPELKKFLEVMPHRIDEYEALFAESPIFYERARGVGVIPPEVAIDLGLTGGSLRASGVNYDVRKAYPYSGYETYTFDVPLGERGDVFDRMLVRIREMRESVKIIKQALERLEPGPVRDPNPQITPPPRHLLETSMEAVIYHFKHYTEGFHPPKGEVYVPTESARGELGYYIVSDGGSMPYRVKVRAPSFVNLQSLPYACKGEQVPDMVAIIASLDPVMGDVDR

SEQ ID NO: 2111 - protein, 394 aa, Crocosphaera watsonii WH 8501
MSKIETRTEPMVLNMGPHHPSMHGVLRLIVTLDGEDVVDCEPVIGYLHRGMEKIAENRTNVMYVPYVSRWDYAAGMFNEAITVNAPEQLADVKVPKRAQYIRVIMLELNRIANHLLWLGPFLADVGAQTPFFYIFREREMIYDLWEAASGMRLINNNYFRIGGVAVDLPYGWIDKCEDFCDHFDPKVDEYEKLITNNPIFRRRVEGIGTITREEAINWGLSGPMLRGSGVQWDLRKVDHYECYDDFDWEVQWETAGDCFARYLIRIREMRESVKIVRQALKAIPGGPYENLEAKRMMEGKKSEWNSFDYQHIAKKVAPTFKIPEGEHYVRMESGKGELGIFIVGSNDPFPWRWKIRAPDFNNLQILPHLLKGVKVADIMAILGSIDVIMGSVDR

SEQ ID NO: 2112 - protein, 88 aa, Brassica napus
MSSTSKAWTVAVSIGVVETLKDQLGLCRWNYMFRSVNQHLRNNVRTVSQGKRFSSSVAAANSSGESEKAKKCEESLRTVMYLSCWGPN

SEQ ID NO: 2113 - protein, 404 aa, Yersinia pseudotuberculosis IP 32953
MSPIEKSSKLDNVCYDIRGPVLKEAKRLEEEGNKVLKLNIGNPAPFGFDAPDEILVDVIRNLPTAQGYCDSKGLFSARKAIMQHYQARDIRDLTVEDIYIGNGVSELIVQSMQALLNLGDEMLVPAPDYPLWTAAVSLSSGKAVHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 2114 - protein, 714 aa, Oryza sativa (japonica cultivar-group)
MGYAAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQASNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHIAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFTMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 2115 - protein, 224 aa, Triticum aestivum
NAHQELIKTAKYIATPGKGILAADESTGTIGKRLASINVENVEANRQALREMLFTAPGALEYLSGVILFEETLYQTAADGTPFVDILKAGNVVPGIKVDKGTVDIAGTVGETTTQGLDSLGARCAKYYEAGARFPKGRAVVKIRARRRTRPKLRREATTPQGAGPGRGSSARKNGLGPHPGSPEIPPRTGPQRPTRAGPARHGTAELARAPNGCPNRTIQVVPP

SEQ ID NO: 2116 - protein, 441 aa, Cryptococcus neoformans var. neoformans JEC21
MQAAVSLVQDYMGTEPTSTKSPYKHRQDGSTMRALAWFGKEDVRMVDAPIPDITQDTDVIVKVTGTTICGSDLHLYHSEMLGMQKGDILGHEFMGIIDRVGPSVNHLKIGDRVVVSFQIACGTCRYCQQKLSSFCDKTNDSSVVVNLWGQRDSAFFGYSHLTGGWPGGQSEYVRVPFGEVNCLKVPAEVPDEQALYLSDVLPTSYHAVVDTGVQKGDIVGIWGLGPIGICCVKWALLKGASKVYAIDTNPTRLALARSLGPEVITVDFKADDVKKRIHDEVPQGLDVCIDATTFHEPKTFLHKVEKALMLETDVSETPNEMIWLVKKMGRVGLIGVYTAYTNHFNIGALMEKGVRFIGNGQAPVHLYWEEILHDYIMTGKFDVGFMISHRVDLEDFPQLYDKFDRRVAGVEKVFVQTKASAPPAKGFPALSKVDDWADKII

SEQ ID NO: 2117 - protein, 456 aa, Salmonella enterica subsp. enterica serovar Paratyphi A str.
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKIFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 2118 - protein, 410 aa, Haemophilus influenzae R2866
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKVRGIPVFNAPFSNTRSVAELVLGEILLLMRNVPQANAEVHRGIWNKSATGSYEVRGKKLGIIGYGHIGSQLSIIAESLGMDVYFYDIENKLPLGNAKQLRSLEELLSSCDVVSLHVPELPSTKNLMNAARIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 2119 - protein, 390 aa, Pyrococcus furiosus DSM 3638
MKEKRKYFMAHRIGVIQRSKIRELFERASKMENVISLGIGEPDFDTPNNIKEAAKRALDEGWTHYTPNAGIPELREAIAEYYKKFYGIDVEVDNVLVTAGAYEATYLAFETMLEQGDEVIIPDPAFVCYVEDAKLAEAKPIRLPLREENDFKPDIDELLERITKRTRMIVINYPNNPTGAVLDKETAKAIADVAEDYNIYILSDEPYEHFLYDDAKHYPMIKFAPDNTILANSFSKTFAMTGWRLGFVIAPTQIIREMIKLHAYIIGNVASFVQVAGIEALRSKESWKAVEEMRKEYNERRKLVLQRLRKMPYIKVREPKGAFYVFPNISETEMSSEEFSEWLLEKAKVVVIPGTAFGENGEGYVRISYATSREKLIEAMDRIEKALEEI

SEQ ID NO: 2120 - protein, 159 aa, Arabidopsis thaliana
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTSGPGGFWGPVAKNITEGGVRFPKGGGRVLKIGGKGAPPS

SEQ ID NO: 2121 - protein, 524 aa, Arabidopsis thaliana
MELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSYGVSIFIKTILVLSTLVVALTFPFFAIMGALMGSFLAMLVDFIFPCLCYLSILKGRLSKTQIGICVFIIISGIVSGCCGTYSAIGRLVGKLD

SEQ ID NO: 2122 - protein, 958 aa, Photorhabdus luminescens subsp. laumondii TTO1
MTQTLSQLENQGEFIRRHIGSSAEQQKEMLATVGASSLNDLTQKIVPRDIALPEPPDVGGGATEQQALAELKAIASQNKRYQSYIGMGYAPAVLPPVILRNLLENPGWYTAYTPYQPEVSQGRLESLLNFQQVTIDLTGLDIASASLLDEATAAAEAMAMAKRISKLKNADRFFVADDIHPQTLDVVRTRAETFGFDVIVDKAEKVLELDGVFGVLLQQVGTTGEVHDYADLIAQLKQRKIIVSVAADLMALLLLTAPGKQGADMVFGSAQRFGVPMGYGGPHAAFFASRDEFKRSMPGRIIGVSRDAAGNTALRMAMQTREQHIRREKANSNICTAQVLLANIAAMYAVYHGSKGLKRIAGRIHRLTDILAVGLQKAGFTLRYKTWFDTLTVEVADKAAVLARAEKAEINLRTDTYGAVGITLSEATRRDDVIKLFSVLTGTDDKLDVEALDKELMTESHSIPASMLRSDEILLHPNFNRYHSETDMMRYMHRLERRDLALNQAMIPLGSCTMKLNAAAEMLPISWPEFNELHPFCPPEQAQGYQQMISQLSHWLVQLTGYDVVCMQPNSGAQGEYAGLLAIRRYHESRGEGHRHICLIPSSAHGTNPASAHMAGMTVVVVSCDKEGNIDLVDLREKAEESGNELSCIMVTYPSTHGVYEETIRQVCEIIHQYGGQVYLDGANMNAQVGITAPGFIGADVSHLNLHKTFCIPHGGGGPGMGPIGVKAHLAPFLPGHSVVQMDGLTEQRAVSAAPFGSASILPISWMYIRMMGSQGLKQASQTAILNANYIAARLKNDYDVLYTGHNGYVAHECILDIRPLKEEFGISEMDIAKRLIDYGFHAPTMSFPVAGTLMVEPTESESKVEIDRFVDAMLAIRAEIGKVAKGEWSLEDNPLVNAPHVQAELVSDWSHSYSRETAVFPTLETKANKYWPAVKRLDDVYGDRNLHCSCAPVSDYQ

SEQ ID NO: 2123 - protein, 326 aa, uncultured proteobacterium RedeBAC7D11
MKVIGFGAALVDKQFLIKDDALNALGIEKGLMTLNSEEEQNELLTFLQNQNYDQISSCGGSATNSIYAAAALGTSSGFIGKVAEDEDGEIYNADLKDNNIEISNCITSSNGKTGNCIVLITPDAERTMNTYLGVSSETKFSEINFEQVSATNLLFMEAYVVTSPDTKDTAKKLIKSCHESNIKIALSLSDPGIVAGFKDELKSWMNVKIDYVFCNHEEAKTFCDANEFDDLRNYAKTIFITNGVNPTIVLEEDQTYEVSAYKAKAVDTNGAGDMFAGGVIHGLSEGWENAESVRFGNFLASKGVAEIGPRLKKNRYIEYLEEFSKK

SEQ ID NO: 2124 - protein, 313 aa, Medicago sativa
MGANSMIADVTHDLNEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 2125 - protein, 528 aa, Arabidopsis thaliana
MDLEEQERDILIQTDDDDCHVDVSYVNDDDDSNASFSLSQNDSAFWPQSYRHSVDLLTGVTPPMVSFIQGRSTETSFSSSIASLYKRRPTSIANSFVSSTSKQPLLSEKDDVSFLSSQVGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKALDLANLPVAIGIFGFGFSGHAVLPSIYSSMKEPSKFPLVLLISFGFCVFFYIAVAICGYSMFGEAIQSQFTLNMPQQYTASKIAVWTAVVVPMTKYALALTPIVLGLEELMPPSEKMRSYGVSIFIKTILVLSTLVVALTFPFFAIMGALMGSFLATLVDFIFPCLCYLSILKGRLSKTQIGICVFIIISGIVSGCCGTYSAIGRLVGELNWMVQ

SEQ ID NO: 2126 - protein, 271 aa, Thermus thermophilus HB27
MSKLASPQSVRALLERHGLFADKRFGQNFLVSEVHLRRIVEAARPFTGPVFEVGPGLGALTRALLEAGAEVTAIEKDLRLRPVLEETLSGLPVRLVFQDALLYPWEEVPQGSLLVANLPYHIATPLVTRLLKTGRFARLVFLVQKEVAERMTARPKTPAYGVLTLRVAHHAVAERLFDLPPGAFFPPPKVWSSLVRLTPTGAPDDPGLFRLVEAAFGKRRKTLLNALAAAGYPKARVEEALRALGLPPRVRAEELDLEAFRRLREGLEGAV

SEQ ID NO: 2127 - protein, 182 aa, Glycine max
  misc_feature (37)..(37): Xaa can be any naturally occurring amino acid
  misc_feature (88)..(88): Xaa can be any naturally occurring amino acid
  unsure (1)..(182): unsure at all Xaa locations
MENQMAPSMIDCPAVTTVNRAGAVMAASFTGLKSMAXGFRTRETNSDITYIASNGGRVQCMQVWPPVGTKKSETLSYLPDLDDAQLAXEVEYLLRKGWIPCLEFELEHGFVYREHNTSPGYYDGRYWTMWKLPMLGCTDASQVLKERAEAKTVYPNGFIRIIGFFFVGRVHCISWLAYKPPG

SEQ ID NO: 2128 - protein, 251 aa, Frankia sp. CcI3
MVRLAGVGPDDTVLEIGPGLGSMTLGLVEAAKAVVAVEVDRPLAAALPVTVAARLPADVAERLRVVAADGLRVTLADLPADVAAPGVLAANLPYNIAVPLLLGLLERLPSLRRGLVMVQAEVADRLTAPPGSRVYGAPSVKLAWYAHARPAGAVPRPVFWPQPNVDSGLVAFARRPLPGPARLRADVFAAIDAAFAQRRKTLRTALAPWAGSPAAAGDLARAAEVDPGARGETLDIAAFCRLAAARAARSD

SEQ ID NO: 2129 - protein, 390 aa, Magnaporthe grisea 70-15
MSKQQHPSSKTQITRRRDTADMTFEQVLHKGSSANMGGLSSMLGKDREASKTAVDQYFRHWDGKTAKTETTKVREERKADYATLTRQYYNLVTDFYEYGWGQSFHFCTFAPGETFASAITRYEHTLAHRIGIKKGMKVLDIGCGVGGPARQIAKFTGANITGITINEYQVERARRYAEMEGYGAGEQLKFVQGDFMALPFEKETFDAVYSIEATVHAPKLEDVYKQIFNVLKPGGIFGLYEWVMTDAYDENDPHHKEIRFGIEHGGGIANLQTAQTAIAAIKAAGFELLESEDLADNSDRAPWYWPLGGNAWQYASTFGDILSTFTMTPAGRAIAHTVLGVVESIGLVPPGTKKTADSLSTTAAALVAGGKEGLFTPMFLMVARKPVAKE

SEQ ID NO: 2130 - protein, 426 aa, Rhizobium leguminosarum
MNATSLTDRKNAAISRGVGMTTQIYADRAENAEIWDKEGRRYIDFAAGIAVLNTGHRHPRVIAAVKDQLDRFTHTCHQVVPYESYVHLAERLNALLPGDFEKKTIFVTTGAEAVENAVKIARAATGRSAVIAFGGGFHGRTFMGMALTGKVVPYKVGFGAMPGDVFHIPFPVELHGVTADQSLAALKKLFAADVDPQRVAAIIIEPVQGEGGFYSAPAAFMKALRELCDQHGILLIADEVQTGFARTGRMFAMDHHEVAPDLTTMAKSLAGGFPLAAVTGRAAIMDAPGPGGLGGTYGGNPLGIAAAHAVLDVIVDEDLCNRANLLGGRLKQRLESMRETVPEIVDIRGPGFMNAVEFNDRTTGLPSAEFANRVRLIALDKGLILLTCGVHGNVIRFLAPITIQDEIFGEALDILEASMLQASAAK

SEQ ID NO: 2131 - protein, 272 aa, Magnaporthe grisea 70-15
MGHEDAVYLAKLAEQAERYEEMVENMKIVASEDRDLTVEERNLLSVAYKNVIGARRASWRIVTSIEQKEESKGNSSQVGLIKEYRTKIEAELAKICEDILSVLDKHLIPSAKSGESKVFYHKMKGDYHRYLAEFAIGDKRKDSADKSLEAYKAATEVAQTELPPTHPIRLGLALNFSVFYYEILNAPDQACHLAKQAFDDAIAELDTLSEESYKDSTLIMQLLRDNLTLWTSSEAEPTASTGHAEAPAAAAATEEKPAEAAAAAEEAPKPAE

SEQ ID NO: 2132 - protein, 222 aa, Glycine max
LFNQHPNFSSVQCFTFTFQFPLPFSLPNPKMASKLTLIALVVAALCAVDLTQRASSSSSSPHAPAPSVDCSNLVLTMADCLSFVTNGSTVTKPEGTCCSGLKSVLKTAPACLCEAFKSSAQFGVVLNVTKATTLPAACKVSAPSATNCGLSETPAAAPAGGLSPQASPSPQQAADASTNGPVNEVSPAPAPAPAQGNTASALFPISAISLFVAILVATFSGF

SEQ ID NO: 2133 - protein, 429 aa, Alkalilimnicola ehrlichei MLHE-1
MQRSHELFERARQHIVGGVNSPVRAFTGVGGEPPFIARAEGPYLYDEDGNRYVDYVCSWGPMVAGHAHPKVVRAVQAAAADGLSFGAPTEVEIRMAEKLKAMLPSLERVRMVNSGTEATMSALRLARGHTGREKIIKFRGCYHGHVDALLVQAGSGALTLGIPGSPGVPAAVVEQTITLPYNDAEAVRECFQRMGDEIAAVIVEPVAGNMNCVPPVPGFLEALRECCDDHGSVLIFDEVMTGFRVGVQCAQGRYGITPDLTCLGKVIGGGMPVGAFGGKAQIMADLAPEGPVYQAGTLSGNPVAMAAGLATLALVDDPATHRALEEATATLVDGLRERAEAAGVSVSLNQAGSMFGLFFTDQNPVTTFEQVQACDLEAFKVFFHAMLEEGVYMAPSAFEAGFLSTAHDTPAIEYTLAAAERAFARVARR

SEQ ID NO: 2134 - protein, 1106 aa, Pseudomonas putida KT2440
MAKRSRPAAFIDDPLWYKDAVIYQLHIKSFFDSNNDGIGDFAGLISKLDYIAELGVNTLWLLPFYPSPRRDDGYDIAEYKAVHPDYGSMADARRFIAEAHKRGLRVITELVINHTSDQHPWFQRARHAKRGSKAREFYVWSDDDQKYDGTRIIFLDTEKSNWTWDPVAGQYFWHRFYSHQPDLNFDNPQVLKAVIGVMRFWLDLGVDGLRLDAIPYLIERDGTNNENLAETHDVLKAIRAEIDANYPDRMLLAEANQWPEDTRPYFGEGDGDECHMAFHFPLMPRMYMALAMEDRFPITDILRQTPEIPANCQWAIFLRNHDELTLEMVTDRERDYLWNYYAEDRRARINLGIRRRLAPLLQRDRRRIELLTSLLLSMPGTPTLYYGDELGMGDNIYLGDRDGVRTPMQWSPDRNGGFSRADPQRLVLPPIMDPLYGYQTVNVEAQSHDPHSLLNWTRRMLAVRKQQKAFGRGSLRTLTPSNRRILAYIREYTDADGNTEVILCVANVSRAAQAAELELSQYADKVPVEMLGGSAFPPIGQLPFLLTLPPYAFYWFLLASRDRMPSWHIQPTEGLPELTTLVLRKRMEELLQAPASDTLQSTILPQYLPKRRWFAGKEGPIDAVRLCYGVRFGTATTPVLLSEIEVLSDGTATRYQLPFGLLREEQIHTALPQQLALSRVRRAHQVGLITDAFVLEPFIHAVMQACQDGLRLPCGDAEGELRFECTEQLAGLALDEESEVRYLSAEQSNSSVVIGDRVVLKLIRRVNPGIHPELEMSAYLTAAGFANISPLLAWVSRVDEQHAPHLLMIAQGYLSNQGDAWGWTQNTLERAIRDQMEPTRNDAEAHTDALAELSGFAALLGQRLGEMHLLLAAPTEDPAFQPRPSDAQDSERWCAQISTELTHALDLLAQHRDTLDSDSQSLVDDLQQQRDGLAQHIDTLSKQAQGGLLMRVHGDLHLGQVLVVQGDAYLIDFEGEPARPLEERRAKHSPYKDVSGVLRSFDYAAAMILRSASAVDLSEPARQARQRVARQYLHQSRHAFVEAYGLATAAMPHAWQHAEGERAALELFCLEKAAYEITYEAENRPSWLAVPLHGLHGLISTWGESE

SEQ ID NO: 2135 - protein, 269 aa, Salmonella enterica subsp. enterica serovar Paratyphi A str.
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGITLDQLARALGHDRKIIRAMPNTPSLVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGKHPGELKDMVCSPGGTTIEAVRVLEERGFRAAVIEAMTKCMEKSEALSKS

SEQ ID NO: 2136 - protein, 131 aa, Triticum aestivum
  misc_feature (71)..(71): Xaa can be any naturally occurring amino acid
  misc_feature (82)..(82): Xaa can be any naturally occurring amino acid
  misc_feature (92)..(92): Xaa can be any naturally occurring amino acid
  misc_feature (106)..(106): Xaa can be any naturally occurring amino acid
  unsure (1)..(131): unsure at all Xaa locations
MAPTVMASSATSVAPFQGLKSTAGLPVSRRSNGASLGSVSNGGRIRCMQVWPIEGIKKFETLSYLPPLSTXEALLKQVDYLXIRSKWVPCLXFSKLGSSSVKHNAXPGYYDGRYWDNVGSCLCFGCTDATQ

SEQ ID NO: 2137 - protein, 230 aa, Borrelia turicatae
MIQKLTKIVATISDLRCDPEHIKELYEAGVNVIRLNTAHQSHDDAIRVINNVRKVSNKIALMIDTKGPEVRTANIENPITVKIGDKIIISTSPINESNALQTNYDGFVNEVPNGSTILIDDGELEMTVIEKLTDRLICKVKNDGQIKNKKSINTPGISLKLQSVTEKDKGFIELAAKQNIDFIAHSFVRHAKDIQDVKDILNAAGNPDVKIIAKVENQEGIDNIEEIAKA

SEQ ID NO: 2138 - protein, 328 aa, Leptospira interrogans serovar Lai str. 56601
MKHYDVFGVGNALVDILVPTENVFIKRLGFEKGIMTLVDSEKQAEVLTALEGSKKELRSGGSAANTMIALANSGGTGTYTGKVSKDTYGEFYKKDMENAGILFEVAPEDKGHTGTCVVLTTPDAERTMLTHLGISITLQKSDVDLEKLKSSSISYIEGYLWDGQGTKEASLLTMEESKKNGVKVAYTYSDPFCVNRSREDFIRLTKEYFDIVFCNTEEAKALSQREDKLEALKFISGLSALVFMTDSANGAYFAENGKISHVDGFPVKPIDTTGAGDCFAAGVLYGITHGFSLEKSTRWGNYVASRIVQEVGPRLGIKLMGRQDEILK

SEQ ID NO: 2139 - protein, 431 aa, Zea mays
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPASSSSYASLPCASDWCPLFEGQPCPANQDASAPLPACAFSKPFADTSFQASLGSDTLRLGKDAIAGYAFGCVGAVAGPTTNLPKQGLLGLGRGPMSLLSQTGSRYNGVFSYCLPSYRSYYFSGSLRLGAAGQPRNVRYTPLLTNPHRPSLYYVNVTGLSVGRTWVKVPAGSFAFDPATGAGTVIDSGTVITRWTAPVYAALREEFRRQVAAPSGYTSLGAFDTCFNTDEVAAGGAPPVTLHMDGGVDLTLPMENTLIHSSATPLACLAMAEAPQNVNAVVNVVANLQQQNVRVVVDVAGSRVGFAREPCN

SEQ ID NO: 2140 - protein, 409 aa, Nostoc punctiforme PCC 73102
MKAVVFHGIGDIRLDNVPEPKIKESTDAIIRLTSSAICGTDLHMIRGTFTGMKPGTILGHEGVGIVEEIGSNVRNLKVGDRVVVPSTIACGYCSYCRTGYHAQCDNANPNGHNAGTAFFGGPEAAGPFDGLQAEYARIPYANAGLVKLPKEVTDDQAILLSDIFPTAYFGADIAEITPGDTVAIFGCGPVGQFAIVSARLFGAGHIIAVDTIPSRLEMARDLGAEIIDYNAEDPIEAIRELTGGIGVDRAIDAVGVDANAPDSGPAAEKARQEAQQFQQQLQQIAPKTNPQNGNWHPGNAPSLVLEWAVQALAKAGTLSIIGVYPPSHNFFPIGTAMNKNLTINMGNCNHRKYIPTLVDLVRNGTVDPTKVLTQVEPLMSVIDAYKAFDRRQPGWVKVELVPGATLANV

SEQ ID NO: 2141 - protein, 955 aa, Magnaporthe grisea 70-15
MRLKATSCNRFCISLVWGLALLGRHGSAAQPGRDAQAAAAASAIGSCEARTINYITHTLPQQCLRTSWSSASNDAAAAPAGPIVTSTTGEPTAAPETEGQNNDQKTDSETGGADDGQDQELATSSFMPGTTMTGRASNSSKAEKEVETRERQTWILTHCRRRVSRDNGFGSWIDESEATGKQLEQQKQQQDSKGEDLAIYDGLDYTRSKDAGKTCKERFSYASFDAGATVLKTGPRAKNAKAILVENKDSYMLLECAQPNKFVIIELSDDVLVDTVVIANFEFFSSMIRTFRASVSDRYPVKLEKWKVIGTFEARNQRDIQAFLVEHPQIWAKYIRIEFLNHYGSEFYCPISLVRVHGTRMMDSWKEVEGGRDDDDEAIDQGMPTISQQPSEPQPQPAVEEPSPPEPVPADNATSAPPVVTEMGLTPWEPIFREFSSFEMCEMPEPTATDSGLAGQSSVVSGPETQPMHDGRPHDSVDGNRSTAQKPVSSLTSAIFKETAAPRGNVTMPDPAASVYNIENLVPPPLASTESPSGAKDPASTSSTSTQASSSKHVSNSSKHKTLVSKPSSASAKPAMPKPSSTVPSSARNRTGTNTNSAAAASPTVQESFFKTVAKRLQLLESNTSLSMQYIEDQSRFLQDALARMERKQISRVDTFLDTLNRTVLAELRSVRSQYDQIWQSTVIALESQRDQSQREIVALSDRLSVLAEEVVFQKRMAILQSILLLACLVLIIFSRAFGGAASTVTFSGTPRHSRWAFTMPMSPPPSAGPPTGRRYGPGPPSPSPSPSRLGSIPPRSPPEDDDRLAAIDTRHRYADKTLPLTPTSEYDAGGREVTPVIHVVDETGEPSYFDDTASFSSPQRLGSEASDATPDLGYGSDTHVEPADPVVISSEPADEENVSRAEQAKYPPGGEENDGFEADAADKEVEGSGPPLTRTTLPDFGDSRKPLPALPESP

SEQ ID NO: 2142 - protein, 540 aa, Rhodopirellula baltica SH 1
MHRILVLDDIAQEGIDLLEASEGIEYEVRTKLKGEELRQSLNEFDAAILRSGVTITPESLEGNTRLRALVRAGVGTDNIDKPAATRRGIVVMNTPAGNTVSTAEHTFAMLLAMSRNIAAANQSLVEGRWDRKKFMGTQVAGKTLGIVGMGRIGREVASRAQAFDMDVVAFDPFLTDDQAESLKVRRVATVDDMLPQIDYLTVHTPLTPETRGLIGMEQLEKVKPGLRIINVARGGIYDSEAMVEGLKSGKLGGVALDVYENEPCTDSPLFGMPGVVCTPHLGASTEEAQTQVAVEGIHLLLNYLRTGEIRHSVNVASLDPKTLAELRGHLNVAHRLGLFLSQLHGGGIDHARLTFRGEVSGKDTRVLNNAFCAGLLERVVEDANVINSEMLLRERGIELTCERVGDKGAFTSSITAEVSGNGKTVQAGAAILGHEMPRLILVNGYRLESFLDGKLLVFVHKDVPGIIGRVGTTFGSHGVNIAQMAVGREGDAPGGAAIGVLSLDGEVPTAALDDLLAIDAITECQVIDMPGAGQLPSWLS

SEQ ID NO: 2143 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQYEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 2144 - protein, 475 aa, Gluconobacter oxydans 621H
MNDQVGTTETLLPQDDSSTSIFDATRFKIIAIGVIAALAGLMSGLDIGVVAGALDLFGKEYHASTVALEWVVSSMMAGAAAGALSAGWMSKALGRKHSLIVGGAIFVIGTIGCAMSWSVASMISFRVVMGIAVGISAFTAPLYLSEIASEDARGAMVSTYQLMVTVGIFIAFLSDTYFSYSGNWRWMFGVAGIPAVLFLIGVLFLPYSPRWLMAQGRQKEAKQILLDLRDDPLEAAKEIRAIREQLETKQEGFKLFLTNSNFRRSVALGVMLQMMQQLAGINIVMYYAPNILAAAHFDAQSQMWCTAIIGLVNMLATFVALSLVDRWGRKPILYAGFTVMALGMGVLAMLLQTGMTTQSSQIAAVFLLMIFCAGFAMSAGPLTWVLCSEIQPLAGRDFGIAISTFTNWMTNLLVGVSFLTLMQTLGTAGTFWLFAGLNALFLLLTILFVPETRGMSLAVIEKRLMQGVKLRKLGR

SEQ ID NO: 2145 - protein, 467 aa, Clostridium perfringens str. 13
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 2146 - protein, 241 aa, Candida glabrata CBS 138
MSEDFNSAKFLNKQLKARGLQKLRFYCQVCNKQCRDQNGFKSHVKSPSHLKNISTVTQDDILEFTKLFEENFLNTLKTNHGEKKIAVNKLYNEIIKDRDHIHMNATSFKSLTGFIKYLSKEGKIKVYDDNIGDMPEDQVDLTQLNISFIDNSDTNLRRKEKLQEIEAEELTESKLEEYLRTKRQLREQEEEESDVQDTDLGSNTDIQRDNLTNLKIQLKKTKIKQNKVKKPLNKNKNNVFG

SEQ ID NO: 2147 - protein, 458 aa, Haloarcula marismortui ATCC 43049
MDTQQAIRETPEPVTPGDRPPRLGRVPFVDNTAAMLRDPLGFYDRAGAHEADMVGYSVAGTTGCFVCHPDLVEQVLVTDADVYEKGQLLQDTLGQFIGEGLFLLEGEEWQQQRTALQPAFYRERIAAYGDTMTEFADRAAAGWSDGQRIDVLPHMQSLTLNILGKTLLDVDIETTADALEPLLDALRTRLDPRSLSAYLPLWVPTATNRAVTNSLAEFQSTLDDVIAARQREDEHAREARDDVLSLLLSLDDETMDRERLGHQLLTFLVAGHDTTALTLTYAWFLLANNPKRQQRLHDELDATLGERQPTPEDLFELPYLDAVLNEVLRLYPPAFTVFRQPTEPVTLGGYELSTDAQLTLPQWLVHRDDRWYDAPDAFRPERWDDDLEASLPDYAYYPFGGGPRHCIGMRFARMEAKLALATIAQQYAVEAVTEPPLSLAMQITLSPTAPVEVRLRER

SEQ ID NO: 2148 - protein, 272 aa, Pseudomonas syringae pv. tomato str. DC3000
MSKTRIAFVGAGNMAASLIGGLRAQGVEASLICASAPGAETRERISTEHGIEVFADNAEAVKGADVVVLAVKPQMMKSVCQALKASLEAHQLIVSVAAGITCASLTQWLGDQPVVRCMPNTPSLLRQGASGLYATDKVSPTQREQAEQLLSAVGVAVWVEQEKHMDAVTAVSGSGPAYFFLMMEAMTAAGVKLGLPEDIAKKLTLQTALGSALIATGSNVDAGELRRRVASPGGTTEAAIKAFQAGGFEALVETALTAADHRAAELAEQLGK

SEQ ID NO: 2149 - protein, 254 aa, Arabidopsis thaliana
  misc_feature (117)..(117): Xaa can be any naturally occurring amino acid
  unsure (1)..(254): unsure at all Xaa locations
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGNYPVGTFAIDLERNGIHXMDSGKNAQKGNGFWGSRRDLAKWEKNGSPLGPIKTGENGAFLPKGGFPQVVWFLTKREKIFGGGGGTPPPLCGGGPKKKTPPPPRGGKKKISWGREKKKKKKIGGGGGAPPPPRGGGFILWRGGFYQGEGEKRGGRK

SEQ ID NO: 2150 - protein, 330 aa, Glycine max
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 2151 - protein, 905 aa, Magnaporthe grisea 70-15
MRANRLRNDDDDSGSDVGSQRPDGNNARVFASPVGAQGYIPHHKEPPRYIRTKVYNKKEREFNRMFLAQELVGTRPLAQAKTDEKVPVVTVSTADGTSRRAERTGGAVWATEFSRDGRYLAAAGKDQVVRVWAVISTIEERRTREDEEEALHQQSSPTNSGGSRERLHAPVFREQPLREFQGHTGEILDLSWSKNNFLLSTSMDRTVRLWHVSRKECLCAFRHGEFVSKVAFHPQDDRFFLAGCLDSRLRLWSIPDRAVAFEAQTNDMITAVAFTPDGKTAIAGMLNGVCNFYDTEGLKFQSLLHVRSSRGKNAKGSKITGIRTAEVPTGRGSSDMKVKVLVTSTDARVRVYNLGDKALDVKFKGHEHTAAQLSASFSHGANYVICPSEHRKVFIWSLGSPNQRALNVSNPGGIGTDTLKGDKGPCESFAAHGSGVTTAIFAPAETRQLLGASGDPIYDLCNPPPVTLISREEEAAAAAATSSSRDPSPTSPARATHNMSQTALSEAPSVARSRRADESPAYVARSTHQQGNIIVTTDDTGIIKVFRQDCAYRRREGPETASLLSRKRDSIVGRSASILTRTSASSAARSRKGSLSRSIQGIITGEGVAHSGGAISDQILDWRRDVEAKGSNGRSGSINSAAGTPVRVERSVSPIKSPLTARTLASERRREQYAHSGSPLVPRGDRGHLSPASSTFSDAHRINSEAAMATGSASRQRQALPLGEGGANNGGLWGFRWPKMPTLRMSIGGIGMGSGTASPGKDSVGTGTSTSDGQGSVPGGYPNVRASSDLSIKEKIKEASKMSKEKGKEKEKEKERKARTPPLQMPSFSDKSPPRQTQAGGGGLSTKDKRSSEGAVDSEEDMACPRCGAREFKAKKLGSGQQQQRQRLVCATCATPAAEQEDFAF

SEQ ID NO: 2152 - protein, 175 aa, Triticum aestivum
MAPTVMASSDTSVAPFQGLKSTAGLPVSRRSNGASLGSVRNGGRIRCMQVWPIEGIKKFETLSYLPPVSTEALLKQVDYLIRSKWVPCLEFSKVGFIFREHNASPGYYDGRYWTMWKLTMFGCTDATQVINDVEEVKKEYPDAYVRIIGFDNMRQVQSVSFIAFKPPGCEEYGKA

SEQ ID NO: 2153 - protein, 433 aa, Methanococcoides burtonii DSM 6242
MNDVSSEKSIGYLSAVSIGIGGMVGGGIFAVLGLAVEIGKGGTPIAFGLAGIVALITSYSYAKLSVRYPSEGGTVEFLNQAFGSGLVTGGLNILLWLSYVVMLSLYAYAFGSYGSTFFPDSMQAVLRHVLTSIIIVSLTVVNIVGAKVVGKLETWIVGFKVAILLIFIGVGIWSVKSQPFQPTISSNPLQLVAGGMIIFLAYEGFELIANTAKDVKNPGKTLPCAYYSAVVFVIVLYVLIAFITVETVSIDSIIQAKDYALAVAAKPFLGNFGFNLIAVAALLSTASAINATLYGASRVSFTIAKDGELPEILEEKIWNRPIEGLLITSALTLIVANTFNLASISIMGSAGFLLIFGAVNASNACLYQKTASYRWISITGIIVCSIALFTLIWYTLNNSPKDIFILAFMLCSAFAIEAIYRRFTGRYIKKIHE

SEQ ID NO: 2154 - protein, 468 aa, Colwellia psychrerythraea 34H
MSQAVFDLIKEHDVKFIDLRFTDSKGKEQHISIPHHQVTEDFFEDGKMFDGSSIEGWKGIDESDMVMMPDASTAILDPFTDAVTLNIRCDILEPSTMQGYSRDPRSVANRAEEYLRSTGIADDVLVGPEPEFFVFDDVRFHTDMSGSFYKIDDKEASWNSGTEYEEGNMGHRPGVKGGYFPTAPVDSSQDLRSAMCLVMEDMGLIVEAHHHEVATCGQNEIACRFNTLVKKADEVQIYKYVVHNVAHAYGKTATFMPKPLVGDNGTGMHVHMSLAKDGVNLFAGDKYGGLSETALYYIGGIIKHAKALNAFTNPATNSYKRLVPHFEAPVMLAYSARNRSASIRIPLVPSPKAMRIEARFPDPACNPYLAFSALLMAGLDGIKNKTHPGDAMDKDLYDLPAEEAASIPQVATSLDDALDNLEADFEFLTAGGVMDKDMIDAYIAIKREESRRVNMTTHPLEFELYYSV

SEQ ID NO: 2155 - protein, 155 aa, Triticum aestivum
MDASATVAAGKAKKGAAGRKAGGPRKKSVSRSVKAGLQFPVSRIGRYLKKGRYAQRVGTGAPVYLAAVLEYLAAELLELAGNAAKDNKKSRITPRYLLLAVRNDEELGKLLAGVTIAHGGVVPKINPVLLPKKTAEKSTKEPKSPKKTAKSPKKA

SEQ ID NO: 2156 - protein, 357 aa, Arabidopsis thaliana
MEKHEEENGLCKAESVDGSLDVWSCQNSDSSSADHLVVMVHGILGSTDDWKFGAEQFVKKMPDKVFVHCSEKNVSALTLDGVDVMGERLAAEVLDIIQRKPNICKISFVAHSLGGLAARYAIGKLYKPANQEDVKDSVADSSQETPKGTICGLEAMNFITVATPHLGSMGNKQVPFLFGFSSIEKVAGLIIHWIFKRTGRHLFLKDEEEGKPPLLRRMVEDTDDCHFISALRAFKRRVAYSNVGHDHVVGWKTASIRRDSELPKWEDSLNEKYPHIVYEELCKACDMEDIPEGENHSDDIEEEMIKGLSSVSWEKVDVSFHSSRQRFAAHSVIQVKNEDMHIEGADVIEHIIDHFHA

SEQ ID NO: 2157 - protein, 285 aa, Thermosynechococcus elongatus BP-1
MSPIIQWYPGHIAKAERALKEQLKQVDVIFEVRDARIPLASCHPQIRQWASGKQRLLVLNGMDRISDRDRQQWLTWFETQGETVFFTNAQRGEGIRRLEQAAVRAGAAINQRRQQRGMQVRAVRAVVLGFPNVGKSALINRLLQQRVVESAARPGVTRQLRWVRLSPVLELLDAPGVLPMNFKNQEAAVKLAICDDIGQAAYDPCRVAPMLVEIMQQLGYAERLRDRYGLALTDTGETYLYDLAARRYHGDLERAARQLLQDYRRGYLGAIALEHPPQSRNSTIP

SEQ ID NO: 2158 - protein, 356 aa, Rhodopirellula baltica SH 1
MLHAIIMAGGSGTRFWPASRKAKPKQLLSLAGDRTMIQATRDRLSSVIPAERTHVLTSVALVEPIAEQLPELRRETIVGEPCRRDTAPCVGLAAALVAHEDPDAVMLVCPSDHVILQHDKFAEGVRRGEAILAEHPDAIVTFGIKPSYPAESFGYIQRGDVIEGHEAYKVKTFREKPDSATAKKYLDEGTFSWNSGIFLWKAQTILDALEQHEPEMYSHIQAISDAIGTDDYDEVLQKEFAAIEGKSIDYAVMERHSPVVVIEAPFDWDDVGSWQAVSRLHPADEFGNAVVGSHVSVDSTGCIIHGTPGHTIATIDVHDLIVVQTADATLVAPKTSEERVREVVAALQASGSEDRI

SEQ ID NO: 2159 - protein, 163 aa, Arabidopsis thaliana
  misc_feature (21)..(21): Xaa can be any naturally occurring amino acid
  misc_feature (52)..(52): Xaa can be any naturally occurring amino acid
  misc_feature (67)..(67): Xaa can be any naturally occurring amino acid
  misc_feature (74)..(74): Xaa can be any naturally occurring amino acid
  misc_feature (141)..(141): Xaa can be any naturally occurring amino acid
  unsure (1)..(163): unsure at all Xaa locations
MASTSLLKASPVLDKSEWVKXGQSVLFRQPSSASVVLRNRATSLTVRAASSXYADELVKTAKTIASXPGRGILXAMDESNATCGKRLDSIGLENTEANRQAFRTLLVSAPGLGQYVSGAILFEETLYQSTTEGKKMVDVLXEQNIVLWYPNLQRSGRHLVHTI

SEQ ID NO: 2160 - protein, 1103 aa, Candida glabrata CBS 138
MSAISSNTVSVIKNNQIGPWKLGETLGSGSTGKVLLASNETTKQQAAVKVISKAVFEAMNNSESNGDATNALPYNIEQEIIIMKLLNHPNVLRLFDVWETNSDLYLVLEYAEKGELFNMLVERGPLPENEAVRAFRQIIIGISYCHSLGVVHRDLKPENLLLDNKLNIKIADFGMAALESEDKLLETSCGSPHYAAPEIISGLPYEGFSSDVWSCGVILFALLTGRLPFDEEDGNIRNLLLKVQKGEFEMPDDDEITKEAQDLLARLLTVDPSKRITIREILKHPLLQKYPSIKDSRSIRNLPREDTYLSPLADTNSKIDDAILQNLVILWHGKDAREIAAKLREPGANTEKTLYALLYRFKCDTQREANRARRQSKIVQRNSTIRSTAPESPSKKKTYTPQKKNKRASIIASSSKRPVSVTKTATNITVNSSITGTPKSAKRMSMNNSARKRMSALYGTRDSPTKTSRSRRSSIITKDFLGNRPRDSVISMSHNKRASKSSKRISLVPNLKRQSVTTKLMATYAKLSEDDDWEYIERETKRTSSDFATLIDEIFEYEKYEQIRKEKAELERKVRETKEREERERKERQEKELQERLERERIEKQKEDIARQMDEEISNLKKELVGDQDNEDKFRSVSEPLESKSKKIEDIEEDIDGILRNRKYSLQTRPVSRLDPGIGFIDKPRQSEQHVPETVNLEPELEETEQKILETIRRSKFLGSSFDIKKELENVKRHRQTSQPIEKEMAPPALPETLPKAVEKKNVSMDPSLRKISDIKVPQFTRKSRHFSTSNRRLSVLSMYSTKESYSNLADILKNGPGEKEMIQTAPTPKSADDSDQLFDTIDEADTPASVSREERLYEVAEESENELANKKIDIADLLNSEGSNLKSVEEQEDSMKLPKLPPLFEDGSTKETKEQSKSMIPENMQSSESQKQIEKNNSDEGGSLNPFMTKHRDVSDKGVTKEKPTVTMKTTSEQVSADKKRNMSFLRKLSKGSSSSKDNVDVTLSTSVSSKQLFSGLVNLLKGWTKYGLKGIAIDSTSQTITGKLANDNILSFRSTAFSILIFSQEKGSAVTFRKVSGSGKAVRRLSDEVKKVLSKEGVLRD

SEQ ID NO: 2161 - protein, 293 aa, Treponema denticola ATCC 35405
MNSGFFLSPPNYDSPAELKSLLETLGFAMQKKFGQNFLIDKKTRENLISFLTLDKGTRVWEVGPGLGAMTYLLLEKGVHLTAFEIDKGFISLLKKIFLENSKQNFTLIEGDVQKNWLPYLIEHGKPNVFFGNLPYNIASDLIASTVEAGVVFDTMLFTVQKEAAERITARPGNKNYTAFSVLCSLFYECKIVKTIPASAFWPQPNVESAAVLFKAKKEFAEYKNFKLFIKIVKALFSSRRKNIKNNLGSWMKSNGYGDKIDLVLERSGLSGNLRAESLALYDFLLLSDIIGHL

SEQ ID NO: 2162 - protein, 248 aa, Chromobacterium violaceum ATCC 12472
MSGKLVIGNWKMNTRGDSARQLAAALLADGQTNREGVGIAAPAVYLAALAEQLKGGKIALSSQDVSRFAADGAFTGEVSAAMLADVGCRYALVGHSERRQYFREDNAALLAKMRNAIAAGVTPVLCVGETLAQREAGDYLNVVREQLAILSDIADGEYVVAYEPVWAIGTGKVASLEQIAEIHAFIKNWCLQNAGGSAKIRVLYGGSVKAENAEAILATENVDGALVGGASLDADSFRVICQAAGKMI

SEQ ID NO: 2163 - protein, 435 aa, Robiginitalea biformata HTCC2501
MPGNRVAACESAGNWLPLTHLKPPALKHVPKLKIFNDPIYGFIRIPSRLLFDLIGHPYFQRLRRISQMGMSYLVYPGAHHTRFHHALGAMHLMQNAVDLLRRKGLEITPEEENGLLCAILLHDIGHGPFSHALENELIPGHSHEELSLRFMRQLNEEFSGQLEVAIEIFRGCYKKQFLNELVSSQLDMDRLDYLKRDSFYTGVAEGNINSERLITMLTVYDGKLVVEEKGIYSVEKFLMARRFMYWQVYLHKTGLAAEQVLVRLLRRARERYLDGKLEHCGRNLEYFLALEGGGFPDTPEALHRFAGLDDVDILAALKDWQSDPDPVLSRLCKMLLNRRLPAIKIKKKPIAESKLEGKIQRVQAAWGLTRDEAGYFVFSGEIVNRAYNQDRQNINILRENGKIRDVASTSDQLNLQALSADVVKHYICYPKKGVI

SEQ ID NO: 2164 - protein, 315 aa, Roseovarius nubinhibens ISM
MADTQFGPHGWTPERLGSLAGRCYVITGANAGTGYEAARLFLSKGASVVMLNRSAEKSAAAIATLKAEHGAEADVRFIEMDLADLTSVRRAAEEIRETVPRIDALICNAAIAQVPKQRLTVDGFESQLGTNHYGHFALCGLLFERIEESEGRIVVVASLGYNMGIKTIQFDDLNWDNNYSANAVYSQSKLAQMMFAYELQDRIRAAGKSVEVLVCHPGSSKTSLIKTSGSPVMRAIWWLMTKSPMVQTAQQGAYPEVMCATEEGLEERALYGPTGRMEFVGPVGRGTLHPHAYDKPVMTRLWEVSEAATGVVWPL

SEQ ID NO: 2165 - protein, 294 aa, Triticum aestivum
QGLPPQDNSVHGALQGDGHEEAKSTLVVTGKEIKVFAERDPANIPWGSAGADYMVESSGVFTDADKAGLHLKGGAKKVIISAPSNNAPTFVMGCNESSYKPEYNVISNASCTTNCLAPLAKVIHDTFGIEEALMTTIHAITATQKTVDAPAAKDWRSGRAGLTNIIPASTGAAKAVGLVLPELNGKLTGMAFRVPTIDVSVVDLTARLKKEASYDEIKAAVKAAAEGPLKGILAYTEDEDVSSDFIHSSVSSTFDAKAGIALSKTFVKLVSWYDNEWGYSNRVIDLIVYINDKQ

SEQ ID NO: 2166 - protein, 284 aa, Helicobacter hepaticus ATCC 51449
MKKTLIVVGYGNMAKAILANNSFVTQRYHLIITGRYAHKAYDFITQCALDASVYEAKVESSSSNKSIIDIEGKDILLCTKPAGLESFVFKGQANSVYSVLAGTSIAMIQKHLSASSIVRLMPNIAAHSKLSATAFYYHMLDTKDSAQVLHNEIRPFIESFGVAVQVDSEALIESSIAASGSSIAFLALIAESLIDAGILEGLNEQQSIALVKQTFVGFATELAHKSPNELKYAISSPGGTTIRGLAVLEESGMRGILIKAAHTAAEHARQAIQKYSTQDMPKKR

SEQ ID NO: 2167 - protein, 417 aa, Chromobacterium violaceum ATCC 12472
MAEIRNYTLNFGPQHPAAHGVLRLVLELDGEVVQRADPHIGLLHRGTEKLAESKTFIQSLPYMDRLDYVSMMCNEHAYCLAIEKMMGIEVPERAQYIRVMFAEITRILNHLLWIGAHALDIGAMTMFLYAFREREDLMDCYEAVSGARMHAAYFRPGGVYRDLPDSMPQYTVSKIKNAKELARLNEGRKGSMLDFIEDFTKRFPTYVDEYETLLTDNRIWKQRTVGIGVVTPERALNLGMTGPMLRGSGIAWDLRKTQPYDVYDKMDFDVPVGVGGDCYDRYLVRVEEMRQSNRIIQQCVAWLRANPGPVITDNHKVAPPSREGMKSNMEDLIHHFKLFTEGMHVPEGEAYAAVEHPKGEFGIYLVSDGANKPYRLKIRAPGYAHLAALDEMATGHMIADVVAIIGTQDIVFGEIDR

SEQ ID NO: 2168 - protein, 99 aa, Glycine max
  misc_feature (51)..(51): Xaa can be any naturally occurring amino acid
  unsure (1)..(99): unsure at all Xaa locations
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 2169 - protein, 222 aa, Glycine max
MMSSSPFPSCFRPSPTTESQPPPPPPPAHSTISNLTIYHTDTGPVSLTWSRSIVGRSLHIQLHQNQNPLDSPPYPNPTTLSFHHHIRPFLFWKKHGSKKLAPDTFLFWNLSRAKFGAAPEPLSGFYVALVVHNHMTLLIGDSTKDAFSKSKARHPNTPQLLLLKKEHVFADRLYTTRATFGGKAREIQIDCGYHDHSRLCFSVDGEKVLQIKRLKWKFRGNE

SEQ ID NO: 2170 - protein, 531 aa, Silicibacter sp. TM1040
MAPKVLISDKLSDAAVQIFRDRGIDVDFLPDVGKDKEKLAEIIGQYDGLAIRSATKVTPTILENATNLKVIGRAGIGTDNIDKEAASKKGVIVMNTPFGNMITTAEHAIAMMFAVARQVPEASASTHAGKWEKSKFMGVELTGKTLGVIGAGNIGGIVCDRARGLKMKVVAYDPFLSEEKAKKMQVEKVELDELLARADFITLHVPLTEQTKNILSRENISKTKKGVRIINCARGGLVDEEALAEALTSGHVAGAAFDVFSVEPAKENPLFNLPNVVCTPHLGAATTEAQENVALQVADQMANYLLTGAVENALNMPSVTAEEAKIMGPWIKLADHLGAFAGQMTDEPITAINVLYDGVAADMNLDALNCSVVAGIMKKVNPDVNMVSAPVVAKERGIQISTTNQDKSGSFDGYIKVTVVTAKRERSVAGTVFSDGKPRFIQIKGINIDAEVGAHMLYTTNQDVPGIIGTLGQTLGDMDVNIANFTLGRNEVGGEAIALLYVDAEVPADARAKLAETGYFTQIKPLAFDVA

SEQ ID NO: 2171 - protein, 158 aa, Zea mays
  misc_feature (41)..(45): Xaa can be any naturally occurring amino acid
  misc_feature (47)..(49): Xaa can be any naturally occurring amino acid
  misc_feature (88)..(88): Xaa can be any naturally occurring amino acid
  misc_feature (114)..(114): Xaa can be any naturally occurring amino acid
  misc_feature (123)..(123): Xaa can be any naturally occurring amino acid
  unsure (1)..(158): unsure at all Xaa locations
EVERSHAPSAACSFLALATRHHHTHPNLARRRGQAEGSAAXXXXXPXXXILAADESTGTIGKRLSSINVENVEENRRALRELLFCCPXCSQYISGVILLRETLDQKTQDGQPFXVDVLREEGXLPGIKVEKAPFEVGCPDKETPPKGLDDFGKGLAQE

SEQ ID NO: 2172 - protein, 397 aa, Mesorhizobium sp. BNC1
MRALVWHGKHDVRVETVDDPKIVNPRDAIIKITSTAICGSDLHLYDGVIPAIRPGDILGHEFMGEVVEVGKGNSRLSKGDRVVVPFVIACGKCFFCQKQQYSACDNSNPAEKADMSEMLYGHHMAGLFGYSHLTGGYAGGQAEYVRVPYSDIGPIVVPDDLDDDEVLFLSDILPTGWMAAENCEIEEGDTVAVWGCGPVGLFAIQSALIMGAAQVIAIDHYPHRLELASRIGAKVINYKNSRVYEALMDMTGGIGPDAVIDAVGMESHGFAPDNLYDYAKQTLKLETDRPHVLRQAIYACRKGGRVSVPGVYGGFVDKFPVGAFMQKGLTLRTGQTHVQKYLSSLLDMIRERKIDTTFLISHRLSLEAGPEGYRKFAFEQNETTKVVLKPGWENANG

SEQ ID NO: 2173 - protein, 588 aa, Zea mays
MYCVWQLDSKRCNSQLMLVISVVAAGSLLNRGQLITSVVTKCGDKVLYVVTILPFLMQMYSEASSEIPSQAAIANSRRKTKIVCTIGPSTNTREMIWKLAETGMNVARLNMSHGDHQSHQKVINLVKEYNAQNTDGNVIAIMLDTKGPEVRSGDVPEPIMLSEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQATTCLARRPKSELFSAETGGRGHCCGVMNS

SEQ ID NO: 2174 - protein, 217 aa, Salmonella enterica subsp. enterica serovar Paratyphi A str.
MNQTLLSSFGTPFERVELALDALREGRGVMVLDDEDRENEGDMIFPAEIMTVEQMALTIRHGSGIVCLCITEDRRKQLDLPMMVENNTSAYGTGFTVTIEAAEGVTTGVSAADRVTTVRAAIKDGAKPSDLNRPGHVFPLRAQAGGVLTRGGHTEATIDLMTLAGFKPAGVLCELTNDDGTMARAPECIAFAGQHNMAVVTIEDLVAYRQAHERKAS

SEQ ID NO: 2175 - protein, 282 aa, Glycine max
  misc_feature (151)..(151): Xaa can be any naturally occurring amino acid
  unsure (1)..(282): unsure at all Xaa locations
MILIYYLSEHPAIVGFRWSHAQSWGATWSFLFTSIASYLFLSILLHLSLSLLFRRRQIPLGPFPAVHSLSMSLVSATIFAGILLSSAAEIRDTRWFWPRSKTPLQWLLCFPLGTRPSGRVFFWSYVYYLSHFLHMFRTLLTIVRHRRLSFXHLLSHSISAFASFLWLEFSQSFQVLAILFATLVYAVVYGYRFWTAIGLRGACFPFVLSCQIALLACNIACHVAVFFLHFFLKGGCNGIGAWLFNSILNLALLMLFLNFYVRMHVVHKRRKVRDVVVAPALS

SEQ ID NO: 2176 - protein, 237 aa, Synechococcus sp. WH 5701
MAELQDRMKLAVATAAVDQIRDGMVLGLGSGSTAALMIRELGARLRRGELSAITGVTTSFQGEVLAAELGIPLQSLNAVSRIDLAIDGADEVDPAFQLIKGGGACHVQEKLVARRADRFVVVVDSSKLVKRLNLEFLLPVEVLPGAWRQVKAELEAMGATADLRMAVKKAGPVVTDQGNLVLDLKFAGGITDPAALEQAINNLPGVLENGLFVGLTDQVLVGEIVDGEPRVRDLERI

SEQ ID NO: 2177 - protein, 471 aa, Pseudomonas fluorescens PfO-1
MTPDKKVKILATLGPAVDGIEDIRELVEAGVNIFRLNFSHGDHADHAKRYQWIREVERQLNYPLGILMDLQGPKLRVGKFADGKVQLHRGQAFRLDLDATPGDERRVNLPHPEIIAALEAGMDLLLDDGKLRLRVVTKYSDAIDTTVLNGGELSDRKGVNVPQAVLDLSPLTTKDRRDLSFGLELGVDWVALSFVQRPQDILEARELIGDKAFLMAKIEKPSAVEQLREIAELSDAIMVARGDLGVEVPAESVPQIQKNIITTCRHLGKPVVVATQMLESMRFSPAPTRAEVTDVANAVAEGADAVMLSAETASGEYPLEAVQMMSKIIRQVENGPDYQTQLDVSRPKAEATVSDAISCAIRRISNVLPVAVLVNYSESGASSLRAARERPKAPILNLTPNLQTARRLSVAWGIHSVVNDRLRQVDEVCSTALEIAQAQGMAERGDTLLITAGVPFGQPGSTNSLRIETLI

SEQ ID NO: 2178 - protein, 98 aa, Brassica napus
MAWRGNISKSLKELRILLCQSSPASASTRTFVEKNYKDLKTLNPKFPFLIRECSGIQPQMWARYDMGVERCVNLDGMNESQILKSLEDLVKAGGATKA

SEQ ID NO: 2179 - protein, 204 aa, Glycine max
RGRVGGRVGEHIAMVKGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQMLRDLGVRSMKLMTNNPAKYIGLKGYGLTVSGRIPLLTLITSENKRYLETKRVKMGHIYGTEFNGRLSTHDSGNGNATRIEDSNAVTGL

SEQ ID NO: 2180 - protein, 393 aa, Mesorhizobium loti MAFF303099
MPRPSSRISGIVPSGKDGWEVHFAAWTRKEAGEDIIMLSVGDHDFDTPSQTIEACVTAVRGSNHHYTPLPGLPRLRQAMAAASSACTGIETTPDQVIATPGGQAALYAAVQAVLDQGDHAIVVAPYYATYPNTFSAAGASFTVVETPAEDGFQPRADMIRAALRPNTRAILINTPNNPTGAVYSRERLEQLAQICREHDLWLLSDEVYWTLGGGEHVSPRSLPGMAERTLVINSMSKSHGMTGWRMGWLTGPQDMITLLINLNLVTTYGLPAFISIACAEALENRYGVKEIAERYAARRTVLLDAVRGMNNVSVRGSEGGMYVMLDISDVEPDDEKFAWALLDQEKVGVMPGSSFGEAAAGHIRISLCQPEPVLQEAAARLRRFASTYRREAA

SEQ ID NO: 2181 - protein, 148 aa, Glycine max
  misc_feature (64)..(64): Xaa can be any naturally occurring amino acid
  misc_feature (75)..(75): Xaa can be any naturally occurring amino acid
  misc_feature (115)..(116): Xaa can be any naturally occurring amino acid
  misc_feature (132)..(132): Xaa can be any naturally occurring amino acid
  misc_feature (135)..(135): Xaa can be any naturally occurring amino acid
  unsure (1)..(148): unsure at all Xaa locations
MEGIEGNSSRYSLKPSRICNEDVLICVDVDPQCLVEMKGATGPNGRPLTRLDSIKQAIVLFVNXKLTINPEHRFXFATLSNTLVSWVRKEFSSEIESTLAAMRVLSASSSSSTTXXQPDLTHLFRLAAHEAXKSXLQGRILRVILFYW

SEQ ID NO: 2182 - protein, 232 aa, Lactobacillus johnsonii NCC 533
MNKTEQDQLKKEAATKAAKMVEPNSVLGVGTGSTVAFFIDALGERKEREGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEAEGLKPQWRLNDEGKRYVTHYGNYIIDLAADPTPVPHGLADYLDHTVGVVEHGLFLDMCDEVIIAHSDGTIEDKKRK

SEQ ID NO: 2183 - protein, 156 aa, Oryza sativa
  misc_feature (111)..(111): Xaa can be any naturally occurring amino acid
  misc_feature (130)..(130): Xaa can be any naturally occurring amino acid
  unsure (1)..(156): unsure at all Xaa locations
LRLASTPLLSASSLIASASDCFFLSFFSVIGLIDQIVSLERWSSSFVMIKPDGDLRGLIGDIIRRVQKKGFYLRGMRVMNVERSFARQYYADLSDRPFFPGPEEYIISGPXVATVCEWKEVDVTGRGMIXCTSSWEGDPGSLRDDCVVQRGRKGVH

SEQ ID NO: 2184 - protein, 567 aa, Dechloromonas aromatica RCB
MPHDISLITTIAAAFGFALILGFVAERLKTPALVGYLVAGILIGPATPGFVADLSTASQLSEIGVMLLMFGVGLHFSIDDLLSVKRIALPGAIVQMSLATLLGMAIGHWWEWAIGPSLIFGLSLSCASTVVLLKALEARGLLTTMNGRIAVGWLVVEDLATVLILVLLPPLAGVLGGSAAAEGSDPLWQAIGKTLLEVAAFIALMLIGGRRALPWLLWQVARTGSRELFTLAVITAAISIAYGAAQLFSVSFALGAFFAGTVMRNSEFSHRAAEESLPLRDAFSVLFFVAVGMLFDPAILVEQPWQVVAVVAIIVIGKSLAALALVLALRYPLNTALTVAASLAQIGEFSFILAGLGQSLGLFSTEGMSLVLAGALISIALNPLVFAAVEPLRRWTLRHSEQARHLEDRDEPYSQLPLSTDRKYLEGQVVLVGYGRVGQRIASSMKAQGIPYVVVEQNREQVEDLRRQGIAAVSGNAAEPAVLIQAHIAHAAMLVIAAPDAINIRQMADCARTLNPAVEIVLRTHSDDDSELLRKDGIGAVFFGDEELAVGMSRRILQRFAPPPATE

SEQ ID NO: 2185 - protein, 366 aa, Chlamydomonas sp. W80
MMATAGSSAAGARVSMRAASGIRASSSSRRAAVVVKAANVNIGDSLAEFLAVATPDTKLRQLMTSMSEATRTIAHKVRTASCGGTACVNSFGDEQLAVDMVADGILFEALKYSHVCSYACSEEVPEPVAMGGSGYSVAFDPLDGSSIVDTNFSVGTIFGVWPGDKLTGITGRDQAAAGMGVYGPRTVFVIAINGFPGTHEFLLQDDGKWLLVKSTEEIGEGKLFAPGNLRAIFDNPEYSKLVSYYLEEQYTLRYTGGMVPDVFQILVKEKGVFTNVTSPSTKAKLRLLFEVAPLALLIENAGGASSCDGLVCRALDVEVTAHEQRTQICYGSKGEVARFEKYMLGESSASLTLSRPSKRPCAERAR

SEQ ID NO: 2186 - protein, 228 aa, Haloarcula marismortui ATCC 43049
MKQGGSDAAKQAAGESAAEAVEDATVVGLGTGSTAAYAIRAIGQAVDAGLDVVGVPTSFQSRQLARDCGIPLADLDDVSVDLAIDGADEVASGNLIKGGGAAHAREKIVDASADRFLVVADPTKEAAVLSYPVPVEVLPMARSTVVTAVEELGGDPTLRRAERKDGPVVTDNGNLVLDCDFNSIHDPAALASDLAALPGVVEHGLFVGMADEIHVGTADGVTVRTLSK

SEQ ID NO: 2187 - protein, 377 aa, Glycine max
MKCFFFKEKSKSAPELHKKKTPAVNRAANSTGSVSSPKSVKDLYREKEHSFRVFTLQELRDATNGFNRMLKLGEGGFGSVYKGSIAQLDGQGDPIPVAIKRLNTRGFQGHKEWLAEVQFLGIVNHPNLVKLLGYCSVDGERGIQRLLVYEFMPNRSLEDHLFNKKLPTLPWKTRLEIMLGAAQGLAYLHEGLEIQVIYRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDPRLRNQYSLPAARKIAKLADSCLKKNPEDRPSMSQIVESLNQALQYSDTSLDIAESSSSSSSRSKLVRKK

SEQ ID NO: 2188 - protein, 424 aa, Oryza sativa (japonica cultivar-group)
MGIFWSKAEPPPPMVLVPPLFDYPPIAARTRMSVPAYELMFGKLSLQNLFEDYFDHAGNMTSRVMLKPLEDPHVDLIATVSAAADKIDGTQVKGDALFRWQKDLDDPHTFVDLLVSTSNPMLQVRSCAYHPKYRVGAFGTFPLLMGNRVRSEDYGVMGVRYGSENLSFGSSFVPFPGSAELPSGAWLVGRKGSLSAGVQYKPLSGNKHLMPYTDWKNWNCAISYGVGLTSPLSPSFIFSLELARSTEFIASFYQHMVVQRRVKNPFEDDQIVGITNYIDFGLELATRIDKDKPSESANNSLFQFAASWQANKNFLFKGKLGPSKSSVALAFKSWWRPSFTFSVTAVNDHLKGTRSYGFGIRVEDLRQPSYQRADPNYVMLTPSKEHLAPGVLREYGKRPMFQAEVDSGNYDHLPTELKPISKIF

SEQ ID NO: 2189 - protein, 325 aa, Zea mays
MASNGDKGLIVSFGEMLIDFVPTESGVSLAEAPGFLKAPSGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFIGALLNQIVDDRSVLEDEERLRKVLRFANACGAITTTKKGAIPALPSDAEVRSFLEKK

SEQ ID NO: 2190 - protein, 587 aa, Bacillus sp.
MSTALTQTSTNSQQSPIRRAWWKEAVVYQIYPRSFMDSNGDGIGDLRGILSKLDYLKLLGVDVLWLNPIYDSPNDDMGYDIRDYYKIMEEFGTMEDFEELLREVHARGMKLVMDLVANHTSDEHPWFIESRSSRDNPYRDWYIWRDPKDGREPNNWLSYFSGSAWEYDERTGQYYLHLFSRRQPDLNWENPKVREAIFEMMRFWLDKGIDGFRMDVINAIAKAEGLPDAPARPGERYAWGGQYFLNQPKVHEYLREMYDKVLSHYDIMTVGETGGVTTKDALLFAGEDRRELNMVFQFEHMDIDATDGDKWRPRPWRLTELKTIMTRWQNDLYGKAWNSLYWTNHDQPRAVSRFGNDGPYRVESAKMLATVLHMMQGTPYIYQGEEIGMTNCPFDSIDEYRDVEIHNLWRHRVMEGGQDPAEVLRVIQLKGRDNARTPMQWDDSPNAGFTTGTPWIKVNPNYREINVKQALADPNSIFHYYRRLIQLRKQHPIVVYGKYDLILPDHEEIWAYTRTLGDERWLIVANFFGGTPEFELPPEVRCEGAELVIANYPVDDSEAGGPAAAGAPHRFRLRPYECRVYRLLGWH

SEQ ID NO: 2191 - protein, 540 aa, Mesorhizobium sp. BNC1
MKDYWWKDAIVYAVDVERFCDSDGDGVGDFKGLTSKLDYIAELGVTCIWLLPFYPSTGEDNGYSITDYLRVDSRFGLFQDFLEFIHRAGEHGIRVVVDLVVHHTSNQHPWFQAARHNEKSRYRDFYIWTHNPPPTPPGKGTIFPGEEGTVWTYDEVARAYYHHRFYHFEPGLNHANPDVRDEIGRIIDYWLSFGVAGFRVDAASHILENPLAKSGEDENAPDMLREMFHRATGSKSDIVMLGEVDESPNELERFFDGTRLNMMFNFLLNNYLILGLAKEKAEPIQRGLAMLPVPPENGQWANFLRNFDEADLERLTPEELESVLKIFAPKEEMRIYGRGLRRRLAPMLDGDVRRLKMAMSLLYSMPGAPVLVYGDEIGMGEDLTQEGRNSVRSPMQWDGSRNAGFSSARKERMVQPIIDKGRFAFERINAETQRNDPASLLSFVKQLAILRRERTEIGSGFCAFLECGSDHVLAHHYKSEAAPLVMVHNLAGEAVKIDVKLPAGVTSLGTLFGGEMPSIEDGHLRMSLEPYGVRWLGLPR

SEQ ID NO: 2192 - protein, 602 aa, Cryptococcus neoformans var. neoformans JEC21
MIPPLDDSSLVKAADKAWWKSATVYQVYPASFCDHADAGHGTLLGILTKVDYLQSLGVDIVWLSPIYESPQADMGYDISNYRQIDKRYGSLEDWDRLLAALHQRGMKLVMDLVVNHTSDQHPWFKESRSSRDNPKRDWYIWRPPRYNEKNERIPPNNWKGTFGQGSAWEFDETTNEYYLHLFLKEQPDLNWENPQVRAEVYDLMHWWLKRGADGFRMDVINFIAKAPGLPDAPVIDPGRTYQSFGMMSINRPEVHGWLKEMNRAVLSHYDCFAVGECPGDEAVVSYAPYSVPHNKELQMVFHFHHQSFDRAAGGLGRVHNPDWKLSELKRVFNTWQIEMAREGGWNSNYLENHDQPRIISRMASDHPSDRARCAKLLAMFHCSLGGTIYVYQGQELGMINVPRGWGLVEYKDVETIQNSEAEVQHRQVICGHANPDISDLLESNRITARDNGRTPMQWDSSLNAGFSKGEPWMRIHDDYREGWNAAAQVNDPDSAWSFWKQMLRLRKKYDAMIYGDFIALDESNEETYAYIREHPPSGQKLLVVLNLSRGNDGRGAPSTFVLPCGLDTSGSKLLISNGEVQEGQRIEGNILLGPWEGRIYLL

SEQ ID NO: 2193 - protein, 692 aa, Saccharomyces cerevisiae
MGNSSSKSSKKDSHSNSSSRNPRPQVSRTETSHSVKSAKSNKSSRSRRSLPSSSTTNTNSNVPDPSTPSKPNLEVNHQRHSSHTNRYHFPSSSHSHSNSQNELLTTPSSSSTKRPSTSRRSSYNTKAAADLPPSMIQMEPKSPILKTNNSSTHVSKHKSSYSSTYYENALTDDDNDDKDNDISHTKRFSRSSNSRPSSIRSGSVSRRKSDVTHEEPNNGSYSSNNQENYLVQALTRSNSHASSLHSRKSSFGSDGNTAYSTPLNSPGLSKLTDHSGEYFTSNSTSSLNHHSSRDIYPSKHISNDDDIENSSQLSNIHASMENVNDKNNNITDSKKDPNEEFNDIMQSSGNKNAPKKFKKPIDIDETIQKLLDAGYAAKRTKNVCLKNNEILQICIKAREIFLSQPSLLELSPPVKIVGDVHGQYGDLLRLFTKCGFPPSSNYLFLGDYVDRGKQSLETILLLFCYKIKYPENFFLLRGNHECANVTRVYGFYDECKRRCNIKIWKTFIDTFNTLPLAAIVAGKIFCVHGGLSPVLNSMDEIRHVVRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANQQQQMMETSITNDNESQQ

SEQ ID NO: 2194 - protein, 737 aa, Oryza sativa (japonica cultivar-group)
MSPKLLLSVALVMLHLASISAQPNPWCKKQCGDVKIPYPFGIGTGCAIGEGFEIICNRNADGIDQPFTGNIEVLDISVVYGRSRVLGSITTNCYNSSTGSANVNSWWMDLSTSPYRFSDAYNTFVVIGCNTLAYIYNGLNRTSYTTACASVCGGPEDLTNGSCLGVGCCQNANAIPKGLTRQDIYLYTIYNTSESDSWKFNPCSYAALVETESFSFSTEYITTMRFNDTYEGQQPLVLDWAIGDVSCEVAKNMTSYACHSGNSICVDSKNGPGYLCNCSEGYQGNPYLPDGCTGKFSSSLCNSLSLYLQFNEILNDVLSDYLKDVNECEQNPSPCTKGETCRNTIGWYYCSRPSCPLGRKLARETNTCNPDINLIIGICIGSVALVITIFFMRLMFERRKLTDVKKKYFQQHGGLILFDKMKSDQGLAFKVFTQAELEHATNKFEKSQILGHGGHGTVYKGITKDNITVAVKKCALIDDRHKKEFGKEMLILSQINHKNIVKLLGCCLEVDIPMLVYEFIPNGTLFDLIHGKNRTFHIPFSSLLRIVNEAAEGLAFLHSYANPPILHGDVKTSNILLDENYMAKVSDFGASILALSDEDQFVTMVQGTCGYLDPEYLQTCRLTDKSDVYSFGVVLLEVMTGQMPLKFEGPEIQKSLSSSFLLAMKENNLEAMLDSQIKDHESMELLSGLADIAKKCLDMCSDNRPSMKEVSEELSRLRKFSKHPWIQRDTEIESFLR

SEQ ID NO: 2195 - protein, 365 aa, Caulobacter crescentus CB15
MSQGDGQPSRCHGRSHPLIATLLGPSVLFFQRFFRLMTALYDVAAIGNAIVDVIAQCDDAFLEREGLVKGSMALIDPARAASLYDVMSAAIEASGGSAANTVAGVASFGGKAAFLGKVADDQLGRVFRHDMNAIGCVFTTPPLAEGPATAQSLINVTPDAQRTMSTYLGACVELNPADVDPDIIEAAQISYLEGYLFDPPEARRAFAKAAALAHGSDRKIALTLSDSFVVDRHRGALLGFVETQCDIVFANAAEVCALFETDDFDAAVKALAERCEIAAVTRSEKGSVVAANGQLHEISAYPVEKVVDTTGAGDQYAAGFLFGLSQGRPLPICGQLGSLAAAEVIDHYGPRPQVSLRELAEKNGL

SEQ ID NO: 2196 - protein, 137 aa, Prunus avium
TKPSNCIGSQFEFRILSPQLRSKLKKSWPDVKNGNDTNFWAGEWNKHGTCSEDTLNQMQYFERSHDMWISYNITKMLKSSQIVPNARQTWSYSDIVSPIKTATGRTPLLRCKPHPKSQTKSRPKSQAKSQPNSQANS

SEQ ID NO: 2197 - protein, 223 aa, Houttuynia cordata
  misc_feature (95)..(95): Xaa can be any naturally occurring amino acid
  misc_feature (212)..(212): Xaa can be any naturally occurring amino acid
  unsure (1)..(223): unsure at all Xaa locations
IQAGAKKVVISAPSKDAPMFVVGVNEKEYKPDINIVSNASCTTNCLAPLAKVLNDRFGIIEGLMTTVHSITATQKTVDGPSMKDWRGGRAASFNXIPSSTGAAKAVGKVLPQLNGKLTGMAFRVPTVDVSVVDLTVRLEKKASYEQIKAAIKEESEGKMKGILGYTEDDVVSTDFIGDKRSSIFDAKAGIALNDNFVKVVSWYDNEWGYSSXVIDLIRHIASV

SEQ ID NO: 2198 - protein, 500 aa, Streptococcus pyogenes MGAS10394
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGSGGTNTMRVRTVK

SEQ ID NO: 2199 - protein, 385 aa, Thermus thermophilus HB27
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALAKLAVEHDFYLVSDEIYEHLLYEGEHFSPGRVAPEHTLTVNGAAKAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLERA

SEQ ID NO: 2200 - protein, 526 aa, Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 2201 - protein, 383 aa, Listeria innocua
MMNNSKIAKKHQQMPVNILADIGTLAKTMPDILDLSIGDPDLITDASIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDGFAINVDILEAAITNKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPSPSQRAAIYALNHSETLIPLVTETFQKRLEYIAKRVAEIPYLSLHPLKGSIYAFINISKTKMDSVSFTEYVLKETQVLVIPGLAFGESGDNYVRLAATQDISVLEEAFNRLAKLTF

SEQ ID NO: 2202 - protein, 83 aa, Thermosynechococcus elongatus BP-1
MVTPEQLTTLIQSRLPDAFVQVQDLTGGGDHYEAVVVSAAFEGKRLVQQHQLVYSSLKDLMASNELHALALKTYTPEQWAQRQ

SEQ ID NO: 2203 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLCHPNVVLFMGAVTRPPNLSIISEFLPRGSLYRILHRPNCQIDEKQRIKMALDVARGMNCLHASTPTIVHRDLKSPNLLVDNNWNVKVCDFGLSRLKHNTFLSSKSTAGTPEWMAPEVLRNEPSNEKCDVYSFGVILWELATLRLPWSGMNPMQVVGAVGFQNGRLEIPKELDPLVARIIWECWQQDPNLRPSFAQLTVALKPLQRLVIPSHQDQVASPLPQEISVNSTP

SEQ ID NO: 2204 - protein, 630 aa, Zea mays
MSPFQGYRGDAVLSGVRSRKRVFATAAAEPVTAAPKRQKRGDEMPLDALPDECLFEILRRVPGGRGRGASACVSRRWLALLGSIRASELGQAAAAAAGTPSLPDLNEEFVMEEDNEESPADRCVDRVLEGKEATDVRLAAMAVVAGSCGGLEKLAVRGSHPTRGVTDQGLSAVARGSPNLSSLALWDVPLITDAGLAEIAAGCPSLERLDICRCPLITDKGLVAVAQGCPNLVSLTIEACPGVANEGLRAIGRSCVKLQAVNIKNCPLVGDQGISSLVCSATAALTKIRLQGLNITDASLAVIGYYGKAITDLTLTRLAAVGERGFWVMANAAGLQNLRCMSVTSCPGVTDLALASIAKFCPNLKQLYLRKCGYVSDAGLKAFTESAKVFENLHLEECNRVSLVGILAFLNCREKFRALSLVKCMGIKDICSVPQLPFCRSLRFLTIKDCPGFTDASLAVVGMICPQLEQVDLSGLGEVTDNGLLPLIQSSESGLIKVDLSGCKNITDVAVSSLVKRHGKSLKKVSLEGCSKITDASLFTMSESCTELAELDLSNCMVSDYGVAMLASARHLKLRVLSLSGCSKVTQKSVPFLGNLGQSLEGLNLQFCNMIGNHNIASLEKKLWWCDILA

SEQ ID NO: 2205 - protein, 436 aa, Lactobacillus johnsonii NCC 533
MKRQISFGQALATVVGTVIGGGVFFKIGSISHETGTSSLTLFVWILAGIVSIASGLTVSEIAAALPVTGGSIKYIEYTYGKVWGFLFGWAQMLVYFPANIAALSVIFGQQFVVLFNLPAKYATLIGLLLAIFLMGLNFISTKFSTRMQSVMTILKAIPIALIVLFGLFNSSKVDINLFPLSAGHNTSFWTGLSGGLLAALFAYDGWINVTNLAGEIEKPEKNLSRAIIIGLSAITLIYVLVNYAFLTAIPFKEIVGNQNTAYLASLKLFGSLGGKLVTIGILISVYGAINGFMLTGMRIPYTLAKNKMLPFSDKISRTNVNTGVPTLSALIILVVSLIMILLGTFDLLTNMLVFVMWTFTTLISIAVVILRYREPKLERPYVVPWYPIVPIISIGGGLFIVISTVINEFWLSITGIGLTLLGLPIYYYMKKQNNRQ

SEQ ID NO: 2206 - protein, 414 aa, Oryza sativa (japonica cultivar-group)
MRRYDEMPPAMVLVPPPFTFPAAAARTRMAVPAYEVMFGKLQRRSLFDDYFDQVGSITSGMIMLRPLVDSHVDLTAKMTTTGGEALFRWQRYLDDPNTFMDLHLSTPKPMVQLRSCAYYPKYRIGAFGTFPLLKANRDCSEGDYGIMGLRYGSENLSIGASFLPFALSGQVPYGAWLVGRKGNISAGIQYKPLCESMHPVPLTDLKNWNCAISYGMGSTSPLSPSFNFSLELVRNTQLVASFYQHFVVQRRVMNPREEEHIIGTTNFVDFGLELATSLDKDKAKENASNPSFQVAASWQASKNFLVKGKLGPSKSSMALAMKSWWRPFFTFSFTAMYDHLKGTGSYGFGISIEDLKEPSYQMAYSNYVIVTQNKEDVEPRFLKKLGKKYIFQPDIDSGNYDNLPTGLKPIDKIL

SEQ ID NO: 2207 - protein, 138 aa, Exiguobacterium sibiricum 255-15
MEQTFLMVKPDGVERGLIGEIIARIERKGFVIREMKMMQVTEELAQAHYAEHAEKPFFGELVTFLTSGPVVALRVEGEDVVTVSRMMIGKTKPTEALPGTIRGDFANTMSENVIHGSDSVESAERELGLWFQGQPLNV

SEQ ID NO: 2208 - protein, 816 aa, Arabidopsis thaliana
MGETGDDAGPSEQGPSNQTWWPSEFVEKFGSVYLGSQEETSSTKDSPRNLGQDGLPSSTASNILWSTGSLSEPIPNGFYSVIPDNRLKQLFNNIPTLEDLHALGDEGLKADVILVDFQKDKKLFRQKQLITKLVSGLNSKPATIIKKIAGLVADVYKQSTLQSPAKSTQSFENCGIQLLGQIKHGSCRPRAILFKVLADTVGLQSRLVVGLPSDGAAESVDSYSHISVTVLLNSVEMLVDLMRFPGQLIPLSTKAIFMSHISAAGESDSAENDSCDSPLEPNSPMFGYPEKFDHENAEKDENLSLHRKLDGSPNTSGPPSRNMLLRSASALERKLSFSQSESNMANEFWRQSRRKVIADQRTASSSPEHLSFRARTKSMLSGDKNLARDFTGDVATSSCKSVGGAKMETKRIRRRSISITPEIGDDIVRAVRAMNEALKQNRLSKEQGDDDSSPNSPNDRTESSHLQKNVSGFHLDAHDQVSGGRSTLSREPLDPQKAISLPSSPQNYRSQYEQSGSSHRNISHIWDKVLGSPMFQNKPLLPYEEWNIDFSELTVGTRVGIGFFGEVFRGIWNGTDVAIKVFLEQDLTAENMEDFCNEISILSICFHQCMHLRLLVVILFLGACTKPPRLSLITEYMEMGSLYYLLHLSGQKKRLSWRRKLKMLRDICRGLMCIHRMGIVHRDIKSANCLLSNKWTVKICDFGLSRIMTGTTMRDTVSAGTPEWMAPELIRNEPFSEKCDIFSLGVIMWELCTLTRPWEGVPPERVVYAIAYEGARLEIPEGPLGKLIADCWTEPGQRPSCNEILSRLLDCEYSLC

SEQ ID NO: 2209 - protein, 320 aa, Vibrio angustum S14
MKDHTVRLALIKLLSDGEFHSGEILGQTLGMTRAAIAKQIQVIQQWGLDIFRVQGKGYCLASAIDLLDQPQILAKVKCPHLDLIPVIDSTNQYLLDRVGQLPSGSVCLAEYQEAGRGRRGRQWVSPFGSNLYLSIYWRLEAGMAAAMGLSLVVGVAIAETLQKLGADDVRVKWPNDIYYQDKKLAGILVEMTGQAGDAAHLVIGMGLNINMPLTEQSEITQAWTTLSQACDSLPSRNILAATLISHLNQTLCDYEHQGLVGFVERWNKIDNFLNRPVKLLIGERTIEGTARGIDAQGALLLETDTGITPYIGGEISLRGC

SEQ ID NO: 2210 - protein, 259 aa, Oryza sativa (japonica cultivar-group)
MEVATATEASAPAASRRSHPFPWLDLAISEPYYFLHLVAFFSYFAARSTVPSADDGLLLRRAVLTFLVLFVVKIVKEENWETCIADSLLYAKGLLLAVTLVIDYWLTVSYLLGFVVIYAVAQQPPYDGLGHSNHLTPLQLEGLLTEEPTTRFWLVEFRTSFSGTCIEASSVLPELSNIYSNKNISFGIIDLGHFPNAAAKFGISMWDHLPTYILFDKATEVARFPEIMNESKVFVPKITKKLLCQHFDLDRRLIEYLSR

SEQ ID NO: 2211 - protein, 194 aa, Brassica rapa
KIPLYASNFARSSSGSSKSWITGLLALPAAAYMVQEQEVLAAEMERTFIAIKPDGVQRGLISEIVARFERKGFKLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 2212 - protein, 591 aa, Arabidopsis thaliana
MDPGDPTSILFTKIRTLEPDFASKIIGYLLLQDLGKTDLMRLALGPETLLQSVCLKAKSALGLSSNGSSSASSPLNPISRPINIHRHSLSHSSPGNGFSRNPLSPSFATPGSLGSNPNMISSPFQASSSLFASDGAAAGDSTGNGDFLDEQQLGNYLSFLNESSSKNNDESLDPFGFSADNGDAHLHKRSFSASDACFGSEEPGFGGGGYNRFLHGGLGDDFDSPGGFGSPDYVSRQQEEIVRMKMAQRQRMAAAQYLAATGSPMSYEKGLNFLLHQRNAHRSGAGQFGEEGYWFGSPGRHERDEFMGMGDKSNSASKQIYLTFPADSSFTDEDVSNYFGNFGPVQDVRIPYQQKRMFGFVTFLHSETVRIILARGNPHFICDSRVLVKPYKEKGRILEKRQQQQLLQQMERGNFSPGSSPSGMDSRDLFDSHLAPRMFSNTQEMMRRKAEQADLQQAIEFQRRRFLSLQLPDMDSESFLHHQRSLSIGSPVHFSPRVNQSMLFRSESTSDEVFEGNGDSGHQSEATRAFLSDTGHNISQERGYNSHLNKGQETSLENTLPDSFFASPSKTGSIEAERKREKVGTLSQTET

SEQ ID NO: 2213 - protein, 232 aa, Triticum aestivum
MITPRYFCDTIEYSSYASNALGALPYGRPAGGRTSDSSGRPGRYGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRSRSDIQTPGLANVAATVMNLHGFQAPADYETTLIEVVD

SEQ ID NO: 2214 - protein, 505 aa, Burkholderia vietnamiensis G4
MSAFTETAHDETGSVDPDRGDAVRAKVRVAPVVLAGGSGARLWPMSREQYPKQLIGVLGADSLLQATVQRMTGFTAGESEVSAPIVVCGDEHRFVTAEQLRASGLAASIVVEPARRDTAPALTLAAAVAHADGQDAIVVAMPADHAIADTPAFHRAIALAVEHARRGAIATLGVPPTRPDTGFGYIKLGEALDGGAHRIERFVEKPAAELAAQYVESRAYWWNSGIFVVRASVWLDTLRALQPDMHAACLTAYVQGKTDGPFFRPHEQAFLQSPADSIDYAVMERLASTAVGAEGVVVPLDAGWSDLGSWDAVWEALDKDADGNVGRGKVVFEGATSSFVHSEGRLVACVGVTNAVVVETADAVLVADRSHVQDVKGLVSRIRAQQAPEADAHRKVRRPWGYYDSIDHGARFQVKRIVVHPGGRLSLQLHHHRAEHWIVVSGTALVTRGDEQFMLGENQSTFIPLGVTHRLENPGKLPLELIEVQSGSYLGEDDIVRFDDTYGRA

SEQ ID NO: 2215 - protein, 355 aa, Helicobacter hepaticus ATCC 51449
MYHKRIKEAIEAIKQGEMIIIMDDEDRENEGDLVMAGIFSSPQKINFMAQEARGLICVSITQELAQKLDLPPMVQKNDSNHETAFTISIDAKEAKTGISAFERDMTIRLMCESNTKPSDFVRPGHIFPLIAKEGGVLVRTGHTEASVDICRLAGVAPISVICEIMKKDGTMAGRGDKFLLDFASQHHLKILYVSDIIQYRLNFENLLREITRESAVFMGVECEKITFIDHLEREHIVFGFPHKGSSSNEPKPLIRFHNVRSDLELLQNAQEWNALLKSIECLKEKGGYLVFLNTHSEYANSSKTCGDIKDFGIGAQILKRLGIEDFVLLSSCGGSKGEYNALSGFNLHLVEKIEV

SEQ ID NO: 2216 - protein, 252 aa, Lactobacillus plantarum WCFS1
MRTPIIAGNWKMNKTASEALAFVNAVKDQLPDPSKVESVVAAPALFLQEMVEAAKGSDLKIAAENAYFEDAGAFTGETSPAALADLGVDYVVIGHSERRGYFHETDEDINKKAHAIFKNGMKPIICCGESLEQREAGEAESWVSGQIKAALKDLSADQVSSLVIAYEPIWAIGTGKTATSDQAEEICAVVRKTVADLYSQEVADKVRIQYGGSVKPANVNELMGKDDIDGGLVGGASLQPDSFLELVNYQNN

SEQ ID NO: 2217 - protein, 272 aa, Dechloromonas aromatica RCB
MSAQVATRRLTQADLAKLYQAGEKIAQFTCYDASFARLLDGAGVDSILIGDSLGNVIQGHDTTLPVTVADIAYHTAAVKRGCDRAFIVADMPFGSYQESPEQAFRNAATLMAAGAQMVKLEGGADMAPTVRFMVSRGIPVCGHIGLTPQSVHVLGGYKVQGKGEAAAQRLKDDAMALKAAGATMLLLEAIPATLAAEVTAMTGVITIGIGAGKDCSGQVMVLHDAFDIPPGKKAKFVKNFMEGASSIHDAACRAIAAVKDGSYPGPEHTYSA

SEQ ID NO: 2218 - protein, 395 aa, Arabidopsis thaliana
MEALFTSTHTPNLQTKPLLKSPLPTSSQSSCWFCNSLPKTQFPKLRLSNGSSHGLRIQALLRNETPSEGEDNNGFGFFPGDIFSLSQEKLGSNSNGETSHSVIDVEASLAHPQGGGGNRAGLFRTPISGGVQNATSAHALPRPALAVRNLLEQARFAHLCTVMSKMHHRREGYPFGSLVDFAPDRMGHPIFLFSPLAIHTRNLLNEPRCSLVVQIPGWSGLSNARVTLFGDVYPLSEDEQNAEHKVCSKTCAFQVTNTCRMIVCLLLLIHSTLNVTIGSDIYFIGGFGTVAWVDVKEYEGLQPDKIAVDGGERNLKELNAIFSKPLRELLSTESEVDDAALISIDSKGIDVRVRQGAQFNIQRLAFEEGHGVETLEEAKSALWKVLEKVKLNLQK

SEQ ID NO: 2219 - protein, 408 aa, Bordetella bronchiseptica RB50
MELLTILLIAAVLCVPLAQRLGLGAIPGYLLAGGVIGPSGLGLVTDVPDIMRVSEWGVVMMLFVIGLELAPKRLWAMRREVFGAGTLQMVVCGALLGAVFGAGLRHLAGMGWQAAILCGLSLALSSTAVALRLLEERGLVRTPLGRSALGVLLLQDMAAIPMLVAAGLLGSDGDSAPSFEAALVAVVVVLACYRLRLLDWAARSQLHELFTAATLLVVLGTAQLFDYAGLSAGLGGFLVGMLLAESRHRNELEHTIEPFKGLLLGLFFLAVGMSVNVEEALDYWPYVLAGVVALLSLKALVLYGIARLMGLPHYHRLLYALVLAQGGEFSFVIFNEAWDNHLMSLEQRDLLAIVVAISMGAVPIVIRLLERLPGRYGGIGDMAVTPVGFAGSPPPQSAADNEERSGPG

SEQ ID NO: 2220 - protein, 320 aa, Robiginitalea biformata HTCC2501
MMRILANDGLAEPAIAKLESAGFEVLTTKVAQEQLIPYLNKENIRALLVRSATQVNEELIDACPGLLLIGRAGVGLDNIAVAHARKKGLHVIHTPNASANSVAELVFAHLLGGTRFLHESNRHMPLEGDQQFRALKKAYAAGREVRGKTLGIIGFGGIGEAVARIGLGLGMEVCFHDTHRDRAVMTLEFAGGQQYDLEIQGFGLDELLSRSDFVTLHVPAQDRPVIGSRELGLMPRGAGLINTSRGGVIDEEALLAALDSGHLSFAGLDVFAEEPRPGVRLLMNPDLSLSPHIGGSTLEAQERIGLELAGQVVELLKKAD

SEQ ID NO: 2221 - protein, 322 aa, Spinacia oleracea
MAVVSTSLASQITNPNSAVSTQFSGLRRSFLKLENSVSTQSSFFQNVDSHLRLSSSSRRCPRGVVAMAGSGKFFVGGNWKCNGTKESITKLVSDLNSATLEADVDVVVAPPFVYIDQVKSSLTGRVEISAQNCWIGKGGAFTGEISVEQLKDLGCQWVILGHSERRHVIGEQNEFIGKKAAYALNQGVGVIACIGELLEEREAGKTFDVCYQQLKAFADALPSWDNVVVAYEPVWAIGTGKVASPDQAQEVHVAVRDWLKKNVSEEVASKTRIIYGGSVNGGNCAELAKQEDIDGFLVGGASLKGPEFATIVNSVTAKKVAA

SEQ ID NO: 2222 - protein, 358 aa, Arabidopsis thaliana
  misc_feature (291)..(291): Xaa can be any naturally occurring amino acid
  unsure (1)..(358): unsure at all Xaa locations
MKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGXRLEQVLERLEWMEKKGVVVFTICVGFGTIAVVAVVFGMGIVRAEKQGGLAWLLLLISSTFVMFILSL

SEQ ID NO: 2223 - protein, 819 aa, Haemophilus influenzae R2846
MDNFDSPFQYNRPEMTVEAIKKSIVYKLIFLIGRSPREASQRDWLNATLHAVRDLVTEGWITTARQTRSEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNNFIRRVSLIEEGYQRKVRMGWLSVVGSHKINGVAEIHSDLMVTSTFADFARIFPERFTNVTNGITPRRWLAVANPQLADLFDKYIGSEWRCDLSQIAKLKPFAQEKAFKEAVADIKFANKVKLAEYVKRELGVELDPHALFDVQVKRIHEYKRQMLNVLHIIARYNEMLANPEKDWQPRVFILAGKAASAYYAAKQTLHLINDVANVINNDERLKDRLKVVFIPNYSVSLAQLIIPAADISEQISLAGTEASGTSNMKFALNGALTLGTLDGANVEILENVGEDNIFIFGNTVEQVEQLRRDGYRSFEYYQNDAQLRTVVDQIIEGKFSPEDPQRYHQLLQGLQYHDYYQAFADFRSYVETQKAVDEKYKQRDQWIASTIQNIVNMGFFSSDRTIKEYAERIWKVEPVQLGD

SEQ ID NO: 2224 - protein, 250 aa, Gracilaria gracilis
NWKCNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 2225 - protein, 119 aa, Prunus avium
KMPSNCNGTQLNFTKVSPQLRSILKTSWPDVESGNDTKFWEGEWNKHGTCSEQTLNQMQYFQRSFAMWRSYNITNILKNASIVPSATQTWTYSDIVSPIKAITQTTPLLGAKRDLSTEP

SEQ ID NO: 2226 - protein, 620 aa, Escherichia coli O157:H7 EDL933
  misc_feature (143)..(143): Xaa can be any naturally occurring amino acid
  unsure (1)..(620): unsure at all Xaa locations
MDSHTLVQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTXMGRSAFAVLLFQDIAAIPLVAMIPLLAASSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYICLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 2227 - protein, 330 aa, Listeria monocytogenes str. 4b H7858
MELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 2228 - protein, 296 aa, Arabidopsis thaliana
  misc_feature (30)..(30): Xaa can be any naturally occurring amino acid
  misc_feature (43)..(43): Xaa can be any naturally occurring amino acid
  misc_feature (164)..(164): Xaa can be any naturally occurring amino acid
  misc_feature (240)..(240): Xaa can be any naturally occurring amino acid
  unsure (1)..(296): unsure at all Xaa locations
KANSSEAITILYQVLADPSSSPEAIRIKEXAITNLCDRLSEEXSRGEALRQLLPQLRPFFSLIPQAKNAKNVRGILDAVAKIPGKNDLQITLCQEMVAWPRAEKRTFLRQRVEARLAALLMEKKEYVEALALLSPLVKEVRRFIVQLLLVDIDLLVCQLHFSFXCNFPQAKAALTAARSTAYAISVPPAPPGPIDLPSGILPAEEQAFKTGYRSFFDAFESFHALGAPRAVFRLPTMFLXPLMVSPAADVAGIISSKAGLPSVGPALVAMKTVAVARSTGPLTLFATALRGFQHSL

SEQ ID NO: 2229 - protein, 383 aa, Saccharomyces cerevisiae
MSETELRKRQAQFTRELHGDDIGKKTGLSALMSKNNSAQKEAVQKYLRNWDGRTDKDAEERRLEDYNEATHSYYNVVTDFYEYGWGSSFHFSRFYKGESFAASIARHEHYLAYKAGIQRGDLVLDVGCGVGGPAREIARFTGCNVIGLNNNDYQIAKAKYYAKKYNLSDQMDFVKGDFMKMDFEENTFDKVYAIEATCHAPKLEGVYSEIYKVLKPGGTFAVYEWVMTDKYDENNPEHRKIAYEIELGDGIPKMFHVDVARKALKNCGFEVLVSEDLADNDDEIPWYYPLTGEWKYVQNLANLATFFRTSYLGRQFTTAMVTVMEKLGLAPEGSKEVTAALENAAVGLVAGGKSKLFTPMMLFVARKPENAETPSQTSQEATQ

SEQ ID NO: 2230 - protein, 242 aa, Mycoplasma flocculare
MKKIIIGNWKMNKTVHETRDFIQKFDIFYSKNLGKIKDNLDFAIAPSFTSLALISTSKIDKLKVAAQNLSQFDSGAFTGEISAKMLQDLAVHYVIIGHSERREIFKEIGEDLTNKILQAQKYNLIPVFCVGESLSEFEANETEKVIIGQINEVKSVLNFEKAIIAYEPIWAIGTGKTATAQIAEQVCKLIKNNFGKNIRVIYGGSVNSKNINELLLQKNIDGALVGKASLDPEEFVKILANI

SEQ ID NO: 2231 - protein, 160 aa, Brassica napus
MGGRTTMKCVLLDESVLLDHDDEDSTPRVRGSVSLILRLLRYSMIRTGISYGLDLPENKVDLLRKTAVEYSIDCLPLETSLTSVAFGDALKAWYSDGDILYIASTRKEETLRELSPSQLVVVVLEGDSCEDPNMLCISRLEELPMTICCMNKKAMGDGAA

SEQ ID NO: 2232 - protein, 150 aa, Mycoplasma pirum
MKKRIIIGNWKTNKTQKEVKEFFKILNASLKNKNICCTFGVAPVAIHLELAKSLAPKQMIIAAQDANYISSGAFTGTISWSQLKDIKIKYVIVGHSERRMYYNETDDIVNKKVKNLLENKMIPILCIGGNIEEFNNKKTYQVCATQLKKA

SEQ ID NO: 2233 - protein, 273 aa, Escherichia coli O157:H7 EDL933
MNNRVHQGHLARKRFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENAPFQES

SEQ ID NO: 2234 - protein, 478 aa, Legionella pneumophila str. Lens
MTTPLYPIILAGGSGTRLWPLSRQNFPKQFLKLNGELSLIQQTMKRAMGLPGNQTIIVSNDAHYFICQDQLQDFNAQTTYLLEPCARNTAPAIACAAHYLANTVGKDAVMLVLPSDHWIADDEIWLAAMLEGGQFASENNAIVTFGIKPDSPKTGYGYIEAGTTLSSDIKQVLSFREKPDAHTAAQFVSKGNYFWNSGMFICRAGVYLEELEQFETDIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 2235 - protein, 161 aa, Musa balbisiana
SSMMVSSAATVSRASPAQSSMVAPFTGLKSTSAFPITRKANADLSHLPSNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 2236 - protein, 279 aa, Streptococcus pyogenes MGAS315
MVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAISNPDTTSF

SEQ ID NO: 2237 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSSMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 2238 - protein, 103 aa, Brassica napus
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (34)..(34): Xaa can be any naturally occurring amino acid
  misc_feature (39)..(39): Xaa can be any naturally occurring amino acid
  misc_feature (49)..(49): Xaa can be any naturally occurring amino acid
  misc_feature (54)..(54): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (74)..(74): Xaa can be any naturally occurring amino acid
  unsure (1)..(103): unsure at all Xaa locations
MASSMLSSAAVXTSXPAQVTMXAPFTGLXKTSAXFPVTXKANNDITSIXSNGGXVSCXKVXPPVGKKKXETPPXPPLTTRSLNCVEAHYLPLIFAISATPLSR

SEQ ID NO: 2239 - protein, 175 aa, Triticum aestivum
  misc_feature (27)..(27): Xaa can be any naturally occurring amino acid
  unsure (1)..(175): unsure at all Xaa locations
MAPTVMASSATSVAPFQGLKSTAGLPXSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 2240 - protein, 117 aa, Prunus avium
TMPSTCTGARFNFTKVYPQLRKDLKKSWPDVESGNDTKFWEGEWNKHGTCSEQTLNQMQYFERSHAMWTSFNITKILKNASIVPHPTQTWTYSDIVSPIKAATGRTPLLRCKGDSKT

SEQ ID NO: 2241 - protein, 492 aa, Gluconacetobacter xylinus
MTFMTATDVTVSTPEPRNRTITPVILSGGTGTRLWPVSRASHPKQFWALASSRTMIGETLQRATGTAFAPPIVVCNNAHRFLVAEQLRENGCEDGRIILEPAVRNTAAAIAAAALLAAQDDPETLLWIMAADAVFRYPERLPAVLEKAMTVAREGYIVTFGMKPDVPETGYGYIRLGAPLHSGDADDNVYRVARFIEKPDRLRATEMLNEGGYLWNSGMFLAPASVILAELKRHEPDVLENVRHALLHSESDLTFRRLETASFMRCPNVSIDYAVMERTDRAVVIPADLGWSDVGNWNALWELGDKDAAGNVVVGDVVLEQSHNCYVRSEGMLTAVAGLTDIVLVVTSDAVLAIHRDYAQDVSALVSQLKMARRTEAEIHNRCYRPWGFYEGLIQGERFQVKRIVVYPGQKLSLQKHFHRAEHWVVVSGTAIVTRNEEKLMLQENESVYLPLGCMHRLENPGRIPLTLIEVQSGPYLGEDDIVRFEDTYGRQ

SEQ ID NO: 2242 - protein, 161 aa, Musa balbisiana
SSMMVSSAATVSRASPAQSSMVAPFTGLKSTSAFPITRKANADLSHLPSNGGRVQCMKVWPIEGKKRFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 2243 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSRWIPCLEFSHEGFVWRENHRSPGYYDGRYWTMWKLPMFGCTDAVQVVKELEECKKEYPKAFIRIIGFDN

SEQ ID NO: 2244 - protein, 136 aa, Mycobacterium tuberculosis CDC1551
MTERTLVLIKPDGIERQLIGEIISRIERKGLTIAALQLRTVSAELASQHYAEHEGKPFFGSLLEFITSGPVVAAIVEGTRAIAAVRQLAGGTDPVQAAAPGTIRGDFALETQFNLVHGSDSAESAQREIALWFPGA

SEQ ID NO: 2245 - protein, 161 aa, Musa balbisiana
SSMMVSSAATFTRVSPAQSSMVAPFTGLKSASAFPVTRKPNADLSHLPSNGGRVQCMKVWPIEGLKKFETLSYLPTLKDEALLKQIEYLLRSKWIPCLEFCPKGFVWRENHRSPGYYDGRYWTMWKLPMFGCTDAVQVAKELEECKKEYPDAFIRIIGFDN

SEQ ID NO: 2246 - protein, 139 aa, Brassica napus
  misc_feature (128)..(128): Xaa can be any naturally occurring amino acid
  unsure (1)..(139): unsure at all Xaa locations
GWASPPGDVFSVRSADYFTNKQKCPGGDYLLSAAGVDWLKSSTKLDNILARPDNRVSHALRKAQSLGRSQNGFIFAVNFHIPGKEHHHSEHYFATEEPIPSDFLLKRFIDGDHSFRNESVKIVSPAAXGPLIVKAVEGN

SEQ ID NO: 2247 - protein, 168 aa, Oryza sativa (indica cultivar-group)
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 2248 - protein, 394 aa, Rickettsia akari str. Hartford
MDTMTNNTKTITLNLGPQHPATHGVLRLILEMDGEIVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYERVSGSRMHSNYFRPGGVAEDLPDGLLEDIDKFIDQFPPKLHDIESLLNENRLWKQRLVDIGVVSQKEAMDWGFSGPMLRGSGIAWDLRKSNPYDVYDEMEFEVPIGKNGDCYDRYFVRMLEMYESIKIIKQCIEKMPKGAVKTNDPKLTPPTRAKMKESMEAMIHHFKLYTAGYDVPAGETYKAVEAPKGEFGVYLYSQGVNIPYRCRIKSPGFAHLQGLDFMSKGHLMADVITIIATLDIVFGEIDR

SEQ ID NO: 2249 - protein, 457 aa, Rhodococcus sp. DK17
MSYYATTSPLTGQRVQEFPRATDHEISDALTSSDAAYRQWRTSSLEERADVLRALAKLWHERADELAPILTLEMGKPIPQARGEVALCANIFEYYAEHGPTFMEDEVLEIAGGGEAIVRTEPIGPLVGIMPWNFPYYQVVRFAAPNIMLGNTLLLKHSRNCPQSALAIETLFVEAGLPEGVYVNVFADNAQVARMVADPRVRGVSLTGSERAGSAVGEIAGRHMKKFVLELGGSDPFIVLDDTDLDTTVAAAVNNRMANAGQACTASKRLIVLDDVYDRFLDKFTEAMRNIVPGDPTDPATTFGPLSSRSCVDEIAEQVDDALAKGAKLLTGGCRGEGPGAFYEATVLAGVTPQMRVYSEELFGPVAVVYKVATEAEAIALANESPFGLAAAIFTSDRNQARRVAEDLEVGMAWINGTSKSAPDLPFGGVKRSGVGRELGRYGFNEFANKKLVRTVR

SEQ ID NO: 2250 - protein, 554 aa, Clostridium perfringens str. 13
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYNIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYNDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 2251 - protein, 358 aa, Arabidopsis thaliana
MSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGGRFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYRY

SEQ ID NO: 2252 - protein, 358 aa, Zea mays
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 2253 - protein, 470 aa, Desulfovibrio desulfuricans G20
MRTKIIATVGPASSGRETLSRLIQAGVRIFRLNFSHGDASQFVDLIALMRQLEAEYQTPITLLQDLSGPKIRIGELPDGALTLAKDDRILLGIPGKAAADGLPFVPFTHKTILDGMEPGDRVVLSDGGLQFHVESKVGPDLFCLVANNSGIITSRKGLALPGKPIHLAALTEKDKKDLQDGLRMGVDAVALSFVQTPEDVAEAKALIKAAGRNVPVIAKLERRNAVDRLEEILEVTDIVMVARGDLGVECPLPELPAMQKRIIRACNRKAKPVIVATQMLLSMVNSPSPTRAETTDVANAVLDGADCVMLSEETAMGNFPVETVQFMRQIVRAAEELHLEQSSVLPPLDEQKTPDFLAYSACLLADKTCAGAIVAHSMSGSAARVLSARRPRQTIHALTPDDEALRFLNFSWGVWPHKVDETLPGHLERAELFVDNAPQFEDGAEVVITAGQPKPGEKPRGTNLVKIYRK

SEQ ID NO: 2254 - protein, 112 aa, Triticum aestivum
ASDATFLTLLVLGAVVMGAAADGPPATYLFFVDPTPPGVTCMQYHLGILTAALGSEEKAKAAIIYNYKNVVSGFSARVTPAELEAIKKQPHVNRALPSATLQLMSSNFDGVS

SEQ ID NO: 2255 - protein, 583 aa, Bacillus sp.
MFLEAVYHRPRKNFSYAYNGTTVHLRIRTKKDDMTAVYALAGDKYMWDHTMEYVPMTKLATDELFDYWECEVTPPYRRVKYGFLLQQGHEKRWMTEYDFLTEPPANPDRLFEYPFINPVDVFQPPAWVKDAIFYQIFPERFANGDTRNDPEGTLPWGSADPTPSCFFGGDLQGVIDHLDHLSKLGVNAVYFTPLFKATTNHKYDTEDYFQIDPQFGDKDTLKKLVDLCHERGIRVLLDAVFNHSGRTFPPFVDVLKNGEKSKYKDWFHIRSLPLEVVDGIPTYDTFAFEPLMPKLNTEHPDVKEYLLKAAEYWIRETGIDGWRLDVANEVSHQFWREFRRVVKQANPDAYILGEVWHESSIWLEGDQFDAVMNYPFTNAVLDFFIHQIADAEKFSFMLGKQLAGYPRQASEVMFNLLDSHDTARLLTQADGDKRKMKLAVLFQFTYFGTPCIYYGDEVGLDGGHDPGCRKCMEWDETKHDKDLFAFYQTVIRLRQAHAALRTGTFKFLTAEKNSRQIAYLREDDQDTILVVMNNDKAGHTLTLPVRHAQWTHLWQDDVLTAAHGQLTVKLPAYGFAVLKASSD

SEQ ID NO: 2256 - protein, 287 aa, Mesorhizobium sp. BNC1
MHDRKTILKRLRSTIADGKAIVGAGAGTGLSGKCAEAGGVDLIIIYNSGRYRMAGRGSLAGLMPYGDANAIVMDMAREVLTIVKDTPVLAGVCGTDPFRLMPIFLRQVADAGFAGVQNFPTVGLIDGTFRENLEGTGMGFGLEVEMIARAHELDLLTCPYVFDPEQARQMAAVGADIIVAHMGLTTSGTIGASVAMSLEDAVARVQEIRDAAAEVRNDIIVLCHGGPIAMPADAEFVLSRTKGVAGFFGASSLERLPTETAMTETARAFKAVGHAARQPASEDGNLK

SEQ ID NO: 2257 - protein, 410 aa, Mesorhizobium sp. BNC1
MSTVVLMGTLDTKGAEYAFLRDEIEKQGIETLLVDTGILGDPSTRPDISRSVVAEAADADLAALIEAHDRGAAVSAMAKGAAALALRLYEEGKLDAIAGLGGTGGTALVTAAMRALPIGVPKLMVSTVASGDTRAYVGSTDITMMHSVVDIAGINKISRKILGNAAGAVAGMAGQPVTDAPSREAPLIAATMFGVTTPCVQKARELLERSGFEVLTFHATGTGGRSMEELTKAGMFSAVLDVTTTELADELVGGVFSAGPDRLTAAGAAGIPQIVSLGALDMVNFGAWETVPEKFRERNLYRHNASITLMRTTPQECLEIGRRLGSRLSQSKGPTVVFVPLKGISLIARAGQPFHDPEADNALLRGLRESLRADIEIREFNTDINDPSFAEAMVEALIEIMAEKKVNAHA

SEQ ID NO: 2258 - protein, 1182 aa, Aspergillus oryzae
MVFKPFTHLARQSFTKAFTHGYAQSVVAASQSSYASSATFNQLANQPAKVSRSALQNVFQPSSSSGAGAKASQGGSGSGDLGLAAYYAAWQHAQQTGDDSDWKQFQVKRKLGWKPSTPEEAAKSKEDSVNSTNPHNFDSPHITKASANADVSAQVEEAVAREIQIQEEQAQAEEASEGKDDSATEAFPDLPADVAAIADVSTEQARIASDQIVQLALTKKYAEIPSAFEALLRDGLTPTVGAYNALLESAVRLHGDTAQAIQKALDVYSDMLRRRVIPDEQTYRTLVQLFVERAHDALKSQKSLEQDRIRYGGMEEPGKFMLHSSELERAILDEDHSLGIAIKLFNTATTRHPDLIFPLDTYSRLIIACAREGQVENMIRIYAHMETHKVTPHASIFPSMIDAFASTGDLKSAVECYNEYKALAISDDNGTFSIVQRLDGQVYAALVKAYLSCGKEKEALRFLERIRASFDEVTENKETRKDAVETVIVRDGLVSHSLKSGEHDKALSQAKTRLRDGALDHAMAEICIAAADAGNLKTASEAYDCLPTDTAKRHGPAISMLALYVRQGNVSAARPLWVMLSTVGQTTPDMVQPTAMYSVALLKSGQIEEALVEARNMFGRVRNASIDNPYLLNAVREQINESLHLIGRVLIQTAAVLSPQTAVGKLFNSRPDMVRRWHDHLGLTSSPSSFLSDRHTPVSEMSTMTSAPSEDSFDPYAYATDFKGSAMIAEQLESTSGRPDSHLNDALTRLRNMRRSGRHPRYITYAKLITAAAKCHRNDLVHEILSMARRDVPLLHQYHAVKYGWVSILDAMVASCLTLNDRSLASKYHQELSELGSAPSANTFGLYITTLKESTKTFDEATEALKIFHRAVAEGVEPTSFLYNALIGKLGKARRIDDCLLYFAEMRAQGVRPTSVTYGTIVNALCRVSDERFAEEMFEEMESMPNYKPRPAPYNSMIQYFLNTKRDRSKVLAYYKRMLSRNIQPTMHTYKLLIDAHASLEPVDMKAAEKVLETIKAAGQQPEAVHYASLIHAHGCVMHDMKAAQDVFNSVVSNSKVRLQPCLYQALLEAMVANHQVAQTEDIVKDMVQRRVDMTAYIANTLIQGWATEGNVSKAKAIYDSIGVDKREPSTYEAMTRAFLMANERENASRIVQEMLSRGYPTAVASKIVDLVGGGAAVAAAL

SEQ ID NO: 2259 - protein, 234 aa, Triticum aestivum
  misc_feature (12)..(12): Xaa can be any naturally occurring amino acid
  misc_feature (25)..(25): Xaa can be any naturally occurring amino acid
  unsure (1)..(234): unsure at all Xaa locations
LGSPQQHISASXSNSEVNGTGKKEXIVGGARGNGKSTESLTEKNESGEINEDLDDGVSKELEGGHEQCNEAVRNQNSEEASSLVNEESIDAKAADCSEHTKTREEGSSISKNDVLAATACQFKNFVAIVDPPRAGLHPTVIKVLRTHPRIRRLVYISCNPDTLVANAIELCTPSTEHREKNKGHRGWRNMSSAGLARQRTKSMPNSEPFVPKRAMAVDLFPHTSHCEMVMLFER

SEQ ID NO: 2260 - protein, 243 aa, Xanthomonas campestris pv. vesicatoria str. 85-10
MSNTKIALVTGATRGIGLETVRQLATAGVHTLLAGRKRDDAVAAALKLQAEGLPVEAIQLDVNDDISIAAAVGTVEQRHGHLDILINNAGIMIEDMQRTPSQQSLEVWKRTFDTNLFAVVEVTKAFLPLLRRSLAGRIVNVSSILGSLTLHSQPGSPIYDFKIPAYDASKSALNSWTVHLAYELRDTAIKVNTVHPGYVKTDMNGGGGEIEVEQGAHSSVQMALLDAHGATGSFTHLGEVLPW

SEQ ID NO: 2261 - protein, 849 aa, Brassica napus
MKGVRNIYHHSYTSFLLLFLVMILIHPALSIYINTLSSTESLTISSNRTLVSPGDVFELGFFETNSRWYLGMWYKKLPFRTYVWVANRDNPLSNSIGTLKISGNNLVILGHSNKSVWSTNLTRGIDRSTVVAELLANGNFVMRDSNNNDASQFLWQSFDYPTDTLLPEMKLGNDLKTGLNRFLTSWRSSDDPSSGEFLYELETGRLPEFYLSKGIFPAYRSGPWNGIRFSGIPDDQKLSYLVYNFTENSEEVVYTFRMTNNSIYSKLTVSLSGYFERQTWNASLGMWNVSWSLPLPSQCDTYRRCGPYAYCDVSTSPICNCIQGFNPSNVQQWDQRSWSGGCIRRTRLSCSGDGFTRMENMELPETTMAIVDRSIGVKECKKRCLSDCNCTAFANADVQNGGTGCIIWAGELEDIRNYAADGQDLYVRLAAADLVKRRNANGQIISLTVGVSVLLLLIMFCLWKRKQKRANANATSIANRQRNQNLPMNGMVLSSKREFLEEKKIEELELPLIELETVVKATENFSNCNKLGQGGFGIVYKGRLLDGQEIAVKRLSKTSVQGTDEFMNEVTLIARLQHINLVQIIGCCIEADEKMLVYEYLENLSLDSYLFGKTRRSKLNWKERFDIINGVARGLLYLHQDSRFRIIHRDLKVSNILLDKNMTPKISDFGMARIFARDETEANTVKVVGTYGYMSPEYAMHEIFSEKSDVFSFGVIVLEIVSGKKNSYNLNYKNNLLSYAWSQWEEGRALEIIDPVIVDSLPSTFQPQEVLKCIQIGLLCVQELAEHRPTMSSVVWMLGSEAKEIPQPKQPGHCIGRSPYDLDPSSSSQCDDDESWTVNQYTCSLVDAR

SEQ ID NO: 2262 - protein, 175 aa, Arabidopsis thaliana
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (129)..(129): Xaa can be any naturally occurring amino acid
  misc_feature (134)..(134): Xaa can be any naturally occurring amino acid
  misc_feature (137)..(138): Xaa can be any naturally occurring amino acid
  misc_feature (143)..(143): Xaa can be any naturally occurring amino acid
  misc_feature (148)..(149): Xaa can be any naturally occurring amino acid
  misc_feature (157)..(157): Xaa can be any naturally occurring amino acid
  misc_feature (160)..(161): Xaa can be any naturally occurring amino acid
  misc_feature (164)..(164): Xaa can be any naturally occurring amino acid
  misc_feature (169)..(171): Xaa can be any naturally occurring amino acid
  unsure (1)..(175): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGILCTREARETIPXYLXMXGTWQIWXFPFFXMNXXRSKFXREVKXXKKGPLGPXLGXXGFXNPKGXXXVFFK

SEQ ID NO: 2263 - protein, 1074 aa, Oryza sativa
MAGTISRIRLENFMCHSSLHIELGQHVNFITGQNGSGKSAVLTALCIAFGSRAKSTQRAAALKDFIKTDCSYAAIIVDINNQGEDAFKPEAVVSLILPLPFIKNLRLVNQFEDGQEGCSDGEAGAPVKLMDVVFTGRKVAHRKDDLIEIIEHFNIDVENPCVIMSQDKSREFLHSGNNKDKFKFFFKATLLQHVNDLLLAIRELLDNADSVVQELEKSIKPAMMELDELQQKIKNMEHIEEIAHEIDNLKKKLAWSWVYDVDRQIEEQTVKLLKLKERIPACQEKIDGHAAMIVKLKEELTDKERNARSLVEKSREVTMMKEKLEDDIAQAVALKIELEREHVRGTNVLKNMNNRVKQLQKQIHDFREQYIQYTQDESSKAENDKCEIQKEINSLHSNVTRLKEEERGLHETQMGIVKSIQNMETEIVENRKKITQFKAHIRDLQQRQSDKVSTFGGQRVRNLLKSIERQERRFNIPPLGPIGVHVGGSQITLSQHEINAVPLVKLHILLAIECALGRLLDAFIVSCHRDSVILRECAKEVNYHNLQIIIYDFAKPRLNIPDHLLPSTTHPTVLSVIQSENPTVLNVLVDQGSAERTVLVRDYEVGRSVAFDNRIQNLKDVYTSDGYKMFSRGPVQTILPPHRKGNAGRLCTSLGEKIAEMESEIADMERIISQRTRDMKKPNDKREDIELKIKNLKRKRVEEERLLESKKVQLDDIRKTSADINRVTSSDTSELEAEMMQVEVDIEQKELLVQKTNLRLTKALQDENDRRACYKEFIDGVYREVGPSNVLEKEIERVKDKLQTAEQGKAYYEGIMETKVLPDIKIAEAEFEDLQKLQQESFKKASIICSESDVETLGGVAGSSPEQLSATINKLELRFHKESSRYTESIDDLRALHIKKKEKIEDKQQLYAGFRDKLNSCQKALDMRWKKFQRNAALLKRQLTWLFNEHLGKKGISGFINVDYKERLLSVELTMPQDSSRDTITDTRGLSGGERSFSTLCFTLALHGMTEAPFRAMDEFDVFMDAVSRKISLDTLVDFAVTQGSQWIFITPHDISMVQPGDRIKKQQMAAPRG

SEQ ID NO: 2264 - protein, 457 aa, Bacillus subtilis subsp. subtilis str. 168
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 2265 - protein, 848 aa, Rhodopseudomonas palustris CGA009
MVVVSSAWNGHLPVQSLPEKKSSQSAPLDELALAEIKSAILAKLTLAIGKEAAHATKHDWYKASALALRDRIVHRWLVSEKESYDAGRKRVYYLSLEFLIGRLFTDSLNNMGLLAQFDAALGDLGVGLNDLRKCEPDAALGNGGLGRLAACFMESMATLEIPAYGYGIRYDYGLFRQIINHGWQQEFPDEWLSFGNPWELQRPEVVYQVKFGGHVDQVTDAKGYTRAVWTPGETVQAIAYDTPIVGWRGEHVNALRLWSARAPDPLLIDVFNTGDYLGATAHEARAEAICKFLYPNDESPAGRELRLRQEYFFVSASLQDLIKRHLDSDGQIRNLAKKAAIQLNDTHPSLAVAELMRLLVDVHGLRWDDAWQITVATLSYTNHTLLPEALETWPLDLFQRTLPRHLEIIYRINEVHLGLAEARSPGDIEFRASVSLIDEKAGRRVRMGHLAFIGSHRVNGVSAMHSDLMKETVFHDLNFLYPGRITNKTNGITFRRWLTLANPGLTELVRSVAGDEVLDDPTRLERLEAFAGDSAFQQQFRSVKHRNKVALARLIGERNNIRIDPSALFDVQIKRIHEYKRQLLNVLETIALYQAIKDEPNRDWVPRVKIFAGKAAASYRYAKLIIKLINDVAEVVNNDASIGGKLKVVFLADYNVSLAEVIIPAADLSEQISTAGMEASGTGNMKLALNGALTIGTLDGANIEIRDLVGPKNIAIFGMEALEVVARRAQGLDATDVINRSPQLANAIRAIDSGVFSPDDRARFASVAHALRHLDHYMVSADFDSYYEAQRGIDARWRAGSAWTRAGILNVARMAWFSSDRTIREYAEEIWNVPTKPATQPSPARQAG

SEQ ID NO: 2266 - protein, 374 aa, Cryptococcus neoformans var. neoformans JEC21
MPDIKLKNQASLCASTRLFLAYTSIKPFDVAFHPKEPVVFSSLLTGQVCAWSYDDATGETSSSWSVRPSKRTARALSIEENGDEIWMGGKSGSLLCALTPPKVIQLSTRDGSMTRERDSAHECPINRVYCVNRNLVATGDDDGVIKLWDPRQADSIRTYSQHFDYISDFTYFDDKRQLVATSGDGHLSVIDIRSNKSTPLTVSEDQEDELLSIVPIKGGQKAIVGSGLGILSVWNRQMGWADSVDRIPGHPASIDAIVALTPDIIATGSEDGMIRVIQVLPHKFLGVVATHEEFPVERIRLDRNNKWLGSVSHDECLKLTDVEDLFEDSDEDDEMEEDEPDSDEEKSKKKKKDNGMKDMSRGQAENDGSFFADL

SEQ ID NO: 2267 - protein, 337 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 2268 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 2269 - protein, 255 aa, Robiginitalea biformata HTCC2501
MKITFLGTGTSQGIPVIGSDDPVCLSENPRDKRLRVSVMITYDDGYNCVVDCGPDFRQQMLANQVTRLDSILFTHEHADHTAGMDDIRPFFFRQGDIPIYAHPRVIASLQRRFDYIFTDENRYPGAPSVAVNTIEKGRAFRLGSHWVTPVEAWHNRLQVFGFRFGDFAYLTDVKSIEPEEAARLQGVRVLAVNALRLEPHHSHFNLEEALGFIESVGPERAYLTHISHRMGFHAEVESRLPDRVHLAHDNLTLTL

SEQ ID NO: 2270 - protein, 358 aa, Arabidopsis thaliana
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 2271 - protein, 380 aa, Arabidopsis thaliana
MSAILAAAIGGAVGALALIALFVFLLWFCVFRRKNLSRTSETGSSDPSTQEGRNVAIELSMREARRFEMEELAQATKSFTNKSLIGIGKFGGVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKEVSLTTVMGEGTPTVTLGSQLFKATK

SEQ ID NO: 2272 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 2273 - protein, 238 aa, Aspergillus phoenicis
TIDTCSSDSPLSCQTDNEASCCFNSPGGSLLQTQFWDYDPSDGPSDSWTIHGLWPDNCDGSYQEYCDDSREYSNITSILEAQDRTELLSYMKEYWPDYEGADEDESFWEHEWNKHGTCINTIDPSCYTDYYAQEEVGDFFQQVVDLFKTLDSYTALSDAGITPSEDATYKLSDIEDALAAIHDGYPPYVGCEDGALSQLYYYFNVKGSAIGGTYVASERLEDSNCKGSGIKYPPKSSS

SEQ ID NO: 2274 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 2275 - protein, 483 aa, Alkalilimnicola ehrlichei MLHE-1
MFESPLLSNLHGYIDGSWTPADSGERFPVHNPVNGDELGRVAAMGAEETRRAIDAAHAALRRGSELEERQAWLDGIVDALKAHKSELGRVLTMEHGKPLKEAQGEVLYAAGFFEFCAKNVYSLGPRTLPERPREATWTIHNRPAGVVGLVTPWNFPIGMIAKKLSAAIAAGCPSVIKPSSKTPLTMLALFTLMEREVDLPPGFVNLVTGPSGPIGDTLMADDRVRVVSFTGSTEVGRKLITASAPGVKKLALELGGNAPFIVFADTDLDRAADHLIANKFRGGGQTCVCANRILVEASVEESFADKVAERAARLKVGDGMAPDTDLGPLIDRNGYEKVRRHFNNALEQGATAVLGEDPGPIPNDWGGFFPPAVLRGVKPGMDCTREETFGPLVPIMPFRDEAQALEMANDTEFGLAAYLFTADEARAQRLIAGLEFAHVGHNTGTGPTPEAPFGGMKCSGWGREGGTEGLFEFVEPQTVPRGN

SEQ ID NO: 2276 - protein, 461 aa, Pyrococcus furiosus DSM 3638
MKTLILAGGKGTRLWPLSRELMPKQFIKVFSNKSLFQKTVERALIFSKPKEIFVVTNKEYRFRVLDDLNEIGVNIPEENILLEPVGKNTLPAIYWGLKVIDESFGDSIVAVLPSDHAIDVNENYIEAFKKAEKLAENYLVTFGIKPTKPHTGYGYIKPGEKISNLGFLVDEFKEKPDLETAKRYVENGYYWNSGMFMFRTTLFMEEARKHAPDVVKAFEEGKTIEEAYELAPEISVDYGIMEKTDKAAVVPLNTYWNDLGSFDAVYEALQKDENGNAVEVRGFKAKYINVDSKNNLILTERLTATVGVEDLIIVDTGDALLVAKKGETQKVKEVYKKLKEENDERAIVHRTAYRPWGSYTVLEEGERYKIKRITVLPGKRLSLQLHYHRSEHWVVVRGTAKVRVGDKEFILRPGESTFIPAGVIHRLENPGKVVLEVIETQIGEYLGEDDIVRIEDDYQRA

SEQ ID NO: 2277 - protein, 417 aa, Alkalilimnicola ehrlichei MLHE-1
MGRRSPVIRSRCIGGSGMVADPVELEYSETPEPMWNPALRALPIPGIRRMVNMAAEMDDVIHLSIGQPDFPVPDHVIEAHIDALRHGQTGYTMDAGLPELLETIAEYYADRYQRPIAPENVLVTTGATEAIYLALAATAAPGRQFLVPDPSFPLYAPLIRMNGGEVKAIPTRAENGHQLDPQEVIDNIGMRTFGIILNSPSNPTGTVYPRETVEAIVQEAAYRGVYVYSDEVYDHLLLDDLQYASVLNCTSDLDHVMMMSSFSKTYSMSGLRIGWIISSQGAIKKLRRFHIFTTTVANTPAQWAGVAALRGEKTCLDSMVAEYRRRRDRVVQLVSDAPHLTGYWPQGAFYIFPSLPPNTDATTVAIRMLQETGVCVVPGDAFGDSCPNSLRISFSASMDDIEEAFERVIPWLAKQRF

SEQ ID NO: 2278 - protein, 384 aa, Mycobacterium tuberculosis CDC1551
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPLPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 2279 - protein, 957 aa, Escherichia coli W3110
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFNVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 2280 - protein, 148 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLERPRRRTLMHSSVSSASTTSGRCSSSASSPTSPRAARSLVATKPSSSYIALFNCSSLIR

SEQ ID NO: 2281 - protein, 152 aa, Glycine max
RNETHEGNATRAFQFQDVFSLENEDSDDVTTLIDKKDNVFVMSNKKSKYPVLQVDLRLISDLVVVIVSAAIGGIVFSCLGQPVIVGYLLAGSLIGPGGLKFISEMVQVETVAQFGVVFLLFALGLEFSLAKLKTGGPCACLGGLLQIIISMV

SEQ ID NO: 2282 - protein, 266 aa, Bacteroides fragilis
MTKKKLPVRFTGQHFTIDKVLIKDAIRQANISNQDTVLDIGAGKGFLTVHLLKIANNVVAIENDTALVEHLRKLFSDARNVQVVGCDFRNFAVPKFPFKVVSNIPYGITSDIFKILMFESLGNFLGGSIVLQLEPTQKLFSRKLYNPYTVFYHTFFDLKLVYEVGPESFLPPPTVKSALLNIKRKHLFFDFKFKAKYLAFISCLLEKPDLSVKTALKSIFRKSQVRSISEKFGLNLNAQIVCLSPSQWLNCFLEMLEVVPEKFHPS

SEQ ID NO: 2283 - protein, 676 aa, Coccidioides immitis RS
MAANFTEDNIQELRYRLEDAARKCSERCLYQSAKWAAEMLDSLIPADEFSDGADTEPDSPMDISPSVAENPFLTNADPEEAALEAREAHKYILAKAYFDTREYDRCAAIFLPPSMSSIPLAPRPPTSTSKIRPNISSHKGKEKSISLGAHQARAASKNPFPKLSQKSLFLALYAKYLAGEKRKDEETEMVLGPADGGMTVNRELHALAQGLEGWFSDRRERGLESRGQGWLEYLYGVILLKAKNDEDAKKWLIRSVHLYPFHWGAWQELNDLLTNTDDLKRVAEKLPQNIMTLIFHLYSSQELYQATEATYHTLTELESIFPSSAFLKTQRALLYYHSKDFEEASHLFSELLISHPHRLDGLDHYSNILYVMGARPQLAFVAQMATATDKFRPETCCVVGNYYSLKSEHEKAVMYFRRALTLDRNFLSAWTLMGHEYIEMKNTHAAIESYRRAVDVNRKDYRAWYGLGQAYEVLDMAFYALFYYQRAAALRPYDPKMWQAVGSCYAKMGRADQSIRALKRALAAGSYYDSSRNTPFGRRILDPETLHQIATLYERLGDEEEAAAYMELTLQQETGQMGGNNDDEDNDDDAEDDAMSASRRTSAFTHHNDDMDEEPTGTGVTAATSKARLWLARWALRHNDLDRAEQLANELCQDGVEIEEAKALMRDVRARREGRG

SEQ ID NO: 2284 - protein, 478 aa, Rhodococcus sp. RHA1
MAFTTAEEVIKFIKDENVEYVDIRFSDLPGVQQHFSIPASAFNQDVFEDGLAFDGSSVRGFQSIHESDMMLLPDVATAQLDPFRAAKTLNINFFVHDPFTRESYSRDPRNVARKAEEYLKSTGIADTAFFGAEAEFYIFDSVRYDSGINGAFYELDSISGSWNTGNDVNADGSPNLGYKVRPKGGYFPVAPYDHYVDLRDEISTNLQNAGFELERGHHEVGTGGQQEINYKFNTLLAAADDLQLFKYIVKNTAWQHGKSATFMPKPLFGDNGSGMHVHQSLWKDGKPLFHDEAGYAGLSDMARHYIGGILHHAPSLLAFTNPTINSYHRLVPGYEAPINLVYSQRNRSAAVRIPITGNNPKAKRLEFRAPDSSGNPYLNFAAQMMAGLDGIKNKIEPQAPVDKDLYELPPEEARNIPQAPTSLSAVIDRLEADHDYLTEGGVFTSDLIETWISLKREQEIAPVNLRPHPYEFQLYYDV

SEQ ID NO: 2285 - protein, 538 aa, Streptococcus suis 89/1591
MSEIQKTDWWKKSVIYQIYPRSFQDSNGDGIGDIRGIISRLDYLHELGIDAIWLSPVYQSPMDDNGYDISDYQGIAPEFGTMEDMEELIAEGHKRNIKIIMDLVLNHTSDEHFWFQEALKGPDNPYYDYYVWADEPNELRSTFSGSAWEYVPHLNKYYLHQFSVKQPDLNWKNPALKQEIWDMINFWIEKGVGGFRLDVIDLIGKEPEKLITADGPTLHPLIQELNEKTFGAYDLVTVGETWSANPENAQLYSHPDRKEFSMIFQFEHVGLDQQEGKEKWDLAPLDPARLHKVLSKWQTELVGKGWNSLFWNNHDLPRAISRFGDDRPAFRELSGKMLAIYLHFMSGTPYIYQGEEIGMINTPITDISQADDIETRRMYAERIENGFTKEELITSINAKGRDNARRPMQWTAEEGAGFSTGQAWLALGDTVKDINVEKALADKQSLFYTYQKLIALRKEYPCMSEGKYEVMETGNDLVMAYRKYDEQDDFIILVNFTSEEQAYEFSLEDYSVFMHNYDNKVIFDKSVLRPYEAIVFKK

SEQ ID NO: 2286 - protein, 445 aa, Haloarcula marismortui ATCC 43049
MNHEQSRALYDRALSVLSGGVNSSVRATRPYPFFVEKGDGGHVIDADGNRYIDFVMGYGPLLLGHSLPEQVQSAIQQHAAEGPMYGAPTEVEVELAEFVTRHVPSVEMLRFVNSGTEATVSAVRLARGYTGRDKIVVMQSGYHGAQESTLVEGEGDHTAPSSPGIPESFAEHTLTVPFNDEEAAHEVFEEHGDDIAAVLTEPILGNYGIVHPVEGYHDTLRQLCDDHGSLLIFDEVITGFRVGGLQCAQGAFDIDPDITTFGKIVGGGFPVGAIGGKSEIIEQFTPAGDVFQSGTFSGHPVTMAAGLETLRYAAEHDVYGHVNDLGERLRAGLQDILEDQAPEYTVVGRDSMFKVIFTRDGPDSLEGQCEAGCQQQESCPRFEYCPKTGHDVTQAETERWERLFWPAMKDQGVFLTANQFESQFICDAHTGEDIENALEAYKEAI

SEQ ID NO: 2287 - protein, 461 aa, Solibacter usitatus Ellin6076
MATTREGGLIKGLGLVDSTTLVMGSMIGSGVFIVAADISRQVQSPGLMMMTWFVTALLTLIAALSYGELAAAMPHAGGQYVYLREAFGPLYGFLYGWTLFMVIQTGTIAAVAVAFAKYAGVFFPWISDQNYLLGAGKVGFTTQQLVAIAIIVFLTWSNTRGIRTGAMVQNIFTIAKVAAILGLIAAGFLVGRNPEAIASNFNGFWRNSGWNFDTVRLVGVAMVGSLFSSDAWNNVTFTAGEVRNPRRNLPLSLALGVCIVSALYILSNFVYLNVLTFDAIQHAPKDRVAALAAEHMLGPVALQIMAAAIMISTFGCVNGLTLAGARVYYAMAKDRLFFRRATELDPKTNAPVFSLTVQCAWSVALTLSGSYNDLLDYVIFAVLLFYILTIAGLFVLRRTRPDMDRPYKAIGYPVLPAVYILAAGLIEVLLLAYKPNYTWPGLIIVLLGLPVYFIWRGKATI

SEQ ID NO: 2288 - protein, 140 aa, Triticum aestivum
MAGAAKASWMVAMSVGGVEALKDQAGLCRWNYALRSIHRAAKARANVRGGVLQGAKQLPASAAVAERRRGEKAEEGLRTVMYLSCWGSQLVLATKRCFLLAPGSSLCLATTWLVNSLPIVNTYSLCSELLVLNLSRYGCI

SEQ ID NO: 2289 - protein, 710 aa, Ustilago maydis 521
MAMSDATVFDIDYPFPDLDATRARESLRFAALELSNRGLASSSRWTLELLQSVPYTGNLNSGLVLSDQSRSNHSAMVTSTPAPKRRSQARSLVPEHSTPALGVHQRMSVEPGAEDTSAGEGLESFAPGTFSSSPLVNSRLAHVASPRDDPDSSLIPVGSEDGTAPGSAHVHWQSNTNSVDCSPGAFQYRLDGTSSAALSSLEEDSYLLAKNYFDQHQLERCIWVLEGSKGSSDKARFLRLYSRFLMSERKLDEHGMIIPKPNGTLPATSPSLIPILKELVDVSDPFLLFLKGAILRKLNRPIEAMDCLVRSVQSFAYNWAAWQELAMTLEPGEADQMADLLPESFMVSFFREFLDRHSAQEGDATITRIDRLLESFPRSAYLLTCRAQTNVHRLEYIEAEQDFQEAWSIDPYRIDGLADYSNALYLLNRTAELAHLAHKFSSFAKDRPEVCCLVGNYYNQRSDHHRAIEAFRHALRLDSGCVPAWILLGHEYIELKNSHAAAEMYRRALKINPREYRALYGLGQVYELNGAYTYAVNYFQKCAAIRPYDGRMWSSMGICYDHLGRSQDAVSCFKRYLACRLNQGDTVMGLTRIIEVYEKERDFEAAACYHRRLVQVVDRALTGTESNVVARYARSYIIAARWEMGEIGVRSAQEREETADEKEQDGEPETVAKVGNLALANDYLQKVIAAGTEMTDSAEILLKRLAFLRD

SEQ ID NO: 2290 - protein, 157 aa, Arabidopsis thaliana
  misc_feature (42)..(42): Xaa can be any naturally occurring amino acid
  misc_feature (95)..(95): Xaa can be any naturally occurring amino acid
  misc_feature (100)..(100): Xaa can be any naturally occurring amino acid
  misc_feature (102)..(102): Xaa can be any naturally occurring amino acid
  misc_feature (106)..(107): Xaa can be any naturally occurring amino acid
  misc_feature (109)..(109): Xaa can be any naturally occurring amino acid
  misc_feature (120)..(120): Xaa can be any naturally occurring amino acid
  misc_feature (132)..(132): Xaa can be any naturally occurring amino acid
  misc_feature (135)..(135): Xaa can be any naturally occurring amino acid
  misc_feature (137)..(137): Xaa can be any naturally occurring amino acid
  misc_feature (141)..(142): Xaa can be any naturally occurring amino acid
  misc_feature (144)..(144): Xaa can be any naturally occurring amino acid
  misc_feature (147)..(149): Xaa can be any naturally occurring amino acid
  misc_feature (153)..(154): Xaa can be any naturally occurring amino acid
  unsure (1)..(157): unsure at all Xaa locations
MASSMLSSTAVVTSPAQATMVAPFTGLKSSASFPVTRKANNXITSITSNGGRVSCMKVWPPIGKKKFETLSYLPDLSDVELAKEVDYLLRNKWVXCVEFXFXHGFXXTXEHGKHFPGYYXWAGTCKFWRVPXFWXNXLPLXXFXGFXXXKKGXXGAF

SEQ ID NO: 2291 - protein, 530 aa, Mesorhizobium sp. BNC1
MRLPRREGRRRKFNQLDRDYAQSGLAMEETMQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 2292 - protein, 389 aa, Aspergillus oryzae
MTETQTVLASRQSGRSSESSSLDAIAAEKQNLAVHSVPSTRPDLHNSASPKRWKTFWTAFRYLQHLTPKQVDDFMASYVIYNLDWSDEKQMVEELGPNYQEKVGDCLKSYYGVLNHLCALGDVEKMYIPPFMSKKATVLENQLLYEESIAEHIGLKPGDKVLDLGCGRGRVAAHMTQYSGAHVTGLNIDPNQIAQARSYNEKLGFKDNRFIVQDFNSLPLPFEDETFDAFYQIQAFSLCKDLPALFREIFRVLKPGARFSMLDWVSLPDYDPSNPEHVQLMRRVKPLIGAVGTPTPKILENALTDAGFTVTRSDNASVGGLQAPLIAKVDLYFRSMRQLILGLVKTHVLPKHFKTLINRLCLDGEAFVKMDNMRLVTTSYRIIAQKPLH

SEQ ID NO: 2293 - protein, 479 aa, Campylobacter jejuni RM1221
MTTYLNYIDGKFIPHNGEFIEVLNPATKEVISRVASASLEDTKRAIEAAKKAQKVWEAKPAIERANHLKEIASLIRKNANFLTEVLMQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSVYDEFVDKFVKAMSKVSVGNTLKGDFDMGPLVNQAGVDNALAMLQRATAKGAIVECGGKIIDTSGYYFPASVLTNVKHEDEIMQKEIFAPILPIAKFDTLDEAIDMANDCEYGLTSSIYTQNLDIAMRASREIKFGETYINRENFEAMQGFHAGFRKSGIGGADGKHGLEEYLATHVVYLQYNTNKQ

SEQ ID NO: 2294 - protein, 536 aa, Glomus mosseae
MASTPPTDYGKEAVLDVSETRDVETGEVKNGGLKQDLKNRHMQMIAIGGAIGAGLFVGSGGALQKGGPAALLIGYLIIGIMLLCTCLALAEMAVLYPVNGAFFTYIVRFVDPSWGFAMGWQYALAWLTVLPFELIAASITIRFWREDINMAVWVSVFLVVLMGIQIFGVRGYGEVEFVLSIIKICACVGFIILGIVINCGGVGDQGYIGVKYWRDPGAFTSFKGFCAVFVVAAFSFGGTEMVGLAAAESANPRKSIPMASKQVFWRIAIFYILNLFIVGLILPANDPRLMGASGANTKASPFVLAIQDAGIKVLPSIMNAVITVAVLSVANSCTFGSTRTIQAMAERNMAPNFFKYIDSKGRPLYCVILQIAFGLLAYIGAAPQGMEIFGWLLALTGLGFLFVWGSICLAHIRMRAGMKAQGINLGLIPYKTPFGVAGSYLGLGLNILALIASFYTALFPASGASPTAEAFFSSYLAFFSVTLLYLGYKACTRKRQMYVRPAEMDLASGAVWLEEVEPKEPFVWADTPKKVLRSFY

SEQ ID NO: 2295 - protein, 243 aa, Mesorhizobium loti MAFF303099
MDARQLKVEAARAALAHVSDGMRLGIGTGTTAEEFVRLLADKVATGMTVIGVPTSERTAALCRELGVPLSTLEETPELDLTVDGADEVDPELTLIKGGGGALLREKIVAAASQRMIVIADRSKMVETLGRFPLPIEVNQFGLRATEIAIAKTAADLGLSGPITLRMTGGQAFVTDGGHFILDASFGRIPDTRALSNALHAIPGVVEHGLFIGLASTAIIAGGDGIQTVHAARKPGSSTNHDVA

SEQ ID NO: 2296 - protein, 1041 aa, Pleurotus djamor
MSSLRWSVGLRIVAGVRHRPVRCPTRRFATLKPLSSLFAPLDTFPERHIGPDDRETSYMLSKLNYNSFDAFIADTVPDQIRVSDTVNNSTIPPLSESELHRRAQALGAKNEKFKSYIGMGYHNAVVPPVVLRNVMENPQWYTPYTPYQPEVAQGRLESLVNFQTMVMSLTSMDIANASLLDEATAAAEGMVMAYVNSNHKKRSFFVDSGVSPQTLAVLRTRAKGFGINIVTGNVERIVSDTALRSDLCGVLVQYPDVDGTIKDYSALADSVHSAGGLVICATDLLALTMIKPPGEWGADVVLGNSARFGVPAGYGGPHAAFFAVTDKLKRKMPGRLIGRSRDASGRPAYRLALQTREQHIRREKATSNICTSQALLANMAAMYAVYHGPEGLKRVAERIHGLTQVLKTAVEGLGFKSVNTEFFDTLTLDVSAATGTADVVHATAMAANINLRQIDDTHVGVTLDESVGPIDLLSIINVFASAVSAPVIDRSRLVLPERVAIASSLRRTSEFLPHPVFNKHHSETEMLRYINHLASKDIGLVHSMIPLGSCTMKLNSTSSMIPLTWPEFSSVHPFAPAEQVEGYLTIIKELEEDLCRITGFHAASLQPNSGAAGEYAGLCVIRAYHESRGEGHRDICLIPLSAHGTNPASAVMAGLKVVPVKALADGSLDLKDLKEKAEKHKDQLAAFMITYPSTFGVFEDGVQEACKIIHDNGGQVYLDGANLNAQIGSTNPAKCGGDVCHMNLHKTFAIPHGGGGPGVGPICVAEHLAPFLPTHPYLSTEANSQAINAVSAAPFGSSSIHLISWAYIKMLGGQGLADSSRIALLNANYMAYRLSGHYSLRYKNNNNRVAHELLIDLAEFDKAAGLKVTDFAKRLQDYGFHPPTCSWPISTCMLIEPTESETLEEIDRFCDAMIQIRQEAQDIIDGKQPKDNNLLKNAPHPAHVIALPEAEWNRPYSRETAAYPAPWLHEKKFWPTVSRIDDGGSRFLIVLSLADRYLAHSSLRRPQSHRECCTSVACSSPSLMMYLLQCDCPSVEELAHA

SEQ ID NO: 2297 - protein, 446 aa, Rhodococcus sp. RHA1
MDRQKEFVLRTLEERDIRFVRLWFTDVLGYLKSVAIAPAELEGAFEEGIGFDGSAIEGFSRVSEADTVAKPDASTFQVLPWSSSKGHQHSARMFCDIAMPDGSPSWADSRHVLRRQLNKASDLGFSCYVHPEIEFFLLENGPIDGTPPKPADSGGYFDQAVHDSAPNFRRHAIDALESMGISVEFSHHEAAPGQQEIDLRYADALSMADNVMTFRYVVKEVAIAEGVRATFMPKPFSDQAGSAMHTHMSLFEGDTNAFHNPDDPMQLSETGKAFIAGILEHANEISAVTNQWVNSYKRLIHGGEAPTAASWGPSNRSALVRVPMYTPNKASSRRVEIRSPDSACNPYLTFAVLLAAGLRGIEKGYELPPEAEDDVWALTSAERRAMGYRELPGNLDGALREMEKSELVAEALGEHVFDFFLRNKRREWEEYRSHVTPFELKTYLGL

SEQ ID NO: 2298 - protein, 400 aa, Sulfitobacter sp. EE-36
MELLSKTLARVKPSPTIAVTQKAAELKAAGKDVIGLGAGEPDFDTPQNIKDAGIAAITAGKTKYTAVDGILELKQAICAKFKRDNGLDYTPSQVSVGTGGKQILYNALMATMNPGEEVVIPAPYWVSYPDMVLLAGGTPVIAPATLENDFKLTPEALEEAITPNTKWFIFNSPSNPTGAGYSWDELKALTDVLVRHAHVWVMTDDMYEHLAYDDFKFCTPAQVEPALYDRTLTVNGVSKAYAMTGWRIGYAAGPEKLIGAMRKVQSQSTSNPCTVSQWAAVEALNGTQDYIAENNKMFTRRRNLVVDMLSEIDGIVCPKPEGAFYVYPSIAGLIGKTTPSGVTITDDEVFATALLEDTGVAVVFGAAFGLSPNFRISYATSDEALKEACTRLQQFCAALS

SEQ ID NO: 2299 - protein, 289 aa, Rhodococcus sp. RHA1
MSDSKSSASTSEDRLYGSAPSHDVPKRKTRTHHLQAMKAEGERWAMLTAYDYSSARIFEEAGIPVLLVGDSAANVVYGYETTVPVTIDELLPLVRGVVRGAPHALVVADLPFGSYESSPEQALASATRFMKEGLAHAVKLEGGERVAPQIAAITAAGIPVMAHVGFTPQSVNSLGGFRVQGRGDAAEQLVADAIAVQEAGAFSVVMEMVPAEIAGQVTRKLTIPTVGIGAGVECDAQVLVWQDMAGYTSGKTAKFVKRFGNVGDELRSAAAAYATEVRAGTFPAEEHSF

SEQ ID NO: 2300 - protein, 603 aa, Mannheimia succiniciproducens MBEL55E
MVTEGANYLVSIVTFLGAAIIVVPLFKKIGLGPVLGYLAAGLAIGPFGLALFTDSTTIIHIAELGVVMFLFLVGLEIQPKQLWGLRKYIFGMGSLQVLGATGALTAIGLLYNFSLQFSFIAASGFVLTSTAIVMQTLSYRNDMTSDPSRRIIAVLLFEDLLIVPLLALVAILSPAQTADSLQSHSLWQHIIVSFAGLALLIVAGIWLLDPLFRLVAKTKIRELMTAVALFVVLGSALLMEATGLSMAMGAFLAGVLLSNSSFRHQLEVDIDPFKGLLLGLFFLGVGMSLDLTHVLNHWKMIVSALFLMMITKGIIIYAVARATGSTKLQSLDRAVLMAQGGEFAFVLFSSAALQGVISAEVHANMTAIVVLSMALTPLFIVIYQKWIAPKFAVREVLENDVIEEQNDIILIGLGRFGQIVNHLLRASGFQPTIIDKDAKLVSGMKKRGIRSYFGDACHPDLLHRAGIETVKLVIVAIDNTKQATKIVQHIRQINPKAKIIARAYDRHHVFELAQAGANVQIRETFDSALRTGKQALTTLGIEQEKVHRIGNMFFGKDRHSVKLMADVYDPKKPMFTNADMLKIAFEQDEELKLEIQKILDEEI

SEQ ID NO: 2301 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 2302 - protein, 393 aa, Arabidopsis thaliana
MRKKKTRFQFLLNPNSKFVFFPRAISSSSSSSSDNNNDGSVSSSRQNNRQMGYDPSEELFGVDFKPRFISGDSREPRSWFGPNGQYIRELPCPTCRGRGYTSCSNCGIERSRLDCPQCKGKGIMTCLRCLGDCVIWEESIDERPWEKARSSSPFRVKEDDEVDNLEIKFSKRRKSKRIYQSPTPEVGQKISRSLKSLNAKTGLFSKRMKIIHRDPVLHAQRVAAIKKAKGTPAARKHASESMKAFFSNPVNREQRSLSMKGTKFYCKNCGQEGHRRHYCPELGTNADRKFRCRGCGGKGHNRRTCPKSKSIVTKSISTRYHKCGICGERGHNSRTCRKPTGVNPSCSGENSGEDGVGKITYACGFCKKMGHNVRTCPSKQVSDSDSCLEQEGS

SEQ ID NO: 2303 - protein, 179 aa, Triticum aestivum
  misc_feature (114)..(114): Xaa can be any naturally occurring amino acid
  misc_feature (141)..(141): Xaa can be any naturally occurring amino acid
  unsure (1)..(179): unsure at all Xaa locations
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWXTMWKLPMFGCTDATQVLNEVEESRRSXPDAYVRVIGFDNIASECVSSMPSGTRLQGIPARPKVQV

SEQ ID NO: 2304 - protein, 358 aa, Solanum tuberosum
  misc_feature (277)..(277): Xaa can be any naturally occurring amino acid
  unsure (1)..(358): unsure at all Xaa locations
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYAAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVAPEVIAEYTVRALQRTMPAAVPAVVFLSGGQSEEEATRXLNAMNKLQTKKPWTLSFSFGRALQQSTLKAWSGKEENIGKAQAALLTRCKANSEATLGKYAGSSNLGDGASESLHVKDYKY

SEQ ID NO: 2305 - protein, 668 aa, Aspergillus oryzae
MVAGISKRQQLRNERALQDLVRSVPGNDRCADCQAMNPGWASWNMGIFLCMRCAALHRKMGTHISKVKSLSMDSWTAEQVDNMKSHGNNLMNKIFNPRNVKPPVPADVDESDACMERFIRQKYQHRTLEEGKPKPPSREGTRRDDRSPEGSPPPLPPKPARPHGLGLRSASSTTSLHRLSNRQAASSRFEAYESPRSVSQGMGASVGNSNASHESQMATLRSMGFTNEYRNSAVLKGLDGNLDKSIETLVRLGEGPPSLQGGTRVQTTTANDAARQQASSNPFDQLDSKPAQPSGQSYNPFDVPTPQPAAQTLEASFQNLQVSQPLFPHSTGGYPNQQPSFPQPLYQQPITPPVMPTISQGAVVQSPQPVDGGQNPFFQSGSFTSTPNQTPGLAQPQTNPFFTQPPSQLNSMQTPSQAPAGYPHPPRHANTMPAISSTSPFGTASPFQQQQQQQQQIQPPQLQVQPPQQMQPSHNPFQPMTAPPTPQSAGYQVQSQLGLQAPAQHLAPQPTGRIDKNSILSLYGLSPPPSATSEYSQPPNPAGAFPGPGTAPAPAPGYATTTQPQQPTDPHSAGTRNPFLTSQAPAAGLPQQQQQQAYLQQPQLQPQPQYTTTSPFTMPVKSNTMPPAAPSAFPRPQGHMSQQSVDINAFQNGRHSPDAFASLSARYG

SEQ ID NO: 2306 - protein, 413 aa, Azoarcus sp. EbN1
MADKPKVLLVATRDTKNEESQYIRQCLEDAGVEVYHLDASIRSTLDGDVAIGPDKIAGAAGMTMPEIRALRHEGLCLEVMIRGALKCADELNRNVGLSGILGLGGSMGTVLATRIMQTFPYGLPKVMISTMASGMTGPFVGAKDIMMVNPVCDISGLNSITRNAFRSGALAVAAMAHDYQSGEAGGNKPLITVSTLGTTEKCSARVRRSLEQQGFEVMVFHTLGTGGAAMEQIIRERDVAVVIDMSLIEVSEYLHGGLCATGPDRGKAALEKGVPTIFAPGNLDFLVAGPLAEAKVRFPGRRYHEHNPALTAVRAEAQEFRNDAEHLAGLIRTARGPVSFFVPLQGFSNHDSPDGHLHDPSLPPVFLAHLKTVMPAGVPVVELPLHINDEKFADALVEQAVAFSKYRSEAASK

SEQ ID NO: 2307 - protein, 150 aa, Thermosynechococcus elongatus BP-1
MERTFLAIKPDGVQRGLVGTIIQRFEQKGYTLVGLKLMRVSRELAEQHYGEHKDKPFFPGLVNFITSGPVVAMVWEGRGVIANARKLIGATNPLNAEPGTLRGDFAVDVGRNVIHGSDSPENAEREINLWFQTQELVPWEPALTSWVYEM

SEQ ID NO: 2308 - protein, 457 aa, Legionella pneumophila str. Lens
MLNPREIRTIEDAKRIVEERQLTHVKVGLFDIDGVMLGKYMSRNKFFSALEHGFAFCDVILGWDSKDKLYDNVKYTGWHTGYPDASVRIIPSTCREILFEENQLLFMAEFSQAAEAICPRGILRRVINKAAGMGYDVYAALEYEFFVFDETPDSVRAKGFRNLKPVTPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQHHSPELALPRTLWESAQNLKNSSAAYELFGQEFVEHFAASREWEEREFRKHITDWELDRYFEII

SEQ ID NO: 2309 - protein, 395 aa, Mycobacterium sp. MCS
MSGAHAQRTEPRDVALRAGIPPFYVMDVWLAAAERQRTHGDLVNLSAGQPSAGAPTAVREAAIAALQENQLGYTVALGIPELREAIAARYADQFGLTVGLDDVVLTTGSSGGFLLAFLACFDVGDRVAIASPGYPCYRNILTALGCEVVEIPCGADTRFQPTAAMLAELDPPVQGVIVASPANPTGTVIAPAELAAIATWCEATGTRLISDEVYHGLVYDGAPPISCAWQTSRKAVVVNSFSKYYAMTGWRLGWLLVPQELRRAVDRLTGNFTICPPALAQHAAVAAFTPESTAEADGLLAHYAENRRLLLDGLRAIGISRLAPADGAFYVYADVSHLTDASLSFCAKLLADTGVAIAPGIDFDTVHGNSFVRLSFAGPTADITEALSRIGGWLR

SEQ ID NO: 2310 - protein, 256 aa, Legionella pneumophila str. Lens
MRHSPRKRFGQNFLQDKYIINEILRAINPLADDNMLEIGPGLGALTQPLLQKLNRLTAIEIDTDLQSYLTCLPVSQGKLNLIPADALTVDFCQFGPHLRVVGNLPYNISTPLLIYLLKFITCIDDMHFMLQKEVVERIAAAHGTKAYGRLSVMLQYHCEVEYLFDVPPEAFEPRPKVDSAIVRLTPHRVSPFESVNTEKLENIVAKAFAMRRKTLTNNLKGIISLSQLNDLGIDGGKRPEQISVAEYVQLAKFISN

SEQ ID NO: 2311 - protein, 276 aa, Bordetella bronchiseptica RB50
MPRFERSALLDKFQDMVRRRQPIVGGGAGTGLSAKCEEAGGIDLIVIYNSGRYRMAGRGSLAGLLAYGNANDIVLDMAREVLPVVRHTPVLAGVNGTDPFCNFDAFLDELARVGFSGVQNFPTVGLIDGTFRANLEETGMGYGLEVEMIRLAHAKGLLTTPYVFDPDQARAMTAAGADIVVAHMGLTTGGNIGAETALSLDDCVARIDAIAAAALAERGDVIVLCHGGPIATPQDAAHVLQRCRHCHGFYGASSMERLPAEQALTATTRAFKQLSF

SEQ ID NO: 2312 - protein, 402 aa, Bordetella bronchiseptica RB50
MQEIEQRIYLAATYDTKGEEAEYLRQLLRRDGVMVVTVDVATSGQGSPAMVSAQEVAACHPQGAQAVFTGERGSAIVAMALAFERYLAGQRDVGAVLGIGGSGGTALVTPAMRALPVGVPKLMVSTMASGNVAPYVGPSDIAMMYSVTDVAGLNRISRRVLANAAGAIAGAFRQARQPIADDGRPAVGITMFGVTTPCVQHVTAALHDRYDCLVFHATGTGGQSMEKLADSGLLAGVLDLTTTEVCDFLFGGVLACTDDRFGAIARSGVPYVGSCGALDMVNFGALDTVPAACRERLLYPHNPQVTLMRTTAQENARQGAWIAERLNRCEGQVRFLIPEGGVSALDAPGQAFYDEAADAALFQALYDHVRQTDRRRLVRVPCHINDPLFARAAVEQFHEISQ

SEQ ID NO: 2313 - protein, 130 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNID

SEQ ID NO: 2314 - protein, 404 aa, Solibacter usitatus Ellin6076
MKAVVYKGKNKVAVEEVSNPKIEAPGDVIVKITTAAICGSDLHMYEQRSNAEPGTVFGHENQGVVEEVGNGVVSIKRGDRVVLPFNIACGFCFNCARGYTNACLTANPEAPTAGYGYAGMGPYRGGQAEFLRVPFADFNCLKLPGQPGDQFEDDFVLLADIFPTGWHAAELANVKGGDSVAVFGAGPVGLLSAYSAFIKGASEVYVVDRAPDRLARAKSIGAIAVDFTQGDPVEQIKELRSKNRAHSQALRPGEEKMAGVNCAIDAVGYQARSQSDPDREDPMQTIRQITDIVNPTGSVGLIGVYFDEDPGGVDKHAKKGEFLFPLGKLWSKGITIGQGQAPVKKYNVYLRDLIIAGKAKPSFIVSHRLPLARAEEAYAHFDHRGVGSGKDWTKVLLKPEMKAA

SEQ ID NO: 2315 - protein, 251 aa, Lactobacillus johnsonii NCC 533
MRTPIIAGNWKLHMNPEQTIEFVNAVKGKLPDPSKVESVIAAPAVDLYVLKKTAEGSNLHTGAENAYFEVEGAFTGETSPKVLNEMGIDYCIIGHSERRGYFHETDEDINKKAKALFANGVTPIICCGESLETREANKQDEWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 2316 - protein, 664 aa, Debaryomyces hansenii CBS767
MSDIGGNKGALHPEPKKWKIPKGPKPILHKNKNTIGLGRTIANQKRAENKISFLPDGEMRFTTDKREADWVKLRSVTQENALDEFLNTAELADTDFTAEKNQQVKIIKIGNTSIVNQNGLLTQEETLELRRKHKIFENKLTVPRRPQWNKNQLKLEIERQENLAFLQWRRELASLTENNDLLLTPFERNIEVWRQLWRVVERCDLIVQIVDARNPLLFRSIDLEKYVQELSKPDDNATKKNLLLVNKADLLTREQRIQWSDYFISQNINYVFFSASKANELLEEEQENLEESQRDPNYTPERKVEDEPEEVDSKIRILTINELENLFLTSSPSFEKSEEFPDRKLQIGLVGYPNVGKSSTINALVGSKKVSVSATPGKTKHFQTIHLSPEVLLCDCPGLVFPNFAYTNGELVCNGVLPIDQLREHIPPVSIVCHRVPKFYLEAFYGIHIPIQKVEDGGNGVYASARELLNAYARARGFMTQGFGSADESRASRYILKDYVSGKLLFVSPPPRKVNDDEWDLPSNEEARELNKELYSLRTLPESRQHQILSALSSKNVNPEDFDLSKGLAGLNFSMHIGDKSSSDIIDSENTKKNSGARTIFYGGKQASLESAGDDLDREFFKMNNVQGKLSKPFHAASDNGNGKNKKHGKKNKKADKKTRVVGY

SEQ ID NO: 2317 - protein, 638 aa, Arabidopsis thaliana
  misc_feature (562)..(562): Xaa can be any naturally occurring amino acid
  misc_feature (594)..(594): Xaa can be any naturally occurring amino acid
  unsure (1)..(638): unsure at all Xaa locations
MEFNCLPPTFITLRLMRRKLPFSMCCGYCLQASYSCLYFRKFLEVTPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQVIIYMMISVFCFFTMGLVTAVFLGELDWYFFQGIMTPQLSSLLFLVVGISMALTPWLAAGGQLIASRFELQDVRSLLPVESETDDLQGHIIICGFGRIGQVLHKIGADRACAAAIALDTPGANYRCVWALSKYFPNVKTFVRAHDVDHGLNLEKAGAPAVVPETLGPSLQLAAAVLAQAKLPSSGMATXTINEFRSRHLSELAELCEASGSSLGYGFSRKXTANPKPPSPSETSDDNQIIEGTLAYLTLFSRFWVRPHKFQLLFA

SEQ ID NO: 2318 - protein, 430 aa, Desulfotalea psychrophila LSv54
MESLKSKKLFAEAKKVIPGGVNSPVRACLSVGCDPLFIERAEGSYIYDADGQKYLDFVNSWGPMIMGHAHPDIIKAIQDAAVYGTSYGAPTSSEVDLASMVVEAVPSIEKVRFVSSGTEATMSAVRLARGYTGKNVIVKFDGCYHGHADSFLVKAGSGVLTLGIPGSPGVPEDIVKNTISIPYNSVEALETTLRDADLNIACVIVEPVAGNMGCVPPAPGFLQKLREITAEEGIVLIFDEVITGFRLSYGGAQQYYGVTPDLTCLGKIIGGGLPVGAYGGKADIMNSVAPDGPVYQAGTLSGNPLAMAAGKAALKLLQQDGFYEDLNQKSAAYADGLLEVAGRVGLPMQLNRVGSVMTSFFTATPVTDFETAMKADTGLYGRHYRQMLDSGIYLAPSQFECSFMSSTHSDADLKRALLETEKSFSLLKNA

SEQ ID NO: 2319 - protein, 617 aa, Pseudoalteromonas tunicata D2
MLEMAVIYLAAAIVAVPIAKRLGLGSVLGYLLAGILIGPYILALVGDQTDVMHFAEFGVVLMLFLVGLELQPSRLWKLKKTIIGLGGLQVILTTLLVWAVAYYVFALVWQTALALGLMMAMSSTAIVLQTLTEKGWIKQEAGQNAFSVLLFQDIAVIPILALLPLLALTEPDAHSQGHTSLIAHLAVYQQVLIATGAIVGIIAAGKYIASPLFRYIAQTRLRELFTVFALFLVMVIALLMQKIGLSPALGTFLAGVVLAESEFRHELEADIEPFKGLLLGLFFITVGASIDFPLFIAKFWLVIGLVTSLILIKACVLYALAFGFSMQKKQQVLFTLALAQGGEFIFVLLSLTASLSILSPEHTKLATLVVAISMLFAPLLLIGYEKWLEKSSRHAPSFDKPEHIEATKHVIIAGYGRFGQIIGRLLSAQGYHLSILDYSPSQIELLRRFGNKVFYGDAARQDLLEAAGAKDAKLLVIAIDEGDKILEIARICKKHYPHLKLVARAIDRRHAYELMHLGVVHFKRETFDSALNLGIEALQLLGNDPIAAERAGQLFAKHDDDSLAQLAQLWGDDKSYGIAVKKRLEDLKIVLMNDKAEQDKLNLCHGEQQKDESSCLE

SEQ ID NO: 2320 - protein, 266 aa, Campylobacter jejuni RM1221
MVKAKKQYGQNFLIDKSVLAKIIQAIPKEMNNIIEIGPGLGDLTQELLKISQVKAYEIDNDLIPILKKKFQKELECGKFNLIHQDASEAFNPSLDEKPYFLVANLPYYVASHIILKALEDKNCLGLIVMVQREMAEKFCAKEGNSEFSSLGVLSAMICERKILFDVDPQCFNPPPKVMSAVMSLIKTKDFDELCEIENFKNFLKDCFKAPRKQLLGNLKTYKAKVLEVLSTLGLKENIRPHEICVDLYLKIYDKLKDEYGRKQRDK

SEQ ID NO: 2321 - protein, 387 aa, Trichodesmium erythraeum IMS101
MNFATRMNSLGGDAAIEVFTKAKQLESQGRNIIHLEIGQPDFKTPKNIREAAFQAMNDGYTTYTPAAGLLKLREVIAEHISQTRNISVNSDEVVVMPGAKPVIFFTLLALINSGDEVIYPNPGFPVYESVINLVGGKPIPLPLLEELDFQFSIDNLVNSISEKTKLLIINSPHNPTGSVLTPEYLEAIAKLAVKHNFYVLSDEIYSHLNYDSKFTSIISFPSMKERTILLDGHSKTYAMTGWRLGYSISPKAIAEKLDKLMLNSNSCACSFTQIAGIEAIKNSQEFVKKIFAEFKQRRDVIVDGLNSISGINCRKPAGAFYAFPNVKQLPISSNKLADYLLAEAGVALLPGTAYGKFGDGYLRLSYANSIENIREGISRIETAIAKL

SEQ ID NO: 2322 - protein, 559 aa, Aspergillus oryzae
MGTGKKEATRRERQGKVGDGMGNVRVKGENFYRDAKKVKRLNMYKDGKPRRDAEGNITVAASYQSREAPVARIEPNRKWFGNTRVISQEALSSFREAVAERASDPYQVLLKTNKLPMSLIRDGQGVNGLKQHQAKMAIETNPYSDTFGPKAQRKRVKLGVGSLEDLAGETAKMHDAYVEKSDHQTHADGSLAVSGDVSAAQDDAHTTTATAVESVFSKGQSKRIWNELYKVIDSSDVIIHVIDARDPEGTRCRGIEKYIREEAPHKHLIFVLNKCDLVPTGVAAAWVRHLSKDHPTLAFHASINNSFGKGSLIQLLRQFSSLHSERKQISVGFIGYPNTGKSSIINTLRKKKVCTVAPIPGETKVWQYITLMKRIYLIDCPGVVPPNQNDTPEDILLRGVCRVENVENPEQYIPAVLKRVQPRHLERTYGVKGSDDPLEFLAVLARKGGRLLRGGEPDLDGVAKMVINDFLRGKIPWFTPPPHTPGEEGEKVNGREGRLGEMGRKRKLDAVSEETEKNEAKSGSTSDGEFEGFGDSDDDDNDSIANLEVSDEESGEEND

SEQ ID NO: 2323 - protein, 143 aa, Triticum aestivum
  misc_feature (95)..(95): Xaa can be any naturally occurring amino acid
  misc_feature (102)..(102): Xaa can be any naturally occurring amino acid
  misc_feature (114)..(114): Xaa can be any naturally occurring amino acid
  misc_feature (128)..(128): Xaa can be any naturally occurring amino acid
  misc_feature (135)..(135): Xaa can be any naturally occurring amino acid
  unsure (1)..(143): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVXGFIFREXHNASPGYYDGRXWTMWKLPISGCTDXTQVINEXVEEVKKDT

SEQ ID NO: 2324 - protein, 399 aa, Pseudomonas syringae pv. syringae B728a
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLVHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADIVGVEVISLDDAPRGYGEFDSGVPKKFVIDPHGLFGAA

SEQ ID NO: 2325 - protein, 255 aa, Triticum aestivum
MLAVFDQTVAKCPEGLRSPPAAGGGGTAAGGGGGAAALMKGFADANDAAVTVSLGAAGALAYSSANKNPLVPRMFGSVNDIFCLFQGHVENIGNLKQHYGLSKTANEVTILIEAYRTLRDRGPLPASQVVRDLSGRFAFILYDTVSKSTFVAADADGSIPFFWGVDSEDHLVFSDDNELLKAGCGNSFAPFPKGCFYTTSGGLQSFEHPLNELKAVPRVDSQGQMCGSTFKVDSEAKKDSGIPRVGSAADWSNHY

SEQ ID NO: 2326 - protein, 265 aa, Thermosynechococcus elongatus BP-1
MYGMMVRRSVTLPQLQAKKALGEPITMLTAWDYLWARLLDAAGVDVILVGDSLGMVALGYPTTLPVTLDQMIHHAQAVRRGVSHSFLVCDLPFLSYQESPEQALRSAGRLIKEAEVQAVKMEGASPVVQAATRRLVEAGIPVLGHVGLLPQRVHQLGGWRQQGNTPQDAAAILAGALALAEAGVFAVILEHIPAALAQQITAQLKIPTIGIGAGPHCDGQVLVTADVLGLSPQVPPFAKVYADLGTQAIAAIENYCQAVKSRQFP

SEQ ID NO: 2327 - protein, 457 aa, Escherichia coli O157:H7 EDL933
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 2328 - protein, 214 aa, Brassica napus
  misc_feature (208)..(208): Xaa can be any naturally occurring amino acid
  unsure (1)..(214): unsure at all Xaa locations
EVDEVKGDDVICLSRNAATLAGSMFTLHASQVHIDMPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKXFNQDLY

SEQ ID NO: 2329 - protein, 296 aa, Spiroplasma citri
MTTNIHWFPGHMAKAIKQIDEQSKLIDLVIEIVDSRIPFSSSNPLVDNLRGLKPKLIILNKKDLADPVVIKAWLEYYQSQQIAVLPLDSKHGNITKLIIEKIYHVLSGKIERDQNRGIKSPKLKVMVIGIPNVGKSTFINALIKRNSTRVGNKPGVTKGQQWLKLNHQIDLVDTPGILWPKINDPQVAINLAFTRSIKEDILPKEEICLAAIKWMYKHYFSLLAKQYHLTASDNFDVTDEQKLFELLLIMQQNRFHKVNEDNVNDIVTDFLNNLWNNKFGLISFEFPPGRGIFNYE

SEQ ID NO: 2330 - protein, 323 aa, Candida shehatae
MSPSPIPAFKLNNGLEMPSIGFGCWKLDKSTAADQVYNAIKAGYRLFDGAEDYGNEQEVGEGVKRAIDEGIVTREEIFLTSKLWNNYHDPKNVETALNKTLKDLKVDYVDLFLIHFPIAFKFVPIEEKYPPGFYCGDGDNFVYEDVPILETWKALEKLVKAGKIRSIGVSNFPGALLLDLFRGATIKPAVLQVEHHPYLQQPKLIEYAQKVGITVTAYSSFGPQSFVEMNQGRALNTPTLFEHDVIKAIAAKHNKVPAEVLLRWSAQRGIAVIPKSNLPERLVQNRSFNDFELTKEDFEEISKLDINLRFNDPWDWDNIPIFV

SEQ ID NO: 2331 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 2332 - protein, 582 aa, Exiguobacterium sibiricum 255-15
MRRTKIVCTIGPASEKRLPEMIEAGMNVARLNFSHGDYEEHGARITDIRRAAEEANKLVTILLDTKGPEIRTHTFEEGKALLVRGKQVIVVSGDANEIVGTADKFSVTYDGLYDDVEVGSMIMLDDGLIGLRVAEKLDNRELLCDIENEGIIKTKKGVNLPNVKVNLPALTDKDIADIEFGIKSDIDLIAASFVRRASDVVAIRQLLEKHNASHIKIFPKIENQEGVANIEEIIAISDGLMVARGDLGIEIPTEEVTPTQKDLIKICNDYGKPVITATQMLDSMQRFPRPTRAEASDVANAILDGTDAIMLSGETAAGDYPIESVQMMHTIAKRTEKMLDYKMLLKDRQTRSEHTVTDAIAQAVTHTAINLDAKAILTPTQSGYTAARISKYRPEPNIVAVTPSARVARQLNIVWGVYPIVVDHLSDNTDDMLTLAADTAKEAGFVTDGDLVVISAGIPALTAGTTNMLKIHIVGKEITNGRGIGERGVVGEVVIAHTAEEANAKAKPGMILVTNSTDRDMMPAIEMAAAMVTVDGGLTSHAGIVGPSLGKPVIVGVENAMTIFTDGQRISIDPLTGKLYNA

SEQ ID NO: 2333 - protein, 387 aa, Bradyrhizobium japonicum USDA 110
MVKPATGDCTHAPRFRVKDAKARREGRAATRTDKPNREQEMPKYRVVTPKGASFTVAGSDYSYEREALDPIDAEIIEAPANEAEFIAAAKNADAIYAKGIPITKSIIDALESCKVITLGSVGVDSVDVKAATARGIPVTNIPDTFIEEVADHAMMLLLAGFRRLVEQDRMVRSGRWAEGRPALLKIPRLMGQTLGFISFGRVARAVAKRAAPFGLRMMAYDPFIQETLMYDHGVIPATLNEVLSQSDFVSMHAPARPEVHHMLTEKHFRQMKKGSIFINTGRGATVDEESLIKALQEGWIAHAALDVLEKEPPSHNNPILSMENVTLTAHVASASARFDEARKRRVGYELSLVLQGMWPVSCVNPSVLQSTALRRWQPVSMDRGPNS

SEQ ID NO: 2334 - protein, 152 aa, Solibacter usitatus Ellin6076
MVNIPMDYIGTWAPATRPWVTSSSPSISAGMQRKGDLHRYTGFRMNSVKSATPAEIKQRLAAGEPLELIDVREPGELAIAAIEGARALPMSQASTWIDHLPGDRELVIICHHGMRSMQVAMALVQRGHGNVTNMTGGIDLWSTQVDPTVPRY

SEQ ID NO: 2335 - protein, 376 aa, Oryza sativa (japonica cultivar-group)
MMNGGGGGRVPTWRERENNRRRERRRRAIAAKIYAGLRAYGNYTLPKHCDNNEVLKALCNEAGWTVEPDGTTYRKYWSLDRIEAAHVKKGLVKEAIMETKGCKPPASELADQLGRSPSASPCSSYQPSPRGTSSFPSSGSSSQITLGGGGGGEGSSLIPWLKTLSSAGVGIGGGSSSKFPAHYSYFGGGSISAPVTPPSGSPPRTPRLKTAAWEEYHHHHAGSVLPPWATVGASYAYAASSSLPNSTPPSPRRKVAAAAAAAGGGNDAAAWLAGFQISSAGPSSPTYSLVAPPPNPFGAAAAAAGSSSRVMSGACSPVAGGDVQMADAARREFAFGGEGGKMTGLVKAWEGERIHEECGSDDLELTLGSSMTRGDR

SEQ ID NO: 2336 - protein, 388 aa, Avena sativa
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 2337 - protein, 524 aa, Apium graveolens var. dulce
MAGAFNVSGDDSGGSKDVGSPVIFDAVKKPKRNKYAFGCAILASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIGVGYALMIAPVYTAEVSSASSRGFLTSFPEVFINIGVLLGYVSNYAFSKLPANLGWRFMLGIGAIPSIGLAIGVLGMPESPRWLVMKGRLGEARQVLDKTSDSKEESRLRLSDIKQAAGIPEECNDDIVVMPKRRNDEAVWKELLLHPTPSVRHAFIAGVGLHFFQQSSGIDAGGLYSPRIFEKAGITSTDLKLLATIAVGISKTLFILVATFLLDRIGRRPLLLTSMGGMIISLTLLGTSLAVIDHSDHTVHWAVALAIFGVLAYVGTFSIGLGPIAWGYSSEVFPLRLRAQGCSIGVAVNRGTSGIISMTFLSLYKAISIAGAFYLFAAIAGVAWIFIFTLLPETQGRSLEEMGLLFGTYFGWRKTLKGLKNREAEEAKNANVI

SEQ ID NO: 2338 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTAVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 2339 - protein, 448 aa, Nitrosomonas europaea ATCC 19718
MIQFSSDRQLKFRKYWLIYAVFATMLAADVFAQSSYSREDIKPIDRIVAVVNEEVITQQEINEVLQNTVQQLQRQNTQLPRMEILEKQLLERLILKRIQLQRAKEIGLTVSDNDLDQTLRRIIQDNHLTMDEFRQVLLQEGTDMNRFREEIRGEILMSRLKEQEVNSRVNVTENEIDNFLQNQANSPAGNEEYRIAHILVQISEQMDEAQIEARHKRAETAYESLRQGADFVRVSAEFSDAPDAMQGGELGWRPLGQLGSPFTEMLVNMQPGEVTPVVRSPVGFHILKLLERRQQEQKVTIIEQTHAQHILIKVSELVSEEDAHQLINQLMERIHNGADFMDVAKAHSEDASASAGGDLGWVSPGDTVPEFEQAMNALLPGQVSPPVRTPFGWHLIKVIERRSQDVSERQQREAARHTIHARKADAIVQEWLQQLRDQAYVEYKVEDN

SEQ ID NO: 2340 - protein, 444 aa, Pseudomonas syringae pv. phaseolicola 1448A
MLPPETQRLIEQHGIKYVLAQFVDIHGSAKTKSVPVTGLEMVAEDGAGFAGFAICGMGMEPHGPDFMARGDLSSLTPVPWQPGYGRVVCIGHVDGKPWPYDSRYVLQQQVERLSQRGWTLNTGLEPEFSLFKRDAAGSLQMVDASDNLDKPCYDYKGLSRSREFLERLTEALQPVGFDIYQIDHEDANGQFEINYTYSEAMESADRFTFFRMAAGEIANDMGMICSFMPKPDPKRAGNGMHFHLSIASASSKNLFHDASDPSGMGLSKMAYHFAAGLLAHGPALCAFAAPTVNSYKRLVVGNSLSGATWAPAFIAFGANNRSAMVRVPYGRLEFRLPDAGCNPYLVSAAIIAAGLDGIDRQLEIDHVCNENLYTLSLEEIAARGIKTLPQSLKEACDALEADPLFAEVLGNEIVGEFLRLKRMEWVEYSRHVSDWEVKRYIEFF

SEQ ID NO: 2341 - protein, 531 aa, Silicibacter pomeroyi DSS-3
MAPKVLISDKLSDAAVQIFRDRGIDVDFQPDLGKDKDKLAEVIGQYDGLAIRSATKVTEKILENATNLKVIGRAGIGTDNVDKDAASKKGVIVMNTPFGNMITTAEHAIAMMFAVARQIPEASASTHAGKWEKSKFMGVELTNKTLGVIGAGNIGGIVCDRARGLKMKVIAYDPFLGEEKANKMGVEKVELDDLLKRADFITLHVPLTDQTRNILGRENLAKTKKGVRIINCARGGLVDEEALAEMLQSGHVAGAAFDVFSVEPAKENPLFGLPNVVCTPHLGAATTEAQENVALQVAEQMSNYLLTGAVENALNMPSVTAEEAKVMGPWIALAGHLGSFVGQMTDEPIKAINILYDGTASTMNLAALNCATVAGIMKKANPEVNMVSAPVVAKERGIQISTTNQDKSGAFDGYVKVTVVTAKRERSVAGTVFSDGKPRFIQIKGINVDAEIGAHMLYTTNEDVPGIIGTLGQTMGENGVNIANFTLGRAAAGGEAIALLYVDEPVPAEARAKLAETGLFNQIKPLEFDVA

SEQ ID NO: 2342 - protein, 257 aa, Nitrosomonas europaea ATCC 19718
MRHTPRKRFGQHFLVDTSVIAEIIHIIHPVPGDRMIEIGPGLGALTKPLLNVLDELQVIEIDRDIVDYLSRTYPGKLVIHNIDALKFDFSELGEGLRIIGNLPYNISTPLLFHLSRFSSLITDMYFMLQLEVVERMVALPSTPDYGRLSIMLQNRFEMEQMLVVPAESFDPPPRVQSAIVCMRPKAEPTIPLKHERLFAELVSAAFSQRRKTLRNTLRHYLTADDFERLEIDSGLRAENLSLAQYAAIVRQVYEDRQ

SEQ ID NO: 2343 - protein, 181 aa, Debaryomyces hansenii CBS767
MRSLTEEETKIVFEKLANYIGRNISFLIDNPTNPHVFRLQKDRVYYVSEQIANFATSVSRHQLMSIGTCFGKFTKTGKFRLHITALPYLAQYAKFKVWIKTNGEMPFLYGNHVLKAHIGRMSDDIPEHAGVIVYSMNDVPLGFGVSAKSTNEARALQPTGIVAFRQGDIGEYLREEDTLFA

SEQ ID NO: 2344 - protein, 581 aa, Oryza sativa (japonica cultivar-group)
MTICSCEETINEFEMLTRDAARVQKDTLKKILEINASAEYLQNFGLGGRTDAESYKSCIPLCVHNDIEPYIQRIVDGDTSPVVTGEPITNLSLSSGTTHGKPKFIPFNDELLETTLQIYRTSYAFRNREYPIGQGKALQFVYGSKQVITKGGILATTATTNLYRRQRYKEGMKDIQSQCCSPDEVIFGPDFHQSLYCHLLCGLIYSEEVHSVFSTFAHSLVHAFQTFEEVWEDLCTDIRDGVLSKKVTAPSIREAVSKILKPNPELADSIYKKCIGLSNWYGVIPALWPNAKYVYGIMTGSMEPYLKKLRHYAGNLPLISADYGASEGWVGSNIDPTVPPEQVTYAVLPQVGYFEFIPLEKPIGEETENSASIHYIESDPVGLTEVEVGKIYEVVITNFAGLYRYRLGDVVKIARFHNSTPELQFICRRSLVLSINIDKNTEKDLQLAVEEASKFLEGEKLEVMDFTSFVERSSDPGRYVIFWELSGDASDEVLSSCANALDLAFIDAGYTGSRKIKTIGPLELRILRKGTFKEILDHFLSLGGAVSQFKTPRFVNPSNSKVLQILSRNVTQSYFSTAYGF

SEQ ID NO: 2345 - protein, 221 aa, Triticum aestivum
  misc_feature (213)..(213): Xaa can be any naturally occurring amino acid
  unsure (1)..(221): unsure at all Xaa locations
MFNRLFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRTGAKAMKAMQKATNIDDVDKTMDEINEQTENMKQIQDALSAPLGASADFDEDELEAELEELEGAELESQLLEPVVTIPIHTTPVPGKAQPTRPAPQKASAEEDELAXALQAEMAL

SEQ ID NO: 2346 - protein, 303 aa, Arabidopsis thaliana
  misc_feature (219)..(219): Xaa can be any naturally occurring amino acid
  misc_feature (292)..(292): Xaa can be any naturally occurring amino acid
  unsure (1)..(303): unsure at all Xaa locations
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASEYKSAGLPLNLLINNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEXIMTNLWGYFNSYLAGAVGAVAKYMVKSVPQGAATTCYVALNPQVAGVTGEYFSDSNIAKPIELVKDTELAKKXWDFSTKLTDSQ

SEQ ID NO: 2347 - protein, 157 aa, Brassica napus
MATTTTTSGVYIHVIEDVVSKVREEFVNNGGPGESVLAELQGIWETKMMQAGVLSGPIERSSAQRPTPGGPLTHDLNVPYEGTEEYETPTAEMLFPPTPMQTPLPTPLPGTADNSSMYNIPTGSSDYPTPGTENGSHVDVKARPSPYMQPPSPWTNP

SEQ ID NO: 2348 - protein, 483 aa, Mesorhizobium sp. BNC1
MSGRKYPNPSLFINGRSVTGRGAKEEMVIDPSNEEVLGSYRSAAPEDLQELLDSAAAGFEKWRRTSAYERCEILHKVAAALRENAQEIGSLLTLETGKILSESITEVRGAADHFDWSGEEGRRLYGYTVPARRAESRLRVELEPLGIVFALIPWNFPLGTSARKVAPALAAGCSVILRPPEEAPATVEAFVRCCQEAGLPPGVLNMVLGSPKDVVEPLMASFSVRAVTFTGSTRVGKILIQQAADTVKHLVLELGGHAPAIVLPDADPKKVGVAAARAKFRNAGQVCVSPSRFIVHEKIVEPFTQAMVEETRSIKLGSGFDAGAQMGPLTTARQRERVERLVEDARSKGARILAGGQRPSGFNRGFFFEPTVLGDVPDTALIFEEEPFGPVAPIIPVRSVQEAVEKANAVKWGLAGYLFTSSLADATKVSEAMQVGMVGLNTFAAAAPEAPFGGVKESGYGRECGLEGIREFVSSKLIHTDIG

SEQ ID NO: 2349 - protein, 306 aa, Streptomyces globisporus
MRTRRRWSAADVPDRTGTTAVVTGASSGIGLHLAQELARHGAHVVLAVRDPDRGVAAAARIQSRVPSAQLTVRRLDLSRLASVRAGAEELRDRFPRIHLLVNNAGVMWTDRARTPDGHELQFATNHLGHFALTGLLLDSLRAAPGARVVTISSYLHRLGRIDFSDLHGERRYSRYRAYNQSKLANLMFALELHHRLAESGAELASLAAHPGLTATGLGRDFPAPVRRLGSPLAPLFLQPAAAGMLPGLRAATDPGARGGEFYGPLGVTETRGAPGLVRPGGAAVDPRARRRLWEESEHLTGVRLRP

SEQ ID NO: 2350 - protein, 358 aa, Glycine max
MSHFKGKYHDELIANAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 2351 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 2352 - protein, 389 aa, Pyrococcus abyssi GE5
MAMSDRLDLVNPSEIRKLFDIAAGMKDVISLGIGEPDFDTPQHIKEYAKEALDMGLTHYGPNIGLPELREAIAEKLKKQNNIEADPNKEIMVLVGANQAFLMGLSAFLKDGEEVLIPTPAFVSYAPAVILAGGKPVEVPTYEENEFRLNVDELKKYVTEKTKALIINSPCNPTGSVLKKKDLEEIADFAVEHDLIVISDEVYEHFIYDDVKHYSIASLDGMFERTITVNGFSKTFAMTGWRLGFVAAPSWIIEKMVKFQMYNATCPVTFIQYAAAKALRDERSWKAVEEMRKEYDRRRKLVWKRLNEMGLPTVKPKGAFYIFPRIKDTGLTSKEFSELMLMEAKVAVVPGSAFGKAGEGYVRISYATAYEKLEEAMDRMEKVLREKKLT

SEQ ID NO: 2353 - protein, 279 aa, Thermococcus kodakarensis KOD1
MRDRLFSIIYKYNLHPNRDLGQNFLIVPDIIERNIERAEVGEKDTVLEIGPGLGVLTDPLSKRAGKVYAIEKDCRIVEILRREYNWPNVEIIEGDALKVEWPEFNKMVSNLPYQISSPVTFKLLSREFERAVLIFQLEFAERMVAKPGDKNYSRLSLMVRAKARAELVERIGKGAFWPRPKVDSAVVVLEPKPPEERIDLNENLVKALFQHRRSTVSAALKKSAHMLGLSKDKARELRQVFSRVPHSERRVFQLSPEDVLEIEEFLKKEGVIESYPASP

SEQ ID NO: 2354 - protein, 471 aa, Zea mays
MGSNNASCALSVLLLIIICAAAALRADASQADRLREFIRSRRNSPSDDKGSFKVTNLAQRVATSSLLSTSSYSDSEQSAMKAADKITSLPGQPDGVDFDQYAGYVTVDETNGRALFYYFVEAPQDASTKPLLLWLNGVANVIFLESPAGVGFSYSNTTSDYDLSGDQRTADDAYLFLVNWLERFPEYKSRPFYISGESYAGHYIPQLAATVLIQNSYNSKTAINLRGILVGNPLLDWNMNFKGAVDYYWSHGLMSDEVFDNITRHCNYDNSDGAACNGAVDVIDPGQIDPYNIYAPICVDAANGAYYPTGYVRHLLTILNLPGYDPCSDYYTYSYLNDPAVQNAFHARMTSWSGCANLNWTDAPISMVPTLAWLIEKKLPVWIFSGDFDSVCPLPATRLSINDLKLRITTPWRPWTVNMEVGGYVQQYKGGFTFASVRGAGHMVPSSQPERALVLLDSFFKGVLPPYVPEQ

SEQ ID NO: 2355 - protein, 128 aa, Arabidopsis thaliana
  misc_feature (6)..(6): Xaa can be any naturally occurring amino acid
  misc_feature (14)..(14): Xaa can be any naturally occurring amino acid
  misc_feature (21)..(21): Xaa can be any naturally occurring amino acid
  misc_feature (23)..(23): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (38)..(38): Xaa can be any naturally occurring amino acid
  misc_feature (78)..(78): Xaa can be any naturally occurring amino acid
  misc_feature (97)..(97): Xaa can be any naturally occurring amino acid
  misc_feature (102)..(103): Xaa can be any naturally occurring amino acid
  unsure (1)..(128): unsure at all Xaa locations
MASSMXSSATMVAXPAQGHMXSXPLKGXKXSXAFPATXKANNDITSITSNGGRVNCMQVWPPIGKKKFETLSYLPDLXDSELAKEVDYLIRNKWIPXVEFEXXHGFLYRHGTQPGILMGGCQGSFFSV

SEQ ID NO: 2356 - protein, 353 aa, Mycobacterium tuberculosis CDC1551
MKTTDVRVRRAITAMAGGHAVVLTGDPNGDGYLVFAAQAATPRLVAFAVRHTSGYLRVALPGAECERLHLPPMCDRDTTHCVSVDVRGTGTGISASDRAWTIAALASATSVAADFQRPGHVVPVQAQADGVLGRRGPAEAAVDLARLAERRPAAALCEIVSPDNPVQMAHHAESVEFAVEHGLAMVSIGELVAYRRRIEPQVVRFTAATLPTWAGASRVIGFRDVYDLGEHLAVIVGAVGAGVPVPLHVHIECLTGDVFGSTACRCGEELNGALARMSAQGSGVVLYLRPPGPAQACGLFARGDAATDVMPETVTWILRDLGVYAIRLSDDVPGFGLVMFGAIREASTLAAAG

SEQ ID NO: 2357 - protein, 276 aa, Zea mays
MASSLSFVSSSHLTLRTPSLTLRKLSPPRTSVSFSVKAQSVALSQDDLKKLAAEKAVEAIKPGMVLGLGTGSTAAFAVDQIGKLLSSGELHDIVGIPTSKRTEEQARSLGIPLVALDTHPRIDLAIDGADEVDPNLDLVKGRGGALLREKMVEAVAERFIVVADDTKLVKGLGGSGLAMPVEVVQFCWKFNLVRLRDLFKEFGCDAKLRVGEGGEAYVTDNSNYIIDLYFKEPLKDGFAAGREIGKLEGVVEHGLFLGMATSVIIAGKNGVEVMNK

SEQ ID NO: 2358 - protein, 404 aa, Streptococcus suis 89/1591
MKQFNKSTKLDDVAYDIRGPVLEEAMRMRANGEQILRLNTGNPAEFGFTAPDEVIRDLIHNARKSEGYSNSKGIFSARKAIMQYCQLKKFPNVDIEDIYLGNGVSELIVMSMQGLLDNGDEVLVPMPDYPLWTAAVSLAGGKAVHYVCDEAAEWYPDLADMESKVTSRTKAIVLINPNNPTGALYPKEILKGIIDIARRHELIIFSDEIYDRMVFDGAVHIPIATLAPDLFVVTMNGLSKSHRICGFRVGWMVLSGPKKHVKGYIEGLNMLSNMRLCSNVLAQQVVQTSLGGYQSVDELLMPGGRLYEQREFITKAINDIPGLSAVKPKAGLYVFPKIDREMYRVEDDEQFVLDFLKQEKVLLVHGRGFNWKDPDHFRIVYLPRVDELAEIQEKMSRFLRQYRR

SEQ ID NO: 2359 - protein, 400 aa, Bordetella bronchiseptica RB50
MSIVADKIKRIKLSPSVATRAIVAQLREEGRRVIDLTVGEPDFSTPAHICEAAIAAMQRGETKYPPAQGTMALRKAVRARLREETGVDYPEGHIIVGTGAKQVLYNGLAATLNEGDEVIIPAPYWVSYPDMVLVNGGVPVAVTATPATQYKLTPQALEAAITPRTKWLMMNAPSNPTGAIYTADEWRGLAEVLRRHPHVWLMTDDIYARLNFTATPTVHPLQVAPELAERTLVVNGVSKAYAMTGWRIGYGAGPEALIKAMAILQSQSTSGACSISQAAAREALAGPQDCVAEFARTFKARRDAAVAALQGAPGLSVVMPEGAFYVFPDCAGVLGKTTPDGRVLETDTDFVHYLLREAGVAVIDGTPYGVPGTFRLSFAAALEDIQQGCAAIRAACERLA

SEQ ID NO: 2360 - protein, 214 aa, Oryza sativa
MAGAAKASWMVAMSVGAVEALKDQGGLCRWNYALRSIHKAAKANAAGVSQGKKLPASAAAVAERRRAEKAEEGLRTVISLKVLLKQLKVIRHAWILEESDVQSGTIAQDRRLLLVLPANAGSREHWRVQKVRSCISLIYGATFSCRLCQLSRASEYSLASHNTGDPLTCSYLVPSYGTAFGIKGCDRYCLLLQQLWLQELKMAAAAAAEKQPQP

SEQ ID NO: 2361 - protein, 300 aa, Streptococcus thermophilus CNRZ1066
MHFYLISFKIILLQLEKENRMETYTLSNGVTIPKIGFGTWQIPEGEEAYNSVSFALKAGYTHIDTAQIYGNEVSVGKAIADSDVAREDLFLTTKLWNDKHDYDLAKASIDESLERLGVDYLDLFLIHWPNPKALRENDAWKVGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 2362 - protein, 377 aa, Glycine max
MAHLALSQMAVTVPVGSDLSLRRSAVKAPNFNFWDKSWAPVFTLYLKANNSSLRSRHVVFMSVQQASVPKVNVSPLELEDAKEPPLNLHKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFLESVPTYKFGGLAWLFLGVANTDSLLYDEEFSKYLNDYSDNFRYDRALSIEQKNKNGGKMYVQDKIEEYSDEIFKLLDNGAHIYFCGLKGMMPGIQDTLKKVAEQRGESWEEKLSQLKKNKQWHVEVY

SEQ ID NO: 2363 - protein, 174 aa, Solanum tuberosum
MMSGPAVHPVEAPPMTMAAPMVRMKDFQGMPGTLGSLFLRLCQFVFAVISICVMVTTSDFPSVTAFSYLVAAVGLQIIWSLVLAIADVYAILVKRSYRNVAIVSLFAIGDGITSTLTFAAACASAGITVLISNDLEKCKVNHCARFMSATAMAFLSWFAASPSFFLNFWSLASR

SEQ ID NO: 2364 - protein, 278 aa, Streptomyces nogalater
MTNSGTRPQEVADFYDGSSRLIAELNGGSLHFGCWDSLPADAGMDRASQRLTEMMTERIEVGPGQRVLDIGCGTGAPAVQLARATGAEVVGITISPEQVRLATAHAEREGVAERVTFRCADASAELPFPADSFDAVWFFESIFHLPDRLTALRRAAEVLRPGGRLALTDVLHNDETSPAAQESLDEHAYTPLVGEPMRLSDYPPLLRQARLVPVECRDISELTVGRTLECMHRTLDENRERFVERYGSELVDQFSTAVPLLDAVEFGYGIVTAARPDH

SEQ ID NO: 2365 - protein, 479 aa, Salmonella enterica subsp. enterica serovar Typhi
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTASDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRSWGKYNVIDSGKNYLVRCITVKPGEKFVAQMHHHRAEHWIVLSGTARVTKGEQIYMVSENESTFIPPDTIHALENPGMIPLQLIEIQSGTYLGEDDIIRLEQRSGFSKEWTNERS

SEQ ID NO: 2366 - protein, 390 aa, Pyrococcus furiosus DSM 3638
MRNMNIEEIRNSFLSGRPAVLIDEERENEADLVFPAEIATPKVVNFMLSAKGLLCLALDMEEGIKRGFFKLPNNGGETNFLIPVDYKDVFTGITAEERALTARKVAEGLGIENFRYPGHLPLLGGLGLNKRKGHTEASLELVEMAGFKRYALIIEILDDKGYSHNLDYAFHFAKEHDLPLIRIREIWKEFVRRKQLIHVYSKAKLPTKYGDFEIYSFKNDLDFKDHVALVKKPFKGTPLVRVHSKCLTGDTLGSLKCDCGSQLENALRTISQEGGVLIYLDQEGRGIGLREKIRAYEFQDRGLDTVEANKALGFAPDERTYEVAFQILRALGIEKIKLLTNNPSKVKALRELGIEIEDVIPLPGEINRYNFFYLKTKVEKLGHKIPGVEV

SEQ ID NO: 2367 - protein, 444 aa, Burkholderia pseudomallei K96243
MQDIDEFLKKHRITEIEAIIPDMAGIARGKIIPRSKFETGESMRLPQAVMIQTVTGDYPEDGSLTGVTDPDMVCLPDASTIRLIPWAIDPTAQVIHDCVHFDGTPVEISPRRVLRRVLELYKAKGWKPVIAPELEFYLVDMNKDPDLPLAPPIGRTGRPETGRQSYSIEAVNEFDPLFEDIYEYCEVQDLEVDTLIHEVGAAQMEINFLHGDPLNLADRVFLFKRTVREAALRHHMYATFMSKPMENEPGSAMHVHQSIVDEETGRNLFTGDDGGPTDMFYAYIAGLQKYTPALMPIFAPYINSYRRLSRFMAAPINVQWGYDNRTVGFRVPHSSPVSRRVENRIPGVDCNPYLAIAGTLAAGYLGMTRRLEPTEPLASDGYSLPYQLPRNLEEGLTLMSACEPLAEILGEKFVKAYLALKETEYEAFFRVISSWERKHLLLHV

SEQ ID NO: 2368 - protein, 432 aa, Trichodesmium erythraeum IMS101
MVVTTLNTTKSEEIFAAAQKLMPGGVSSPVRAFKSVGGQPIVFDRVQGAYIWDVDGNQYIDYVGTWGPAICGHAHPEVLNGLKEVLEKGTSFGAPCALENTLAKMVIDAVPSIEMIRFVNSGTEACMAVLRLMRAFTGRDKVIKFEGCYHGHADMFLVKAGSGVATLGLPDSPGVPKHVTKNTLTAPYNDLETVKKLFEENPDQISGVILEPVVGNSGFIVPDAGFLEGLRMITKENGALLVFDEVMTGFRIAYGGAQEKFNVTPDLTTLGKIIGGGLPVGAYGGRQDIMSMVAPAGPMYQAGTLSGNPLAMTAGIKTLELLKKPGTYDQLNKITKRLADGLLNIAKETNNDIWGGHISAMFGIFFNKGPVHNYDDAKKSDLTKFSKFHRGMLEHGIYLAPSQFEAGFTSLAHTEEDIDRTLATAKKVMSSL

SEQ ID NO: 2369 - protein, 1097 aa, Oryza sativa
  misc_feature (211)..(211): Xaa can be any naturally occurring amino acid
  unsure (1)..(1097): unsure at all Xaa locations
MESSSSVIFLGTGCSGALPDARCLIHPSTPPCPVCSYSLSLPPERNPNYRCNTSLLIDYCQHDGIHKYILIDVGKTFREQVLRWFSHHKIPYVDSIILTHEHADAVLGLDDVWVVQPSGCRNGLGKVPIFLTHFTMNSVAARFPYLLKNKLEEGDEGSQVIQLDWTIIEGDIDKPFVSSGLEFVPLPVMHGEDYVCLGFLFGRRSRIAYLXSDVSRILPRTEHAISKSGAGQLDLLILETNELHGEGDAGSCHLTLSQTLNAVKRISPKRALLIGMNHEFEHHKENQTLAEWSSSEIIVEHFRIIPFACFKRKRKFHLLSSSSGVSSAAAAGRAISLPGCPDKCGDVSIPYPFGVGDRCAAVGLNPYFNITCDDAVRPPVPKLGDPGMEAEVLDITLERGEIRLTGFLSYVCYTSSNSSYASLPGGIFVGGTQLRVSPSRNQLTVIGCRALGLLVGGAHAGGSGDGDEYATGCYTYCASLNSTDADGAPCAGTGCCQAPISSDLAYVGGTFPSNWTNSGWRFNPCFYALIAEVGWYSFRRRHLAGVLGFVNETKPSDIPVVLDWAARDGWCPATAEEKARRKYACVSGNSHCVNSSNGMGYSCSCNQGYEGNPYLDNGCQDIDECTLRRQGRQYEDVYPCKHGICINTPGSYRCKCKAGTKPDGTNFGCQQVLPMAAKVIIGLSACSIFVMALSCMLVIQLQRRKHTIEKQEYFRRNGGLRLYDEMVSRQVDTVRVLTVDELKKATDNFSDARVLGRGGHGTVYRGTLDDLREVAIKRSKAAVDGDGDGGGCKEEFVNEIIVLSQINHRHVVRLLGCCLEVHVPMLVYEFVPNGTLFDLLHGGTAARRRPVSLGLRLKIAAQSAEALAYLHSSASRAILHGDVKSLNILLDGALDAKVADFGASALRSAMGEGESFIEYVQGTLGYLDPESFVSRHLTDKSDVYSFGVVLAELITRKKAVYEDDGGGGGGSGEKRSLSSTFLAASSRGELWRVVDRDIMDGDDVDAVVRELARVAEECMGARGEERPAMKEVAERLQVLRRVEMMEAAAGVEVVDGFNGGGLVGRHGHLDTTTTTTTSYYQSMETDKLQLDVDDLVR

SEQ ID NO: 2370 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 2371 - protein, 195 aa, Oryza sativa
  misc_feature (142)..(142): Xaa can be any naturally occurring amino acid
  misc_feature (153)..(153): Xaa can be any naturally occurring amino acid
  unsure (1)..(195): unsure at all Xaa locations
MAAAARWWVAAVVVAVAAMAGAAKGDFAADKAECADKLMALATCLTYVEEKATARAPTRDCCAGLGQVVAGSKKCLCVLVKDRDEPALGFRINVTRAMDLPSGCSIAATFSDCPKMLNMSPDSKEAEIFQQYAREHESNNGXKPAPAAAAAAXGSAGKATAATGDAGLGRRQRSSLAARAVAAAVLAAVFGLTVA

SEQ ID NO: 2372 - protein, 328 aa, Aspergillus oryzae
MSTTSSTFKSSSGANCHPTALEIIQNNGLEGKLQDKVILITGCSSGIGIDTARALSVTGATLYLTARDLKKAEQALGDLIEKPNVHLLTLNLNSLASVRACAEEFLPKSSQLNVLINNAGVMATPEGRTQDGFETQFGTNHLGHFTLFYLLKPILLASSTPEFNSRVVNVSSLAHRYGEPVFDNINLEGIYEPWRAYGQSKTANIWTANEIERRYGSQGLHAFSVHPGGIRTGLQQYVPKEQKDAWDQDDAISSVWKTSEHGAATTVWAAVAKELEGKGGKYLEDCQIAEKYDPSTGTAGKGYAPWVYDEAKQAKLWEMSLNLAGLHV

SEQ ID NO: 2373 - protein, 551 aa, Burkholderia pseudomallei K96243
MFASVDADAWTRAAETIRTAGGRLVTLWGGEPAAGRYEVCAAYELDDGLLWLRLPVEPAANVGREAGDTSNAGNASNAGDADGVRQRGEAGSYPDLSAIFASATRMQRALHDLVGLRARGAHDTRPWLAHGAWPRDYHPLRRRATGGERFEYATADYPFVPVAGDGVHEIAVGPIHAGVIEPGHFRFSVVGEKVLRLEERLGYAHRGVERLFERADALAGSRLAARIAGDSTVAFAWAYCMALEQALRIRVPDRALRLRALLLERERVANHLGDLGALGNDAGFAVGLAHFSRLKEDWLRMQDRIFGHRYLMDAIVPGGVARDIAAGDAAAIVAQCDRIEREVRAMQTIYDDQSGLQDRFAGTGRLDAQAVAHFGVCGLAARASGQPRDVRADHRLAPYDALRIDVSRDARGDVAARVAVRFAETYESMRAIRALLADLPDDGLAAEIAPGATVPGARADAGGACEGEEGGDAAFCPGDARRRGIGWIEGWRGPVFVALELDARGAVARCHCHDPSWHNWPALEHAIIGNIVADFPLINKSFNLNYAGHDL

SEQ ID NO: 2374 - protein, 436 aa, Triticum aestivum
  misc_feature (109)..(110): Xaa can be any naturally occurring amino acid
  misc_feature (157)..(157): Xaa can be any naturally occurring amino acid
  misc_feature (172)..(172): Xaa can be any naturally occurring amino acid
  misc_feature (180)..(180): Xaa can be any naturally occurring amino acid
  misc_feature (208)..(208): Xaa can be any naturally occurring amino acid
  unsure (1)..(436): unsure at all Xaa locations
METVAAAGYARGAATRSPACCAAMSFSQSYRPKAARPATTFYGESLRANTARMSFPAGRQSKAASRAALTTRCAIGDSLEEFLTKATPDKNLIRLLICMGEAMRTIAFXXRTASCGGTACVNSFGDEQLAVDMLADKLLFEGVEYSHVWQYACSGEXPELQDMGGPVEGEFXVAFDPLDXSSIVGHQTSPGGTIFGVWPGDNFTGLTXGGDQIPAAMGIYALRTTLVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHPPAPKQSVLDKVISQLDERTQVAYGSKNEIIRFEETLYGSSRLAASATVGATAWKSFSPSCFSFFTFFSTCPTRCPILSRKSNHKKKKKQQGGR

SEQ ID NO: 2375 - protein, 509 aa, Triticum aestivum
  misc_feature (187)..(187): Xaa can be any naturally occurring amino acid
  unsure (1)..(509): unsure at all Xaa locations
MAFVSFLELSLSLLCFVVFYYFHARSKRKNPVIPLEWPLVGMLPALLANLPRLHDWVTSLLTASPLNFRFVGPPRSGMELFLTSDPANVRHVFTSNFANYPKGPEFAEIMDILGGGIFNADGDSWRRQRAKAQLLMSGPRFRAFVTRCSRRKVERDLLPLLAHVAGGGTGVCDLQDVFLRLTFDTTXTLVFGVDPGCLAIGFPEVPFARAMDDAMDVLLVRNVLPPSWWKLVRWLGVGYERKMAVAWRDIDRFIGETIAKRREAVKARGGIEDSADLLSSYIDDDDEASTVVDAFLRDTTMNLMLAGRDTTGSGLSWFFYLLTRNPGVVSKILAELDTVSSSTTTPDGMVTYDPDELGRLTYLHAALCESLRLYPPVPMEHKGVVAAEALPSGHEVRPGDKVMVSLYAMGRMEAVWGKDCREFRPERWIGEDGKARYVPSYKFVSFNSGPRTCLGKDMAFVQLKAVAAAVVRNFEVEAVPGHAVEPKISIILHIKNGFKARIKRRHADA

SEQ ID NO: 2376 - protein, 314 aa, Solanum ochranthum
KINFNKVPLYYRNVSGGSRLVSIRAQVTTEAPAKVEKISKKQDEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 2377 - protein, 123 aa, Solanum carolinense
EQHAMLNDCGKKFNDIMDPRESKELDKRWPDLKNRESIATKTQSFWRYEYNKHGTCCSERYNQKEYFDLAMNLKDKFDLLQILKSQGITPGDSYPVDKIEQAIRAVTHEYPNLNCIDNRKKLM

SEQ ID NO: 2378 - protein, 265 aa, Bradyrhizobium sp. BTAi1
MTLTLTILGCGSSAGVPRPALGWGACDPNNPKNRRRRCSLLAERRAAHGVTRVVIDTSPDLREQLIDTQVDHIDAVFLTHEHADQTHGIDDLRSVVMHQRRRIPVYLNQSTAKDIMHRFSYCFVSPPGSDYPPILTQHAIEAGETQAVEGKGGELKLTAFLVQHGNIPALGYRIGNAAYTPDLNDIPEESWGALEDLDVWIVDGLRPASHPSHFSVNDALAWIERFKPRRAVITNMTADLDYEVLRQSLPDGVVPAYDGMRLEVG

SEQ ID NO: 2379 - protein, 481 aa, Arabidopsis thaliana
MELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSDHGGFDGIIPRNACHWNMRIHHNLWHCKRLLRDVLRHWKISRKTGLMVE

SEQ ID NO: 2380 - protein, 478 aa, Arabidopsis thaliana
MDLEEQERDILIQTDDDDCHVDVSYVNDDDDSNASFSLSQNDSAFWPQSYRHSVDLLTGVTPPMVSFIQGRSTETSFSSSIASLYKRRPTSIANSFVSSTSKQPLLSEKDDVSFLSSQVGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKALDLANLPVAIGIFGFGFSGHAVLPSIYSSMKEPSKFPLVLLISFGFCVFFYIAVAICGYSMFGEAIQSQFTLNMPQQYTASKIAVWTAVVVPMTKYALALTPIVLGLEELMPPSEKMRSYGVSIFIKTILVLSTLVVALTFPFFAIMGALMGSFLATLVVSHRLT

SEQ ID NO: 2381 - protein, 126 aa, Arabidopsis thaliana
  misc_feature (84)..(84): Xaa can be any naturally occurring amino acid
  unsure (1)..(126): unsure at all Xaa locations
FLDLSVQLCLPVTSKFADELIANAAEGGRPATGSLAADESTGSSGKHRASINVHNVENNRRKLRELLFSAPGALPCLTGVTRFXHTLYQKSSDGKLFVDNLKERRVLPCHKVENSNVALPGTDSET

SEQ ID NO: 2382 - protein, 69 aa, Glycine max
MNRSRCSESSTKPNNNSPKRKPPFKPAKDDTKPVLQDPILRSDPIETEEAVLRLPPFKIPTSTSTPEMT

SEQ ID NO: 2383 - protein, 149 aa, Anabaena variabilis ATCC 29413
MERTFLAIKPDGVQRGLVGEIIRRFETKGFTLVGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 2384 - protein, 751 aa, Arabidopsis thaliana
  misc_feature (217)..(217): Xaa can be any naturally occurring amino acid
  misc_feature (227)..(227): Xaa can be any naturally occurring amino acid
  unsure (1)..(751): unsure at all Xaa locations
MEEDRATMTGAVATRDSVEPSEDILICVDVDAESTVEMKTTGTNGKPLNRLECLKLAITRFIHDKLSRNSDHRFAFATLSQSAAWLKKEFSNDAKSAAASLREMSATRSSGPADLTFLFQEAAQEAKTSRAQNRILRVILMYCRSSVRPTHDWPINQKLFTLDVMYLHDKSGPDNCTHDVYDSLGDAIERVSEYEGYIFEGSHGLSQSGFRRMSTVXSHPPQRCAQXVDLPKPPAKKPAVSCDKSASDSTKGAKQPLEKKPKTNTKRIHSLGKEKTSDFKKYDEKIVGSRVKIWWPLDRAYYEAVVISYCSAKERHRDKEANQTGCDEEASTMPQKKKAKTRKEQSTNKQSKMLSPFPPNVKKDDEVPQISRRQAEQVLSNCASQIKKYLTEAGKLSSVSLANPSDVVDSICGRAFDALKQEDVVANEKEDRQGPREAAVKACFFLPETSIETLKSFICKKKMNVILAYVGTISSMNENGHKILEMVQQPVAEEEDLAETKTKTYKRARVESSSVHKADGEMEKEAAEGEPSCRSHKSSAEPGDLQPKNLPEPCSVTQQLAKVKQSILDTVASVRQFRCELERKEQSIADTLSIVRQFRSEIEEKEDMLEASLLEIDVLGLSDNVMFGTNRGEDIGNQQNPQLKIIKWIANSTGILKLVGRLSNVVDNQREVIFLYSVITRSSLKTVDFLNVKSKTNSGSYRHHFFDDLTKFEVTAIANTDRFNQKKAPRNCIASITEVKESLLCPSGTTQ

SEQ ID NO: 2385 - protein, 350 aa, Thermococcus kodakarensis KOD1
MAEKMQAIMKTKPAYGAELVEVDVPKPGPGEVLIKVLATSICGTDLHIYEWNEWAQSRIKPPQIMGHEVAGEVVEVGPGVEDLQVGDYISVETHIVCGKCYACKHNRYHVCQNTKIFGVDMDGVFAHYAIVPAKNAWKNPKDMPPEYAALQEPLGNAVDTVLAGPIAGRSTLITGAGPLGLLGIAVAKASGAYPVIVSEPSEFRRKLAKKVGADYVVNPFEEDPVKFVMDITDGAGVEVFLEFSGAPKALEQGLKAVTPGGRVSLLGLFPREVTIDFNNLIIFKALEVHGITGRHLWETWYTVSSLIQSGKLNLDPIITHKYKGFDKFEEAFELMRAGKTGKVVFFPHKG

SEQ ID NO: 2386 - protein, 532 aa, Aspergillus oryzae
MLTLSFSALLGIALAWAIHRLAWKYSRLKAICVKRDNKLATQYGCEQPPRLRNWWPLGIDRLIQIWTADSEQRLMDLFTFPFKDVGYTLEQKFLGTIAFGTIDPENLEAIMTNINVFSFGLRRHILFPLLGDGIFTQEGKSWRHSRELLRPQFTRQHYRDLNIFRPHVDRLLHYLTGNGAATDLQPLFFRLTLDTTTEYLFGKSVNSLMPGEATKGQSFANHFDMAQNYVVQRFRLLDLYWLIGGPKFWRSCSAVHRFIDEIIDTRMDSKEKDKDCNSKSIFFDAVARDSRTRRDLRDQLTNVLLAGRDTTACLLSWTFHCLARHPDVLGRLNVEIASVVGTNTDLTRDDFKRMPYLDQVLREVLRLYPPVPVNTRTAHKTTILPTGGGKDGTKPFMVREGENVAFCVYAMHRREDLYGPDAGQFRPERWDEDLPLFQNERTATWGYLPFNGGPRACLGQDFGFVEAAYTVVRILQKYPIVKPDMYKGDIQGRKWLGWSSHQPEGIEMVTEERQKMTIVLSLGDGCRVTLGR

SEQ ID NO: 2387 - protein, 125 aa, Solanum carolinense
SIILHDCPVDKKDRYFTITDHKKLIALDKRWPQLKLDYFSGINDQDLWRHEFQKHGSCGIKRYKQTAYFDLAMKLKDKFDLLKILRNNGINPGSTYHLKNIESAIMTVSGKIPSLKCIEKPPGNV

SEQ ID NO: 2388 - protein, 479 aa, Alkaliphilus metalliredigenes QYMF
MNCKMYIDGQWVEGKEGEKLEVVNPATGDILVYIAKAGYAETERAIESADKAFKTWSKTTAGERANYLTKLYHLMIEHKDEIAKIMTLEQGKPLQEAMGEVVYGAGFVEWYAEEAKRVYGETIPASKENKRIMVLKQPVGVVAAITPWNFPAAMITRKMAPALAAGCTVVLKPASSTPLTAIKIFELCEKAGFPKGVVNLVIGDASKIGETLMNDFRVRKLTFTGSTEVGKKLMTQAGATVKRISLELGGHAPFIVFDDADLDKAVTGALNSKLRNCGQVCVASNRFYVQEGIIDDFILKMKEKLKNYKIGSGLEEGVHLGPLIDQNAYEKVKTHIEDAVNKGAKIEFGGEGFHRGSSAAGGYFYQPTLLSNVTEEMLIMKEETFGPVIPVVSFKSEEEVIARANDTKYGLAAYFFTQSLAKGFRVSEALAYGIVGVNDGVPSTPQAPFGGFKESGIGREGGHYGIEGFLETKYVSFEI

SEQ ID NO: 2389 - protein, 363 aa, Arabidopsis thaliana
MPAPYKQPNSPKRTTGEVVAKNANGPSNNMGARIFTFRELATATKNFRQECLIGEGGFGRVYKGKLENPAQVVAVKQLDRNGLQGQREFLVEVLMLSLLHHRNLVNLIGYCADGDQRLLVYEYMPLGSLEDHLLDLEPGQKPLDWNTRIKIALGAAKGIEYLHDEADPPVIYRDLKSSNILLDPEYVAKLSDFGLAKLGPVGDTLHVSSRVMGTYGYCAPEYQRTGYLTNKSDVYSFGVVLLELISGRRVIDTMRPSHEQNLVTWALPIFRDPTRYWQLADPLLRGDYPEKSLNQAIAVAAMCLHEEPTVRPLMSDVITALSFLGASSNSSNTGSNHLQQNRSNKYQDAVQWDSSPRYANSQM

SEQ ID NO: 2390 - protein, 615 aa, Zea mays
RVRCAILLSPAPVAPTESRPVRRISPSAPDGALRPKPAVLVAEKLSEAGLAVLRQFADVECAYGMSPAELLAKAAQFDALIVRSGTKVTREVLEAGQGRLRVVGRAGVGIDNVDLQAATEVGCLVVNAPTANTIAAAEHGIALLASMARNVSQADAALKAGKWQRNKYVGVSLVGKTLAVMGFGKVGSEVARRAKGLGMHVIAHDPYAPADRARALGVELVSFDEAIARADFISLHMPLIPTTSKIFNDESFAKMKTGVRIINVARGGVIDEDALVRALDSGKVAQVGDHNFVRFFNVSTYMDVSLKAEFFFYACMTNVEQAALDVFTVEPPPKDSKLVLHENVTVTPHLGASTVEAQEGVAIEIAEAVVGALRGELAATAVNAPMVPAEILSELAPYVSLAEKLGRLAVQLVAGESGIKGVKVVYTTARGPDDLDTRLLRAMVTKGLVEPVSSTFVNLVNADYTAKQRGLRLTEERVAHDSPAAEAPLESVQVRLSHVQSKFAGAISDGGDDIVLEGRVKYGVPHLTLVGPYEVDVSLEGNLILCRQIDQPGMIGKVGNILGDTNVNINFMSVGRTFRGKQAIMAIGVDEEPDKDTLEKIGAIPAIEEFVFLEL

SEQ ID NO: 2391 - protein, 126 aa, Solanum carolinense
NKSQMLNDCSSKKRYHNILEPDKRKQLEDEWPDLTAMAGDTEKHQKFWGYEFNKHGTCSIDLYNQEAYFDLAIKLKNQFDILKTLRNHGIIPGKVSTTVKNVEDAIKAVSAHVPNLNCIGRSSKTM

SEQ ID NO: 2392 - protein, 427 aa, Pseudomonas syringae pv. phaseolicola 1448A
MSRSETLFANAQKHIPGGVNSPVRAFKSVGGTPLFFKHAAGAYVTDEDDKRYVDYVGSWGPMILGHSHPEVLDAVRSQLEHGLSYGAPTAMETEMADLVCALVPSMEMVRMVSSGTEATMSAIRLARGFTGRDSIIKFEGCYHGHSDSLLVKAGSGALTLGVPSSPGVPAAFAKHTLTVPFNNLDAVRDLLAEVGQEVACIIVEPVAGNMNCVPPAPGYLQGLRDLCDEHGVVLIFDEVMTGFRVALGGAQAYYGVTPDLSTFGKIIGGGMPVGCFGGKREIMSHIAPLGPVYQAGTLSGNPLAMAAGLTTLRLISRPGFHDELSDYTRRLLEGLQQRADAAGIAFVTTQAGGMFGLYFSEAREIVTFEDVMTSDAERFKRFFHLMLEGGVYLAPSAFEAGFTSIAHGDAELKLTLDAAEKAFAALK

SEQ ID NO: 2393 - protein, 1252 aa, Coccidioides immitis RS
MEKDTIKDRSQTKRQPFRDASNRLNIVHNSSRQTRYDHVALSSEKQMTSSDPPDALNGHDFPPATAENKRISAVLDYHSDPRRNSAISTTSTNSGRSRRKTHIGPWQLGKTLGKGSTGRVRLAKHSVTGQAAAIKIVSKQSAALAQSQSIAAMDKNIDVAPGSRTIPSGIEREVVIMKLIEHPNVISLYDVWENRGELYLVLEYVEGGELFDYVSERGPLPEIEAVRLFRQIIAALSCCHQYNICHRDLKPENILLDFRKNIKLADFGMAALQPAGHWLNTSCGSPHYASPEIINGQRYHGDKADIWSCGIILFAMLAGFLPFDGGDLANTLKLVKRGEYIIPPWFSPEAIDLIQRILQKRPENRISIDQMWLHPLLMKYQAHPIFANSPMDSIGPPPPLPSKDFKKIVTHRRDIDLEVLRSLQTLWHEKRKEDLIENLLNDKPNHEKLFYKALLKFREEQLENYEGPPLGYSSSDYHHISRPLFRLQRRMPSNHGESNVWRRSKFSIATNSSGMREGSSRGPTSAPTIASYDPYRSSRTAIAEPKVEYANVTIHRHQSNDSSAALNSKSSPPTGKLSMDRASVNMRSSPNGGPGTSSRRSSLASYQSRSSVGSHCQRAKSRHSYKRNVSFRHLRGHNPNRDDKRIGMPPGHSQYSLCQERNKMGKRESERVKRLSSERFSSPSLPSPPTCVRPATNKVGELEVGAKPRQSYQYWKEEARKVSQELEQICEEAFNSSSLSSSYTIETGSKYPESPVTSISTPGNLNRYYGQTNTKPVRGQTFESSSSYATRELAETRRRLIEHSKKARADGLPSHLSEVISHLDRLIEGKPSHSVAKNAALAAEAARPPHNVTRNLPSILEERHSVKDFLSGETTSSYIPPPLDLDVWEKKTIRVVPDSTNNLDNIRPLTIRKKRTTLELPTPSNESTSFSQPQRSLSQSLTRNRSTGRRSNTGRFFSGLEPIEENPKSSKKNEFRNSGDTRKWSRFKYRSQSYSDVGPPTPPKDDVPLSRQSSISHMTSGASQGTEEYPVVEDDNLNWIKKNKPVETGKKLLKLFGMKKREKAVHEFGQESNCFNISVTSLDNKDESDIFGTKNHFLSNTQNEAGSPTHPASSQNWFMKFFRIKAASKVIALNAPKARARKEVIKILREWKKYGMEGIRVDKQNSVIRGRVGELNFLRLRPVEFSAELFTVLEYGRHVSLSLIRLKQERGAASSFRKVVETLIAVLKQRKLLVEDTVKAKKMAKVLSLTGQ

SEQ ID NO: 2394 - protein, 122 aa, Solanum carolinense
NVSRTLNFCSGKDDYKKFTEEKEKNDLDERWPDLKTDKIDCIGGQVFWKNEYNKHGTCCSETYNREQYFDLAINLKDKFDLLASLKKHGIIPGNKYTVQKINSTIKTITRGYPNLSCTKGFM

SEQ ID NO: 2395 - protein, 500 aa, Streptococcus pyogenes MGAS315
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWAVIPVLAEKPASTDDMFEVAERVAVEAGLVQSGDNIVIVAGVPVGTGGTNTMRVRTVK

SEQ ID NO: 2396 - protein, 293 aa, Acidovorax sp. JS42
MTDSPTAGTPYGTLPPASPLPQRRPVSLPRLAQMREAGEKITMLTAYDATFAAVADAAGVECILVGDSLGMVCQGLPSTVGVTLEHMAYHTASVARGLHRVQGTAWLIADLPYGSYAESREQALRSACQLMQAGAHMVKLEGGGWTAPTVQFLVERGVPVCAHLGLTPQTVHALGGYRVQGKGDQAAQQLRRQALELQDAGAAMLVLEMVPTPLARDLTQALPRCHTIGIGAGSGTAGQVLVMHDMLGINLGKNPKFVHDFMRDAGSVRGAIEAYVQAVKQGRFPDDALHAWN

SEQ ID NO: 2397 - protein, 172 aa, Debaryomyces hansenii CBS767
MSSSPIPPQQSQQQADPMAPNVEDLYLESYAFTTAAAIVGSVDRKIFVLLRDGRNLFGILRTFDQFANLVLQDTIERIYLDSDDETDDSRPKKFGEAYRGVFMVRGENVVMMGELDIDREDDHLEELQQVSFEEAEKELKVRHLNKVKQEKLKTKKLLSKGLINDFVKSDLY

SEQ ID NO: 2398 - protein, 177 aa, Glycine max
MAASDGCSSFLTLSCAGAVQNQHVSHPTTFLGVPKNNQRKRKTPHRLVVVAVTQGSAESSKSDEKIPSWAKPDSDEPPPWARDEPNNNSSQQEGFEIPFYAYLFASAITAIAAIGSIFEYVNQKPVFGVLSSDSVFYAPLLGFFVFTGIPSSAFLWFKSVQAANKEAEEQDKRDGYL

SEQ ID NO: 2399 - protein, 362 aa, Oryza sativa
MSAYCGKYKDELIRNAAYIGTPGKGILAADESTGTIGKRLASIGVENVEENRRALRELLFTAPGALDCLSGVILFEETLYQSTRDGTPFVDVLAAAGVLAGIKVDKGTVELAGTDRETTTQGHDGLGERCRRYYAAGARFAKWRAVLSIGRASSRPSQLAVDANAQGLARYAIICQENGLVPIVEPEILVDGEHGIEACAEVTERVLAACYKALSDHHVLLEGTLLKPNMVTPGSDAARAPPEVVAEHTVRALLRTVPPAVPAIVFLSGGQSEEEATRNLNAMNQVASRGKKPWSLTFSFGRALQQSTLKAWAGKAENVGKAQAALLARCRANSQATLGAYAGDAAAGEGVSENLHVKDYKY

SEQ ID NO: 2400 - protein, 842 aa, Arabidopsis thaliana
MVVSVTIRRRFVLLLLACTCLLSRRLCFGEDRITFSTPIKDSESETLLCKSGIFRFGFFTPVNSTTRLRYVGIWYEKIPIQTVVWVANKDSPINDTSGVISIYQDGNLAVTDGRKRLVWSTNVSVPVAPNATWVQLMDSGNLMLQDNRNNGEILWESFKHPYDSFMPRMTLGTDGRTGGNLKLTSWTSHDGPSTGNYTAGIAPFTFPELLIWKNNVPTWRSGPWNGQVFIGLPNMDSLLFLDGFNLNSDNQGTISMSYANDSFMYHFNLDPEGIIYQKDWSTSMRTWRIGVKFPYTDCDAYGRCGRFGSCHAGENPPCKCVKGFFPKNNTEWNGGNWSNGCVRKAPLQCERQRNVSNGGGGGKADGFLKLQKMKVPISAERSEASEQVCPKVCLDNCSCTAYAYDRGIGCMLWSGDLVDMQSFLGSGIDLFIRVANSELKTHSNLAVMIAAPVIGVALIAAVCVLLACRKYRKRPAPAKDRSAELMFKRMEALTSDNESASNQIKLKELPLFEFQVLATSTDSFSLRNKLGQGGFGPVYKGKLPEGQEIAVKRLSRKSGQGLEELMNEVVVISKLQHRNLVKLLGCCIEGEERMLVYEYMPKKSLDAYLFDPMKQKILDWKTRFNIMEGICRGLLYLHRDSRLKIIHRDLKASNILLDENLNPKISDFGLARIFRANEDEANTRRVVGTYGYMSPEYAMEGFFSEKSDVFSLGVIFLEIISGRRNSSSHKEENNLNLLAYAWKLWNDGEAASLADPAVFDKCFEKEIEKCVHIGLLCVQEVANDRPNVSNVIWMLTTENMSLADPKQPAFIVRRGASEAESSDQSSQKVSINDVSLTAVTGR

SEQ ID NO: 2401 - protein, 520 aa, Debaryomyces hansenii CBS767
MLRNSASNIVKATYTRRLYSTYDSSSKVLSSLKNKDLIRTQGYINGQWVASSDNSTFEVNNPALASGAGTKIADVSSMTTKDYVRAINSAQDAFSDFKKTTGRYRSDLLMNLYRLMQENQDDLAKLIVLENGKPYADAFGEVAYASSFFQWFAEEAPRVYGDIIPSALADSKILVMRQPIGVCGILTPWNFPAAMITRKLGAAAATGCTTVIKPASETPLSALALAYLAEQAGFPKGSVNVLPSSDAAGVGKLMCENPTIKKVSFTGSTNVGKLLMSQSSSTLKKLSMELGGNSPFIVFNDADIDKAVDGAIGSKFRSSGQTCICTNRLFVHESIYDEFASKLTKKLSETVKLGNGLADGTTHGPLIHGKSMNKVRSHIEDATSKGAKVLLGGNKREDLGVNFHELTVLGGVTQEMDIFNEETFGPVAPLIKFKSDEEVISLANDTDVGLAGYFYSSNINRVFKVAEELQVGMIGANTGAISESALPFGGVKESGFGREGSKYGIDDYTVVKSVVLGGLD

SEQ ID NO: 2402 - protein, 526 aa, Arabidopsis thaliana
MGDFNLALVIVAIVVCVIVFISSIYLLVNYQHPDDANQAYFPKFVVVFGLSIAMISILMLPADVANRHACRHAIYNGACNLTLPMKDLWLAIYIVDAILVFFVIPFAMFFYEGDQDKTLGKRIKSALIWVVTTAVVCALVLGILYAGVVIESISEHVARMNLMCHWKGGLLGQAFGFCHIHFPSSWQFSNTQPCIGNTARQCSAFTANPTSEKTWTMRTTFPEYVVALATIVGSVLFTIFGGVGIACLPLGLITAFIRRPKAVITRSQYIKEATELGKKARELKKAADGLHQEERSGAKGRKWRKNVKAVEKELLQLEEDVNLLEEMYPQGEQAETAWAFTVLGYLAKFILGIVGLIVSIAWVAHIIIYLLVDPPLSPFLNEVFIKLDDVWGLLGTAAFAFFCFYLLLAVIAGAMMLGLKLVFITIHPMKWGATLMNSFLFNVGLILLCSISVIQFCATAFGYYAQATAAQEIFGHTLQSLRGIKYLYKYNVFQIGFVILAGLTFLYYIAFGWRRKKTSGRFQLSS

SEQ ID NO: 2403 - protein, 480 aa, Salmonella enterica subsp. enterica serovar Typhi
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 2404 - protein, 491 aa, Bifidobacterium longum NCC2705
MSTTDAPKKPRETDDVPVPATLRKSLKNRHIQLIALGGAIGTGLFYGSSESIALAGPSILLAYLVGGLAIFAIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 2405 - protein, 490 aa, Ehrlichia canis str. Jake
MLQKHKKLDILSVFKLGNLIMFLSTEDTLNYIKKNAINFIDLRFTDSNGRWHHITRSAETTDAQVLLTGINFDSSSISGWQSIEKSDMILLPDISTAFVDPFSAQSTLVIICNIVDPYNQSQYAKDPRYTAQKAYEYMLSTGIADKCYFGPEVEFFVFDNVQFYTGMYDSYFKIESAEHDISYQRREFSNNNHRPRVKGGYMPTPPIDSLHDIRSEMLTMFKEVGITPLIHHHEVAASQCEVGFQYDELLASADNVQKCKYIVHGVTSSYGKTATFMPKPVIKDNGSGMHCHQSLWKDNVNLFVNSDGNISDTCLYYIGGIIKYGKAINAFTNPSTNSYKRLVPHFEAPTWLTYSYENRSAAIRIPYVPQNDVNAKRIEVRFPDPLANPYLCFSAQLMAGLYGIQNKIHPGPAIDKNLYSLNKAELQQLSSVANSLEDSLESLDKDREFLLAGNVFTNDQIDSYINLKTLEVKDLQLHPHPIEFINYYSS

SEQ ID NO: 2406 - protein, 639 aa, Glycine max
MPALVNYSGDDELYPGGSFCPNPVELGRLYTTIGSNLDVYYPPTKRPRSIFEAIEREQYYQEPGIEVLPDECLFEIFRRLPSGKERSSCACVSKRWLMLMSTICKDEIERATSVDETVSSDENQDIEDDGYLTRCLDGKKATDVRLAAIAVGTSSRGGLGKLLIRGSNSERGVTNLGLSAVAHGCPSLRSLSLWNVSTIGDEGVSQIAKGCHILEKLDLCHCSSISNKGLIAIAEGCPNLTTLTIESCPNIGNEGLQAIARLCTKLQSISLKDCPLVGDHGVSSLLASASNLSRVKLQTLKITDFSLAVICHYGKAITNLVLSGLKNVTERGFWVMGAAQGLQKLVSLTVTSCRGITDTSIEAIGKGCINLKQLCLHRCCFVSDSGLVAFAKAAVSLESLQLEECNRFTQSGIIVALANIKTKLKSLSLVKCMGVKDIDMEVCMLSPCESLRSLVIQKCPGFGSASLAMIGKLCPRLQHLNLTGLYGITDAGLLPLLENCEAGLVNVNLTGCWNLTDKVVSALARLHGGTLEVLNLDGCWKITDASLVAIANNFLVLNDLDVSKCAISDAGIALLSRASLPSLQVLSLSGCSDVSNKSAPFLTKLGQTLLGLNLQNCNSIGSSTMELLVEKLWRCDILA

SEQ ID NO: 2407 - protein, 314 aa, Lycopersicon chmielewskii
KINFNKVPLYYRNVSGGSRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 2408 - protein, 103 aa, Brassica napus
  misc_feature (87)..(87): Xaa can be any naturally occurring amino acid
  unsure (1)..(103): unsure at all Xaa locations
LGISEAPLPSSTSCSSLRAVAIRHCPGFGDASLSFLGKLCHQLQDIELCGLNGVTDAGVFELVQSNSVGLVKVNLSGCINVSDNAVXSAIFVCHGRTLESLNV

SEQ ID NO: 2409 - protein, 166 aa, Triticum aestivum
  misc_feature (21)..(21): Xaa can be any naturally occurring amino acid
  misc_feature (34)..(34): Xaa can be any naturally occurring amino acid
  misc_feature (77)..(77): Xaa can be any naturally occurring amino acid
  misc_feature (117)..(117): Xaa can be any naturally occurring amino acid
  misc_feature (153)..(153): Xaa can be any naturally occurring amino acid
  unsure (1)..(166): unsure at all Xaa locations
VVPAAVEESYWGNYMWGLDPXGSYNIDADGCTGXMFSIYRPSDECHIGDDSTLDELTEMCIGNVSQPGSNLLAGGYXMYYSSDMFVLTMGTGVYVFTLDPMNGEFVLTQEKVHIPKXSGKIYYFNEGKYALWDDKLKKYMRSLKEPGTCGKPXCARYIGSLLGDLH

SEQ ID NO: 2410 - protein, 371 aa, Sulfolobus solfataricus P2
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 2411 - protein, 332 aa, Bradyrhizobium sp. BTAi1
MTTRTATNKNKILVTESFSAKGRALLTARDDVEMIEFPNMISAADFSALLKSHAPVHGVALGATRFGEPELLAAGDMKVVTRIGVGFDAVDVPALSKHKVPLMVAGTANSPSVAEQALFMMLTLAKRANEMHAMVRDGTWGSRLGVLPFDLYGKTVLIIGFGRIGTRTAKRCQAMEMQVLVYDPYKPAADITAAGCEPVADLDAALPRADFVSIHCPKTPETIGLFNAARLRLMKPTAYLINTARGGLIDEAALYDALSSRRLAGAGLDVFEQEPPPVGHALHALPNVIMAPHVAGVTREAVDRMSEQTARNILSVLDGDPIRQNVINQDVL

SEQ ID NO: 2412 - protein, 559 aa, Malus x domestica
MGSSGIDWKLPDHPKLPKGKVIGLIVLDGWGEANADQYNCIHVAETPVMDSLKKGAPERWRLVRAHGTAVGLPTEDDMGNSEVGHNALGAGRIFAQGAKLVDAALASGKIFEGEGFKYVKESFETNTLHLIGLMSDGGVHSRLDQLLLLLKGASEQGAKKIRVHILTDGRDVLDGSSVGFAEILENDLAKLREKGVDAQIASGGGRMYVTMDRYENDWSVVKRGWDAQVLGEAPYKFKNAVEAIKTLRAEPNANDQYLPPFVIVDDSGKPVGPIVDGDAVVTFNFRADRMVMIAKALEYADFDKFDRVRVPKIRYAGMLQYDGELKLPSHYLVEPPEIDRTSGEYLTYNGVRTFACSETVKFGHVTFFWNGNRSGYFNDKMEEYVEIPSDSGITFNVQPKMKAVEIAEKARDAILSGKFEQVRVNLPNGDMVGHTGDIEATIVACKAADEAVKIILDAIEKVGGIYVVTADHGNAEDMVKRNKTGQPLLDKSGNIQILTSHTLQPVPIAIGGPGLAPGVRFRKDLPSGGLANVAATVMNLHGFQAPSDYEPSLIEVVDN

SEQ ID NO: 2413 - protein, 527 aa, Thermosynechococcus elongatus BP-1
MPKVLVSDPIEQVGLDLLAQVAQVDVKIGLSEEELIKIIPEYDALMIRSGTKVTKDVIEAANQLKIIGRAGVGVDNVDVPAATRKGIIVVNSPEGNTIAAAEHTLAMMLSLARHIPDANAAVKAGQWDRKRFTGVEIYKKTLGIIGLGKIGSHVATVARAMGMKLLAYDPYLSTERAEQLGCRLVELDVLFAESDFITLHLPKTPETQHLINAKTIAKMKPTARIINCARGGIIDEVALVEALKSGRLAGAALDVFENEPLEADSPLRSLGMEAILTPHLGASTEEAQVNVAIDVAEQIRDVLLGLPARSAVNIPGLRPDVLEKLAPYMQLAETLGNLVGQLAGGRVESLEVRLQGELATNESQPIVIAALKGLLSPALRERVNYVNAGLEAKERGIRVVETRDESQRDYAGSLTLIAKSPSMTRSVSGALLSHNELRITSIDDFPISVAPTRYMLLTLHRDMPGIIGKIGTQLGSFNVNIASMQVGRKMVRGNAVMVISLDDPLPEGLLEEILKVPGIRDAYIVNL

SEQ ID NO: 2414 - protein, 247 aa, Acidovorax sp. JS42
MHKLVLIRHGESTWNLENRFTGWTDVDLTPTGIEQAKNAGRLLKAEGYDFDLAYTSVLKRATRTLWHCLDEMDRTWLPVEHSWRLNERHYGALQGLNKADMAKQYGDAQVLVWRRSYDTPPPALEPTDPRCERGDIRYAGLAPEQVPLTECLKDTVARVLPYWNEAIAPTIRSGKRVLIAAHGNSIRALVKYLDGISDQDIVGLNIPNGIPLVYELDAELKPLRSYYLGDAEATAKAAAAVAAQGKA

SEQ ID NO: 2415 - protein, 237 aa, Arabidopsis thaliana
MSSQICRSASRAARSLLSSAKNARFFSEGRAIGAASVVHATGKVPQYASNFGKSGSGFVSNSWITGLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 2416 - protein, 477 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEGAYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKGGQLKISGFGMIRLSKISQDKAKVANHKAHIDLSSKENASFTCMKTESLDYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPWK

SEQ ID NO: 2417 - protein, 309 aa, Kluyveromyces lactis
MSDNGPDLWLEKIKKCQALTESEMKQLCEMMKELLMEESNIQPVQSPVTVCGDIHGQFHDLLELFRTAGGFPDQVNYIFLGDYVDRGYYSLETFTLLMCLKVKYPSRITLVRGNHESRQITQVYGFYEECLNKYGSTTVWKYCCQVFDFLTLAAIIDGKILCVHGGLSPEIRMLDQIRVLSRAQEVPHEGGFSDLLWSDPDNVEAWQVSPRGAGWLFGSKVSREFNHVNGLSLIARAHQLVMEGFKYHFPEKDVVTVWSAPNYCYRCGNVASVMKVEDDLDPTFKIFSAVPDDYIQETNNNNQRGGYFL

SEQ ID NO: 2418 - protein, 92 aa, Escherichia coli
AKTAAALHILVKEEKLALDLLEQIKNGADFGKLAKKHSICPSGKRGGDLGEFRQGQMVPAFDKVVFSCPVLEPTGPLHTQFGYHIIKVLYRN

SEQ ID NO: 2419 - protein, 471 aa, Arabidopsis thaliana
MGETGDDAGPSEQGPSNQTWWPSEFVEKFGSVYLGSQEETSSTKDSPRNLGQDGLPSSTASNILWSTGSLSEPIPNGFYSVIPDNRLKQLFNNIPTLEDLHALGDEGLKADVILVDFQKDKKLFRQKQLITKLVSGLNSKPATIIKKIAGLVADVYKQSTLQSPAKSTQSFENCGIQLLGQIKHGSCRPRAILFKVLADTVGLQSRLVVGLPSDGAAESVDSYSHISVTVLLNSVEMLVDLMRFPGQLIPLSTKAIFMSHISAAGESDSAENDSCDSPLEPNSPMFGYPEKFDHENAEKDENLSLHRKLDGSPNTSGPPSRNMLLRSASALERKLSFSQSESNMANEFWRQSRRKVIADQRTASSSPEHLSFRARTKSMLSGDKNLARDFTGDVATSSCKSVGGAKMETKRIRRRSISITPEIGDDIVRAVRAMNEALKQNRLSKEQGDDDSSPNSPNDRTESSHLQKNVR

SEQ ID NO: 2420 - protein, 153 aa, Thermococcus kodakarensis KOD1
MPNIAILVGEAFTGYATIDLEPDEREKVESLLRAFGECLLVDEEHMDAITGLSGSGPAYVSVFVESMIYGGLRVGLLREVAKIAALQTLLGTAKLLLNYEGHPAEIRDMVTTPGGTTIDGIFELEEGKIRTAIMKAIDAATKKSRILSTRTLP

SEQ ID NO: 2421 - protein, 468 aa, Neorickettsia sennetsu str. Miyayama
MTNNRAASILEFVAKNEIRFIDFRFTSITGKFLHITRHSDSITADALTHGISLDSSLIQGWHDVDRSDVVLVPDLESCSSFLDPFAAQPTLCVVCDIVEPHGRGSYEHSPRATTKKAMEFLRSIGIADKAFFGLEMEFFVLDDARFAVKENGAFFELDSSEGIYNSGRRYEYNNHAHREGSRNCYLASQPSDSLNDIRAEILETLREVKIKPLLHHHGAASSQCRICFHHGEALETSDNMQKCKYITRNVASSYGKSATFMPKPFKDYNGNGMRLHVSLWKDEQNLFVPQDPREEISQLCKYYIGGIIKHRKALNAILNPLANSYKRLADIHNASYGLGYSPENRLAVVRIPHCRKGNPSGKRIEIRFPDAGTNPYIGTAALIMAGIAGIREKVLPEAAVELEKSSKVSLCRSLEEALLALDTDRQFLTEGDVFTNDQLDTYIKLLSDDSEEVSKHPVPIEFIKYYNV

SEQ ID NO: 2422 - protein, 72 aa, Glycine max
MFEIIQAAITGGAALALLLLAGITLGGSAVGLAVTTPLFVIFSPILVPATIATALLATGFTASGSIGAMAIT

SEQ ID NO: 2423 - protein, 415 aa, Arabidopsis thaliana
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWEYESYILILHCMFLETVRRLKITRPERMKGLVSTGWKGPVKFRMPTAENLVPIRLDIQFEGQRYKDAFTWNPSDPDNEVVIFAKRTVKDLKLPYAFVTQIAQSIQKSLLTLVNFLLYQSQLSDFRAYEGQDMYTGEKIIPIKLDLRVNHTLIKDQFLWCSLIAVLQDLNNFESDPEEFARTLCKDLGVEDPEVGIAIQSVASARESRLSKKGRRGSDHGSASKASGLSMDLMKLFSFKSSVVRKRKDLDVYEPVVDLLTSEEVDALEAREERHAR

SEQ ID NO: 2424 - protein, 577 aa, Arabidopsis thaliana
  misc_feature (139)..(139): Xaa can be any naturally occurring amino acid
  misc_feature (200)..(200): Xaa can be any naturally occurring amino acid
  unsure (1)..(577): unsure at all Xaa locations
MLEKVETFDMNRVIDEFDEMTRNAHQVQKQTLKEILLKNQSAIYLQNCGLNGNATDPEEAFKSMVPLVTDVELEPYIKRMVDGDTSPILTGHPVPAISLSSGTSQGRPKFIPFTDELMENTLQLFRTAFAFRNRDIFPXDDNGKALQFIFSSKQYISTGGVPVGTATTNVYRNPNFKAGMKSITSPSCSPDEVIFSPDVXDQALYCHLLSGILFTHQLQYLFPLFAHGLVHAFRTFEQVWEEIVTDIKDGVLSNRITVPSVRTAMSKLLTPNPELAETIRTKCMSLSNWYGLIPALFPNAKYVYGIMTGSMEPYVPKLRHYAGDLPLVSHDYGSSEGWIAANVTPRLSPEEATFAVIPNLGYFEFLPVSETGEGEEKPVGLTQVKIGEEYEVVITNYAGLYRYRLGDVVKVIGFYNNTPQLKFICRRNLILSINIDKNTERDLQLSVESAAKRLSEEKIEVIDFSSYIDVSTDPGHYAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 2425 - protein, 398 aa, Pyrococcus abyssi GE5
MVRASKRALSIEYAIRDVVLPARELEKKGIKVIRLNIGDPVKFDFQPPEHMKEAYCKAIKEGHNYYGDSEGLMELREAIVEREKKKNGVNITPDDVRVTAAVTEALQMIFGALLDPGDEILIPGPSYPPYTGLVKFYGGVPVEYRTIEEEGWQPDIDDLRKKITERTKAIAVINPNNPTGALYDKKTLEEIINIAGEHDIPVLSDEIYDLMTYEGKHISPASLTKDVPVIVMNGLSKVYFATGWRLGYMYFVDPEGKLSEVREAIDKLARIRLCPNTPAQFAAIAGLRGPMDYLEEYMKKLKERRDYIYKRLNEIPGISTTKPQGAFYIFPRIEEGPWKDDKEFVLDVLHNAHVLFVHGSGFGEYGRGHFRAVFLPPVEVLEEAMNRFEKFMREKLSS

SEQ ID NO: 2426 - protein, 400 aa, Rubrivivax gelatinosus PM1
MSSAHLLARTPVPPSRLPRVGTTIFTVMSALAQEHGAVNLGQGFPDFECDPRLVDAVTQAMQAGHNQYPPMAGVPVLREAVAAKIAALYGHRYDPGSEITITAGATQAILTAILALVHPGDEVIVLEPCYDSYAPNIELAGGRVRRVPLTPGRFRPDFDRIAAALGPRTRAILVNTPHNPSATVWTAGEMQRLADLLRPTNVIVIADEVYEHMVFDGQAHQSVARHAELAARSVIVSSFGKTFHVTGWKVGYAAAPAELMAEFRKVHQFNVFTVNTPVQHALAAYLGDPRPYLDLPDFYARKRDRFRAGLADTGLDLMPSEGSYFQCVGYGGLAAHRARSEAEFCRWLTTEAGVAAIPLSAFYDAGFEQRVVRFCFAKREGTLDAALQRLRTALSARSPG

SEQ ID NO: 2427 - protein, 398 aa, Thalassiosira pseudonana
MTVKKKNLLKKIKNFTINFGPQHPAAHGVLRLVLELNGEIVNRADPHIGLLHRGTEKLIEYKNYVQALPYFDRLDYVSMMAQEHSYCLAIEKLFNCKIPERAQYIRVLFAEITRILNHLLAVGCHAMDVGAMTPFLWAFEEREKLMEFYERVSGARMHAAYFRPGGLQVDIPKGLLDDIYMFIEQFTLRLTEMEDMLTENRIWKQRLVDIGVVTAKDACQWGFSGVMLRGSGINWDLRKSQPYEVYEKLEFDIPVGTNGDCYDRYLIRVFEMKESLKIIEQCLNLMPAGYVKTNDFKISPPTRVEMKQSMEALIHHFKMYTQGVIIPSNETYIGTEAPKGEFGVYLISDNTNRPYRCKIKAPGFNHLQALDFMSKGHLIADVVTIIGTQDIVFGEVDR

SEQ ID NO: 2428 - protein, 463 aa, Bacillus subtilis subsp. subtilis str. 168
MQKQKQELHRGLEERHISLMSLGAAIGVGLFLGSASAIQLAGPGILVAYAASGLVMFFIMRALGEMAIQKPVAGSFSRYARDYLGPLAGYLTGWNYWFLWVVTCMAEITAVGIYMGFWFPDVPNWIWALSALVIMTGVNFLAVKAYGELEFWFALIKIVAILSMIAVGLLMIIAGVGNGGIATGISNLWNNGGFFPHGLKGVLLSLQMVMFAYLGIEMIGVTAGEVKNPQKSLAKAIDTVFWRILIFYVGALFVIMSIYPWQEIGSQGSPFVLTFQKVGIPSAAGIINFVVLTAALSSCNSGIFSTGRMLFNLAEQKEAPQAYGQLTKGGIPGKAVLASAGALLVGVLLNYVVPAKVFTWVTSIATFGAIWTWAIILLSQIKYRKSLKPEEKKQLKYKMPLFPFTSYVSLAFLAFVVILMAYSPDTRVAVIIGPIWFLILLAVYYGKGFHKKNAAAASERNIS

SEQ ID NO: 2429 - protein, 1116 aa, Xanthomonas axonopodis pv. citri str. 306
MNAVASLQADAEQSAVVADQRWYKDAIIYQVHVKSFFDSNDDGIGDFPGLISKLDYIAELGVDTIWLLPFYPSPRRDDGYDIAEYMAVHPDYGSIEDFEHLVAHAHARGIRIVTELVINHTSDQHPWFQRARNAPAGSPERDFYVWSDTDQEYEGTRIIFCDTEKSNWTWDPVAGQYFWHRFYSHQPDLNFDNPAVLDAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGSLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDADESAALLPHLPTLEGEILPAWLSARRWFSAKDQVLRSVRIARRTPLPGDEPMTLLELEVALEDGRHERYMLPVGIVWEREQPSTLAEQLALARVRQGREVGYLTDAFALKPMVRGVIDALRSHAALDFCDGDDAAQQGQVCFEATPALATLDIPQDPEIRWLSAEQSNSSLVVADKAVFKLLRHVAVGANPEIEIGRRLTEMGYANAAPLLGSVSRIGGQGTVTTIALLQGFIRNQGDAWRWTLDHLARSFDEYATAQTDEARAEAVAGYDAFAAVVGKRLAELHEALSRGTDDADFAPQRIDLPTANDVVAGVGRQVEEMWETVNARLAGSEDSAEREALEAVLAQRPQLDALLAKAPSVLADSLLTRVHGDFHLGQILVAFDDVVLIDFEGEPAKPLAERRAKASPLRDVAGFLRSLDYASEVSARGEEGTAARAGVGVDTHLDQFLVQFRRRSTQAFLDAYHAVLDASAHPWIAPAAFNAATLLFLVEKACYEVRYEAANRPGWLMVPIEGLRRILQRARAGAGDT

SEQ ID NO: 2430 - protein, 483 aa, Bacillus cereus ATCC 14579
MDKKATFVSIDKKAMYINGEWITLQEQIEVNNPATKEIFATVPKGGVTEAKQAVDAAHEAFKTWSKLTAADRATKLKKWFTLIDENKEEIAAIMTKEQGKPFAEALGEVNYANSFVEWYAEEGKRVYGEMIPAAHPNKRILVMKQPVGVMAAITPWNFPAAMITRKVAPALAAGCTAVVKPASQTPLTALKLAELAHEADIPKGVINIITGSAKAIADTWMEDGRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGLANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 2431 - protein, 358 aa, Arabidopsis thaliana
MSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAVLKIGATEPSELSIQENAKGLARYAIICQENGLVPIVEPEVLTDGSHDIKKCAAVTETVLAAVYKALNDHHVLLEGTLLKPNMVTPGSDSPKVAPEVIAEYTVTALRRTVPPAVPGIVFLSGGQSEEEATLNLNAMNKLDVLKPWTLTFSFGRALQQSTLKAWAGKTENVAKAQATFLTRCKGNSDATLGKYTGGASGDSAASESLYEEGYKY

SEQ ID NO: 2432 - protein, 472 aa, Escherichia coli K12
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 2433 - protein, 331 aa, Zea mays
MATSTSQHALSSIKLLSTGCLHPDKRNCRVLSVSVGRRCPSARNLGLLCASNSQSSVIQPVQLPRSPKSGVAPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVISLELSTGIPMLYIFKEGKFIRRGSPAGPSEAGVYAYTKNLAQYRQKLDGIVQ

SEQ ID NO: 2434 - protein, 422 aa, Methanococcus maripaludis S2
MTIAKFHGGCHQIGKSCVEINTKKSKILIDCGMDPSDNGLPDINDSDVDAVVVSHAHLDHCGAIPYFNFKKIFCNPPTADLMYNVWKDTVSLSKTYKEEDIKKSMDVIKTVNYREEKQVTSDIKMKMYDAGHILGSSSLYLDIDGKKLLYTGDINEIETRTLRAADTDFDEIDTIIIESTYGSPLDIKPARKVLEKQLIDEISETIDNGGKVIIPVFAVGRSQEIIVVINNYMKSGALKEVPIYINGSLTHTTGMYMGYSDWLNPKIKNAIENRINPFGNLIKGGDEVFSREPCIIISTSGMVQGGPVLQYLSLLKNPRNKIILTGYQAEGTIGRSLEEGATEVKPFKRAIPVNGKVVKIEFSAHADYNSLLRFMKKIPQPDKAIVMHGERYQALSLAMTIWKTLKIPALAPSIGSVLPLFD

SEQ ID NO: 2435 - protein, 181 aa, Lycopersicon esculentum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 2436 - protein, 302 aa, Arabidopsis thaliana
MIIGMFRYDEMSQKFNVEYIAGGATQNSIKVAQWMLQVPGATSYMGSIGKDKYGEAMKKDATAAGVYVHYYEDEATPTGTCGVCVLGGERSLIANLSAANCYKVEHLKKPENWALVEKAKFYYIAGFFLTVSPESIQLVREHAAANNKVFTMNLSAPFICEFFKDVQEKCLPYMDYIFGNETEARTFSRVHGWETDDVEQIAIKMSQLPKASGTYKRTTVITQGADPVVVAEDGKVKKYPVIPLPKEKLVDTNGAGDAFVGGFLSQLVHGKGIEECVRAGCYASNVVIQRSGCTYPEKPDFN

SEQ ID NO: 2437 - protein, 399 aa, Geobacter sulfurreducens PCA
MKLADRVNKIQPSPTLSIDAKAKALKAQGIDVVGFGAGEPDFDTPANIKEAGKKAIDAGFTKYMPVGGADDLKDAIIAKMKRDHGLEYTRDEISVACGAKHTLYNISQALIQEGDEVIIPGPYWVSYPDQIVLAGGTPVFIMTDESTGFKITAEQLEKAITPRTVYVILNSPCNPTGSTYTKDELKALAAVLLKHPHVYVVSDDIYEKLLYDGLEFCNIPMACPELKDRTIIVNGVSKAYSMTGWRIGYACGPKALMAAMTKMQSQSTSNATSIAQKASVEALNGPQEPVAEMVKEFEKRRTYIVDRLNAIPGVTCFKSTGAFYAFPNFSGVYGKTTPAGKKIENSSDFAAYLLEDAKVALVPGIAFGDDRYARLSYATSLETIKKGLDRIEEAIGNLK

SEQ ID NO: 2438 - protein, 180 aa, Lycopersicon esculentum
MASSVISSAAVATRSNVTQASMVAPFTGLKSSATFPVTKKQNLDITSIASNGGRVSCMQVWPPINMKKYETLSYLPDLSDEQLLSEVEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 2439 - protein, 337 aa, Arabidopsis thaliana
THASAHASGTICFLIRVLRFLGNRIASTDISPMSSLTVRRVSREDIQLVQNLIERCLQLYMNQKEVVDTLLEQAKIEPGFTELVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGDHERLRTISSGFSYENFRSN

SEQ ID NO: 2440 - protein, 381 aa, Gibberella zeae PH-1
MVASSNTGLEREDHQRDADFNKAMHGSSAQARGGVAAMFRKGGAAKQAAVDEYFKHWDNKPAENETPEERAARQAEYATLTRHYYNLATDLYEYGWGQSFHFCRFSQGEPFYQAIARHEHYLAHQIGIKDGMKVLDVGCGVGGPAREIAKFTGAHITGLNNNNYQIERATHYAFKEGLSNQLEFVKGDFMQMSFPDNSFDAVYAIEATVHAPTLKGIYSEIFRVLKPGGVFGVYEWLMTDEYDNDNLRHREIRLGIEQGDGISNMCKVSEGIAAIHDSGFEMLHHEDLADRPDALPWYWPLAGELRYVQTVGDFFTIVRMTTWGRTIAHGLAGLLETFKLAPAGTKKTADSLALAADCLVAGGRDKLFTPMYLMVARKPAA

SEQ ID NO: 2441 - protein, 483 aa, Burkholderia xenovorans LB400
MMERGGDMQRSTETTELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 2442 - protein, 314 aa, Lycopersicon pimpinellifolium
KINFNKVPLYYRNVSGASRLVSIRAQVTTEAPAKVEKISKKQEEGVIVNKFRPKEPYVGRCLLNTKITGDDAPGETWHMVFSTEGEVPYREGQSIGVIADGVDANGKPHKLRLYSIASSALGDFGDSKTVSLCVKRLVYTNDKGEEVKGVCSNFLCDLKPGAEVKITGPVGKEMLMPKDPNATVIMLATGTGIAPFRSFLWKMFFEKHEDYKFNGTAWLFLGVPTSSSLLYKEEFEKMKEKAPENFRLDFAVSREQTNEKGEKMYIQTRMAQYAEELWTLLQKDNTFIYMCGLKGMEQGIDEIMSSLAERDGIV

SEQ ID NO: 2443 - protein, 771 aa, Arabidopsis thaliana
MGKKRVVLLWLSIFISFSSAEITEESPLSIGQTLSSSNGVYELGFFSFNNSQNQYVGISFKGIIPRVVVWVANREKPVTDSAANLVISSNGSLQLFNGKHGVVWSSGKALASNGSRVELLDSGNLVVIEKVSGRTLWESFEHLGDTLLPHSTIMYNVHTGEKRGLTSWKSYTDPSPGDFVVLITPQVPSQGFLMRGSTPYFRSGPWAKTKFTGLPQMDESYTSPFSLTQDVNGSGYYSYFDRDNKRSRIRLTPDGSMKALRYNGMDWDTTYEGPANSCDIYGVCGPFGFCVISVPPKCKCFKGFIPKSIEEWKTGNWTSGCVRRSELHCQGNSTGKDANVFHTVPNIKPPDFYEYADSVDAEECQQNCLNNCSCLAFAYIPGIGCLMWSKDLMDTVQFAAGGELLSIRLARSELDVNKRKKTIIAITVSLTLFVILGFTAFGFWRRRVEQNALISEDAWRNDLQTQDVPGLEYFEMNTIQTATNNFSLSNKLGHGGFGSVYKARNGKLQDGREIAVKRLSSSSEQGKQEFMNEIVLISKLQHRNLVRVLGCCVEGTEKLLIYEFMKNKSLDTFVFDSKKRLEIDWPKRFDIIQGIARGLLYLHRDSRLRIIHRDLKVSNILLDEKMNPKISDFGLARMFHGTEYQDKTRRVVGTLGYMSPEYAWAGVFSEKSDIYSFGVLLLEIISGEKISRFSYGEEGKTLLAYIGLLCVQYQPADRPNTLELLSMLTTTSDLPLPKQPTFVVHTRDGKSPSNDSMITVNEMTESVIHGR

SEQ ID NO: 2444 - protein, 85 aa, Glycine max
  misc_feature (37)..(37): Xaa can be any naturally occurring amino acid
  misc_feature (52)..(52): Xaa can be any naturally occurring amino acid
  unsure (1)..(85): unsure at all Xaa locations
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 2445 - protein, 295 aa, Lupinus albus
MTYMFKYDSVHGHWKHDELKVKDSKTLDSVHGHWKHDELKVKDSKTLAESGAEIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSSKDWRGGRAASFNIIPSSTGAAKAVGKVLPVLNGKLTGMAFRVPTVDVSVVDLTVRLEKAATYDEIKKAIKEESEGKLKGILGYTEDDVVSTDFIGDNRSSIFDAKAGIALNEKYVKLVSWYDNEWGYSTRVVDLIAHFAKTI

SEQ ID NO: 2446 - protein, 336 aa, Rhizomucor miehei
MTVKAGINGFGRIGRIVLRASLLNPEVEVVAINDPFIDLEYMVYMFKYDSTHGRFKGTVEAKDGKLVVNGKPISVYAERDPCCIPGRIGAEYIVESTGVFTTKEKAGAHLTGGAKKVIISAPSADAPMFVVGVNLESYSSDMQVISNASCTTNCLAPLAKVIDDEFGIVEGLMTTVHATTATQKTVDGPSGKDWRAGRGAGANIIPASTGAAKAVGKVIPHLNGKLTGMAFRVPNPDVSVVDLTVRLEKSASYEDIKAAIKKASEGSLKGILGYTEDEVVSTDFIGDSHSSIFDAKAGISLNPNFVKLISWYDNEYGYSTRVVDLLVHIAKVDGRL

SEQ ID NO: 2447 - protein, 358 aa, Frankia sp. EAN1pec
MRVAVAYEAEKPLVVEDLDQPAVGPRDVLVRIAASGICHTDLHVINGHSPLPLPIVPGHEACGVVEEVGSEVRRVKVGQRVLAAVSPACGTCWWCVNGMSNHCELGGPVKAAPRFTLADGRTAAAVCGCGTFAEAMVVDEASVVPTNTDLADEELALLGCGVTTGLGAALITAGVTPGSSVAVIGCGGVGQSVIQGARISGAATIIGIDLVPARREASLRVGATHVVDPAEADPVEQVRALTEGRGVDFSFEVVGLPNLMVQAFDMARKQGAVTLVGMPTTTATLTLPAISAIFSGKRLAGSVVGGAQILRDMPRFIRLAETGQLDLGGMVSNRIRLDDINEGIALLDRAEGTRTVII

SEQ ID NO: 2448 - protein, 458 aa, Bacillus cereus ATCC 14579
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLADVPVHPVLGMKNPWVYRNKAQVPIGEREGGLVAGFYRQGTHDIINMESCLIQAEENDTLIQEVKRICEKHGITAYNEERNKGTLRHVMARYGQVTGEIMLVFITRTAELPNKKAIIEEIAAKFPEVKSIVQNVNTKRTNVIFGDKTTVLYGSEYIYDFIGDIKFAISARSFYQVNPEQTKVLYDKTLEYAKLNGNETVIDAYCGIGSISLFLAQKAKKVYGVEIVPEAIEDANRNAALNNMTNAEFGVGEAEVVIPKWYKEGVIADTMVVDPPRKGCDEALLNTIIDMKPNRVVYVSCNPATLARDLKVLEEGGYKTQEVQPVDMFPHTTHVECVAWLKLV

SEQ ID NO: 2449 - protein, 434 aa, Exiguobacterium sibiricum 255-15
MYQSLGQLKETKVFKDPVHRYIYVSDQLIWQLIGTKEFQRLRRIKQLGTSFLTFHGAEHTRFHHSLGVYEITRQLIDVFNGRADWDDQYRELTLVAALLHDVGHGPFSHAFENVFGVDHEEWTERIILGDTEIKQVLDQVGEGFAEEVASIINKTHPNQLLVTMISSQLDVDRMDYLLRDAHFAGVSYGKFDLERMLRVLRPAPNQMVVKQSGMHSIEDYIMRRYQMYWQVYLHPVTRSSDYLLKAILERAKELYTSEYAFTIDPVHLSPLFTKEMSLKNYLALDETIVYFYFQQWAEEEDTVLSDLARRFVDRKLFKYVDYPAEKRALVHEKLCTLFEKIGLDPTYYLLEDKLSRLPYDLYGDNGEISKQPIMLQMKNGQMKEISQVSPLVQAIANSRQTDEKLFFPQEILHDLREFANEKMQIDQLLLGEEI

SEQ ID NO: 2450 - protein, 478 aa, Mycoplasma mycoides subsp. mycoides SC
MTKEKLQKRMKRTKVITTIGPSTHSAEAIKELFNNGMTTIRLNFSHGSYEEHGYRIKAAKKISKALNKPISIMLDTKGPEIRLGKFKDNKQEVVKGQAITIYTDNYSYLNKECVQGEMTVAYDMSVDLKPEDMILIDDGKLELTVDSVEPQIIKATAFNHHIVKTNKRVNLPGIDFSLPFLSEKDEKDILFGCEQDVDYIAASFVNTAENVRQIKEILTKANANHIQIISKIESQVGLDNIDEIIEESDGIMIARGDLGLEIPYYDVPYWEKIIIRKCREKGKIVIVATQMLETMTENPSPTRAEVTDVYYATELGADATMLSGESAAGDYPFLTVHTMSTINKRAEVEFYNKIYYQVQLDNARNSTSGPRAEIADLLATKTKDGEYKYAIVLSKTGELLKTISKFRPNVTILGVSPDKKLWTSFGVWHSIFMNKVDTLDNLDNNVEKLSEIAKSWGAKFGEKVLVVRSTAIKEIEVI

SEQ ID NO: 2451 - protein, 232 aa, Triticum aestivum
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTIRGDLAVQTGRNIVHGSDSPENGKREIALWFKEGELCGWDSALAKWLRE

SEQ ID NO: 2452 - protein, 532 aa, Mesorhizobium sp. BNC1
MAPRVLVSDKLSPTAVDIFRQHGVEVDYQPDLGKDKDKLLSVIDQYDGLAIRSATKVTEKLIAAATNLKVIGRAGIGVDNVDIPAASRRGIIVMNTPFGNSITTAEHAVAMIFAVARQIPEANASTHAGKWEKNRFMGVEITGKTLGVIGCGNIGSVVAMRAIGLKMHVIAYDPFLSEDRAEELGVEKVELNELFARADFITLHTPLTEKTRGIINAAAIAKMKDGVRIVNCARGGLIVEADLVEGLKSGKVAGAGIDVFENEPATENPLFNLPNVVCTPHLGASTTEAQENVALQIAEQMSEYLIKGAVTNAINMPSITAEEAPRLKPFIKLAEVLGAFVGQVTDEPIAGVEILFDGSTAAMNTRALISAALAGLIRPQVNDVNMVSAPIMVKERGIIVSEVKRDKSGVFDGYIKLTVKTPERTRSIAGTVFSDGKPRFIQIKGINLDAEVGEHMLYTTNNDTPGIIGQLGTICGKHGVNIANFQLGRNRPGGDAIALLYLDAPFPQPVLEELKSTGSIISAKPLRFDVGN

SEQ ID NO: 2453 - protein, 542 aa, Aspergillus oryzae
MRVLPATLLVGAASAAVPPLQQVLGRPEEGMSFSKPLHAFQEQLKTLSEDARKLWDEVANYFPDSMDHSPIFSLPKKHTRRPDSHWDHIVRGSDVQKIWVNNADGEKEREIDGKLEAYDLRIKKADPSALGIDPNVKQYTGYLDDNGNDKHLFYWFFESRNDPKNDPVVLWLNGGPGCSSLTGLFMELGPSSIDENIKPVYNDFSWNSNASVIFLDQPVNVGYSYSGSAVSDTVAAGKDVYALLSLFFKQFPEYAEQDFHIAGESYAGHYIPVFASEILAHKNRNINLKSVLIGNGLTDGLTQYGYYRPMGCGEGGYKAVLDEATCESMDNALPRCRSMIESCYNSESAWVCVPASIYCNNALIGPYQRTGQNVYDVRSKCEDESNLCYKGMGYVSEYLNKAEVREAVGAEVGGYDSCNFDINRNFLFHGDWMKPYHRLVPGLLEQIPVLIYAGDADYICNWLGNKAWTEALEWPGQKEYASAELEDLKIEQNEHTGKKIGQVKSHGNFTFMRLYGGGHMVPMDQPEASLEFFNRWLGGEWF

SEQ ID NO: 2454 - protein, 765 aa, Ustilago maydis 521
MTGAGYQLLPRREREETRLSMDQNIKSLPEKHLLPLSLDNDEDSQELTSRKPCLLVKAIFCIVIIASSTFAACCVYRRGGVTPVIWANRPITDYSTSATVSSDSPVVFGLGIGDVTGPIVEVNMMGYASLPQTNTGLHIRLRSRAFIVGSSDAPTFFRKPVERFKSFIPTADGSAIRWLFINSDICMGDTALRKAIVDQLREKYPGVYGERNVAFVGTHSHAGPGGFMQALLPTLTSKGVIMQNFDAIVEGTVRAAVRAHDDFVARQDKVANGGSTRLSYGKTRLEDAHIQRSRYAYEQNPQEERDLYNDEDQDHDFGLLKFEDISSNGDSSAAGFLSWYAVHGTSLYENNTLTSGDNKGLAALLYETAEQPDKLPGQNDFVAGFSQALVGDTSPNTKGAWCDDGSMCEYKHSTCDNGKGKERVQTCHGRGPAWGMNEYLPTSPTGGYDWASNEIIARKQVDAARTIMSRDALSRDFGEYEGLTLLTGPVKSVKMNVDMSQYTVYRPDGSRVKTCPAALGYGFAGGTTDGPGAFDFVQGSNKTDHHNPFWDLVKGFIKNPGPEQIECQAPKAILLDIGEIHRPYDWGPSIVEVQMLRLGELFVLIVPGEFTTMAGRRLKRVVSEAIKRAGLVEEGKEPIVQVSGPASTYGHYVTTEEEYSVQRYEGASTLFGPHTLEAYMDVFSRRLVPALKEGARDLPVGPQKSFDMRKTWKLKTGVVTLVWRCLGTTAALIPHPELEHVSFQRLAHHVVDFEHQRDIYCRQST

SEQ ID NO: 2455 - protein, 163 aa, Zea mays
MAAYMRVTHRDEEGKKVTEKMPVPETRRPDTAKHFERKLEEQGLHRFERHPANAPRGVGIGAPPPKSGRGGKYTWEGPGGLVEDQLDPAPPAIDPNDPNYEEAEEGGAADEDDEAAAREVVVGEVEVAKVAESRDGVARVDVAPGLLQDQNEAVKRLVFSGYV

SEQ ID NO: 2456 - protein, 211 aa, Ehrlichia canis str. Jake
MGIIVSESSSFISPIEHIIEDARQGKIFILIDDEQRENEGDLVILAEKVTSDAINFMITHGSGIVCLSITEDLMCKLGLEFIPKRHVNDNSASFATSIDVRYGITTGVSAHDRASTILRVVDQNVTKDDFVTPGHIFPIVAKKGGVLERSGHTEASVEIAKIAGLAPVAVVCELMNPDGTMSRMPDIIEFSQRYNVKVTSIEKLIQYVKAH

SEQ ID NO: 2457 - protein, 101 aa, Zea mays
MGPLGPTVSFSIMVMAKLSVMAKLSGAAQQQPEDERERKEGGSGCGFRMPLHYPRYKKADYEAMPEWRVDCLLREYGLPADGDLDSKRRFAMGAFLWPDQY

SEQ ID NO: 2458 - protein, 260 aa, Ustilago maydis 521
MVSSQELETAIRQKVQDVSTLVVSDVSGGCGQAYDVVIVSDAFSGLNTLKRHRMVNELLKDEIAQLHAFSQKTYTVAQYAQMSSSSNNASDAPAPSSTKPSTADLQAPAPITSMRPSHNRTASGVSIPELTLTTDDETLSGLSAGNAGKPLGAGAQPGGSTQYPGTAVPPPLSPSISRLHENRIRSTEFWTGLRSYLELQFSGPNVEAGAASPGPSSRSPGDAEIERIFEDFFLSQKHHLTASDVAKVRDATGMFGMAGV

SEQ ID NO: 2459 - protein, 277 aa, Sulfolobus solfataricus P2
MKIMEDLTIGILGAGKIGSAIVRAIRLKYPSIHVIATARKDETLRNVKDLEVETTKDNNYAVNKSDVIILSVKPQHFPTVLRQVGIESWRDKVVISIMAGVKLSTLSTLLNNAEVYRAMPNINAIVYKSTTTIAENNGKSRELVENIFKTLGNVYWLPEEYLDIWTALVGSGPAFISEIIDALSLGAVACGMQREIAYNAVLDMISGTIIMLKEGKIDHPMLLRDQVTTPVGTTIRGLMVMEAKSVKSALIETIEASYKRAVEIGNEIDKSIRNNSK

SEQ ID NO: 2460 - protein, 136 aa, Brassica napus
FVKELVRVTAPGGRIIIVTWCHRNLSQGEESLQPWEQNLLDRICKTFYLPAWCSTSDYVELLQSLSLQDIKCADWSENVAPFWPAVIRTALTWKGLVSLLRSGMKSIKGALTMPLMIEGYKKGVIKFGIITCQKPL

SEQ ID NO: 2461 - protein, 675 aa, Ustilago maydis 521
MSQNIASRRIPLRTRSTASASGAQAKENAGVTSVSSRGARYRHDGAAADAGPSKPASTATAATKASVASAASGVLGTRKRAALGDLTNANRTRSAMAGNDDKGKAALKDAIKPRATTSASTSSRSAVGTAASATTTGTGAARRVVRTRPTTASSTTASTTVTDAASDRPFRASRRVAGTTASTASGIPSATSRPTSTTTATSAVTAARKASMVRASSAGSQTDVRRDVSNTSAVTTNTTAPITAASRSSKVQLNEVHDTDDKMEAPQAKRLKTEQTNKPAKDEGWEDLDAEDADDPLMVAEYVNDIFEYMKELEIINMPNGDYMANQKEINWDVRAILIDWLVDVHAKFRLLPETLYLAVNIIDRFLSRRTISLSKLQLVGVTAMCIASKYEEVMCPSIQNFCHLADGGYTDVEILRAERYMLKVLDFSMSYANPMNFLRRISKADNYDIQTRTVAKYFMEISLLDYRLMEHPPSLIAAASVWLAREVLERGEWTPTLVHYSTYSEQELLGTAEIMLDYCLRPIAHQFFHKKYAHKKFMRASTYVIEWAHKAFPEGVVGVDEQQDLNVLRIDLYERNEIERPEMSPVSSSRATSPVSMHGQAHFEVEPSQNVDGDDTVSYAHDDDHEEEDDLVDDAQEIEGDVQLLDDVKAAAQRQDTRQVLRDVTNAYEATETF

SEQ ID NO: 2462 - protein, 281 aa, Borrelia burgdorferi B31
MILSLLSMNINYNSITSIKQTLKERKIAPRKLWGQNYLINESIRQKIIESLDIKENEKIWEIGPGLGAMTEILLKKTNLLTAFEIDLKYSEILNEKFGKLKNFKLIKGDFLKKYKNENQNIDKIFSNLPYNIASKVISKLIEENFLKEMVFTVQKELADRITAKINSKNYSSFTVLVQSHFKVIKILDIGENNFYPAPKVKSTTLKLIPKKNNIKNFKEFNKLVRTVFSNRRKKLKNTIINFITNKATLRENFLKEYLDKRPENISVEEFIQISNTLNAYH

SEQ ID NO: 2463 - protein, 544 aa, Mycoplasma pulmonis
MKNKELWWRTGSIYQVYVRSFKDSNNDGNGDINGLISKLDYLHWLGIKAIWINPIAKSPMVDNGYDVSDYKDIDPLFGTMSDFENLIEKAHSKNIKIIWDFPLNHTSSEHPWFKQALKGNPKYLKYYYFTKTYKLNRDSVFGGSFWTKTSNGYYYAHVFAKEQPCLNWFNQDVVDEFVEIINFWLDKGVDGFRFDAFDEIGKPTDLFTRENFYEHDKKFVIEKFKELRQKTWKDDNEIMSVSESWAMNSKDVNENTNLENKAYSLTFNFDHMISEFEYVDGKKTWKGFDFIKFKKIIAQWQKDVSNGWNSLYFNNHDQPRAISRFLHDQVDFLDQKAKAFALTLHGLKGTPFIYQGEEIGMDNSDHTNDISKINDVNDLRTYEYHVLKQKIMTHNDFMKLSSIFSRDNARTPIPWNSKGGFNDSGKSWLPYNKSFKTINVEDQIDQENSVLSWYKKVIDLRNNPKIRSTIIQGDFELIADEDPNIFAYKRKDDFQELVFVINWSQKLIDNNLNLKNYEVFLNNYPTYQSSKLLPWQALILIRKS

SEQ ID NO: 2464 - protein, 278 aa, Haemophilus ducreyi 35000HP
MLSSILKFVLSGKQVKSIVKKLHVNMKLNTSQIQNALWCGEAIVFDEIDSTNAYLLSHYQSLEQGSICLAEQQTAGRGRRGRNWYSPASQNLYFSMLWHYSSTEATDLPALSLVVALIIAETLQAQQVEHIQIKWPNDIYYQGKKMGGILIESKVDRNGIHLVVGVGLNLAMKQVDETIVTQAWADLSHYQFDRNALVCQLAVALQKNLKIYPLVGFSHYLERWQTFDIFCDQSVKLVAGNNQIHGISRGINQHGELLLEQNGVTTAFGIGEMSLRLK

SEQ ID NO: 2465 - protein, 275 aa, Saccharopolyspora spinosa
MLPGGAPTSQQVGQMYDLVTPLLNSVAGGPCAIHHGYWENDGRASWQQAADRLTDLVAERTVLDGGVRLLDVGCGTGQPALRVARDNAIQITGITVSQVQVAIAADCARERGLSHRVDFSCVDAMSLPYPDNAFDAAWAMQSLLEMSEPDRAIREILRVLKPGGILGVTEVVKREAGGGMPVSGDRWPTGLRICLAEQLLESLRAAGFEILDWEDVSSRTRYFMPQFAEELAAHQHGIADRYGPAVAGWAAAVCDYEKYAHDMGYAILTARKPVG

SEQ ID NO: 2466 - protein, 137 aa, Arabidopsis thaliana
  misc_feature (81)..(81): Xaa can be any naturally occurring amino acid
  misc_feature (97)..(97): Xaa can be any naturally occurring amino acid
  unsure (1)..(137): unsure at all Xaa locations
TPPGGFGPRKPITIFCLITTYPKGRVYGEPKPQNSNKKGTLPQLKQNHRKGKPITMATAYNNPFAVNINPVGINVCFVGNXAARVVHGYNTTFLISXKKMLVNCPPVVRGAKKPLFVGDLPFGPNEFSTNQAVDTAI

SEQ ID NO: 2467 - protein, 317 aa, Arabidopsis thaliana
MSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 2468 - protein, 1881 aa, Arabidopsis thaliana
MACSTVKVGSIVWVQDPEEAWIDGEVVEVNGEDIKVQCTSGKTVVAKGSNTYPKDMEVPPSGVDDMTTLAYLHEPGVLQNLKSRYYIDEIYTYTGNILIAVNPFKQLPNLYNDHMMAQYKGAALGELSPHPFAVADAAYRQMINEGISQSILVSGESGAGKTETAKMLMKYLAKMGGRAVSDRRTVEDQVLESNPVLEAFGNAKTVKNNNSSRFGKFVEIQFDQRGRISGAAIRTYLLERSRVCQVSDPERNYHCFYMLCAAPPEDKRKLKLNDPTEFRYLNQSHCIKLDGVDDSKEYTKTREAMGIVGINLEEQEAIFRVVAAILHLGNIEFAIGEEPDSSVPTDESKKYLKIAAELFMCDEQALEDSLCKRIMVTPEETISRCLDPNSAALSRDALAKFVYSRLFDWIVNKINNSIGQDPDSKDMIGVLDIYGFESFKTNSLSPFLSITFSGQHVLKMEQEEYTKEEIEWSQITFPDNRYVLELIEKKRGGIIALLDEACMFPRSTHKTFSQKLYETLKDNKYFSKPKLSRTDFTICHYAGDVTYQTEQFLEKNKDYVVAEHQALLGASRCTFIAGLFPPLVEDANKQSKFSSIASQFKQQLASLIEGLNTTEPHYIRCVKPNNLLKPSIFENQNSLQQLRCGGVMETIRVCRAGYPTRKHFDEFLDRFGILDSATLDKSSDEKAACKKLLETVGLNGFQVLCERHVLNTFLARRAWYLMYLFSQIGKTKVFLKAGQMAELDDRRTEVLGRAACIIQWKFRSYLTRQSFIMLRNAAINIQAVYRGQVARYRFENLRREAAALKIQRALRIHLDRKRSYIEAVVTVQSGLRGMAARVVLRRKTKATTVIQSHCRRLRAELHYKKLKKAAITTQSAWRARLARKELRKLKTDARDTVVLQAAKSMLAEKVEELTWRLDLEKRMRVDMEVSKAQENAKLQLALEEIQLQFEETKVSLLKEVEAAKKTAAIVPVVKEVPVVDTVLMEKLTSENEKLKSLVTSLELKIDETEKKFEETKKISEERLKKALDAENKIDNLKTAMHNLEEKLKEVKLENNFLKESVLTTPVKTASGRFLSTPLKGAEFTTPPRIQESGSDTKSRGSHIDPQHRDLLGFLEKEDVDALINSVTKNVGFSQGKPVAAFTIYKCLLHWKSFEAERTNVFDRLVQMIGSAIKDEDNDANLAYWLSNTSTLLFMLQQSLKSGGTGATPLRQSPSLVRWMTKGFRSPAAEAIRPVDAKDPALHFKQQLEAYVEKILGIIWDNLKKELNTVLALCIQAPKTFKGNALISITTANYWQDIIEGLDALLSTLKESFVPPVLIQKIFSQAFSLINVQVCNSLVTRPDNCSFINGEYLKSGLEKLEKWCCETKEEYAGSSWDELKHTRQAVGFLLIHKKYNISYDEIANDLCPNLQIQQHFKLCTLYKDEIYNTKSVSQDVIASMTGVMTDSSDFLLKEDSSNIISLSIDDLCSSMQDKDFAQVKPAEELLENPSFIFLHYSFFWLSLRSCLHPFMMPPKQQPKADLAKKQKQVEDKTFGLKNKNKSKNVQKYVQSLKQSVQPKPDATKAAAKKKKEEEKAREQELNELFKVAISQPKVPVGVDPKSILCEFFKAGQCQKGFKCKFSHDLNIQRKGEKIDIYSDTRDEDGDMDEWDQETLEKVVESKKNEYNQNKPTDIVCKYFLDAVEKKQYGWFWSCPNGGKECHYRHALPPGYVLKSQMKALLEEESSKKLAVEDEIENERAKLQTATQMTPALFMEWKRKKIAERDAGLAASQAERAKNDRMSGRELFLSNASLFVDDAEACEEYEREREQEETEQKAKNKEAEAGTSKSSGDAEQSSKEVNEEEEDDDDDDDDLDMDELDELEASLSKTSIQIREPNDEGSS

SEQ ID NO: 2469 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPLGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 2470 - protein, 444 aa, Bacillus thuringiensis serovar konkukian str. 97-27
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEIEWDIFRTQVHQWERDQYMSLY

SEQ ID NO: 2471 - protein, 93 aa, Arabidopsis thaliana
GSSGSSGVPEKFKLSTALMDVLGIEVETRPRIIAAIWHYVKARKLQNPNDPSFFNCDAALQKVFGEEKLKFTMVSQKISHHLSPPPPSGPSSG

SEQ ID NO: 2472 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 2473 - protein, 596 aa, Mycobacterium sp. JLS
MDHSSGSPAHPDHDPAEGSHIEDGVVEHPTAGDFGHARMVPEDRTWFKRAVFYEVLVRAFHDSDADGSGDLRGLTERLDYLQWLGVDCLWLPPFYDSPLRDGGYDIRDFYKVLPEFGTVEDFVTLLDAAHRRGIRVITDLVMNHTSDSHPWFQESRRDPDGPYGDFYVWSDTSDRYADARIIFVDTEESNWTFDPVRRQFYWHRFFSHQPDLNYDNPAVQEAMLDVLRFWLDLGIDGFRLDAVPYLFEREGTNCENLPETHAFLRHCRKVIDDEYPGRVLLAEANQWPADVVAYFGDPDTGGDECHMAFHFPLMPRIFMAVRRESRFPISEILAQTPEIPDMAQWGIFLRNHDELTLEMVTDEERDYMYSEYAKDPRMKANVGIRRRLAPLLENDRNQIELFTALLLSLPGSPVLYYGDEIGMGDIIWLGDRDGVRTPMQWTPDRNAGFSKATPGRLYLPPNQDAIYGYQAVNVEAQRDSSNSLLNWTKTMLGVRRRHDAFAIGMFRELGGSNPSVLAFVRETATDTVLCVNNLSRFPQPIELNLQQWNGFTPVEMTGYVDFPSIGALPYLLTLPGHGFYWFQLRAPDPEPEGVQP

SEQ ID NO: 2474 - protein, 358 aa, Aspergillus oryzae
MRAVVYTGKDTISVEERPKPSLLEPTDAIVKVQHTTICGTDLHILQGHVQTCTPGRILGHEGVGIIESLGTGVTRFSVGQPVLISCITSCGSCNFCRKRMPSQCTSGGWILGNTIDGTQAEFVRIPHASFSLHALPNGLDPKVAVTLSDVLPTAYECGILNGQIQPGSTVAIIGTGPIGLMALQMARNLFGPSMTAVVGRGQPRLDTAKEMGADHAISVLGGQADAVASALAVTSNQGFDVVIEAVGTTDSFELAQALVGPGGTIASLGVFGTPCALHLEDLWHRNICIRTRLVDACTTPDLLKIVESGKISPHFLVSHNFSFDQIYKAYETFQTPSKSGSLKVVISMAELQPANPRL

SEQ ID NO: 2475 - protein, 520 aa, Arabidopsis thaliana
MASIGLYEAFIGFLCFLISFYFLVKKPFSYLLIKKTLQSYPWNWPVLGMLPGVLLRLQRIYDCSVEVLENSNMTFQFKGPWFVGMDVLATVDPANIHHIMSSNFSNYIKGPIFHEIFEAFGDGIINTDAELWRDWRNASQLIFNHQRYQNFSASTTKTKVNDGLVPLFNHFANEEIVVDLEDVFQRFMYDITFIFITGTDPRSLSIEMPEVEFSKALDDVGDAIVHRHITPRFVWKLQKWIGIGTEKKMLKAHATFDRVCEKIIAAKREELGSQGITYNSNGEREDLLTSFIKLDATKYEVLKPSHDKFLRDFTIGFMAAGRDSTASTLTWFFWNLSKNPNVLTKILQEINTNLPRTGSDQDMSSYLNKLVYLHGALSESMRLYPPIPFQRKSPIKEDVLPSGHKVKSNINIMIFIYAMGRMKTIWGEDAMEFKPERWISETGGVRHEPSYKFLSFNAGPRTCLGKNLAMNLMKTVIVEILQNYEIKIVSGQKIEPKPGLILHMKHGLKVTMTKKCSSLE

SEQ ID NO: 2476 - protein, 274 aa, Buchnera aphidicola str. Sg (Schizaphis graminum)
MKKKIKKHLPLKRFSQNFLINQNLIKKIVKFINPQLKQTLVEIGPGLGALTKPICNIVDELIVIEIDLNLLNFLKKYSFYSKLIVFCQDALIFDYLNLFYKKNKLIRIFGNLPYHISTSLLFCFFEKNKIIQDMNFMLQKEVAERLIAFPGTKSYGRLSIIAQYYCNIKIIFNVASENFRPIPKIDSTFVNLVPHKKSPYFTHDIKVLSYITNLAFQKRRKILRHSLGKIFSEKIFLKLNVDPKLRAENLSILQYCQLSNYIIENDILKNKNFN

SEQ ID NO: 2477 - protein, 569 aa, Ehrlichia canis str. Jake
MHDSKYLLDIITLLSAAIVIVVLFWKLNISPVLGYFVAGTLIGSNGLNLVESSVIIQNLGEFGVVFLLFLIGIELTFERLIAMRLHVFGFGTLQVIVTASVIWYISNKFGIDSRGSLIIGGALALSSTAIVLQVLQEKGYQSTQVGRLSIAVLLLQDFAVVPLIVLLPLLTGESHHSIPISLLYSFIKAAIALTLIFITGRLLLRPLFNTIAAMKSNEIFIATTLLIVLGAAFITENFNLSMALGAFVSGLLVAETEYRHDVEQVVLPFKRLLLGLFFMTVGMSIDIKFVLNKLPIITLASISLIALKSFIIFILCRFFRFQLAAAIQAGLLLSQGGEFAFILFGLAAEKNVLSSDLAQTLMMITTVTMAFTPLLAALGDWISKLITKKKISLNSQELTLDTKDLDQHVIVVGFGRVGRMVAKVLVAEHVNYIASDIQPKIVKDGIDEGYPVYLGDLTKLNTLQSMAISRARMIIIAINNEVTIKKIISLVAKNFPHIIIIVRLPDLNNVEIYKELGAHYLIPETYEVGLQLGAVALSNSGFSNHAVALLKDRFRMVNYDVVKNKESDE

SEQ ID NO: 2478 - protein, 282 aa, Pyrococcus abyssi GE5
MREITPRKIIEMKGKEKIAMITAYDYPSALLADKAGFDIVFVGDSLGMVVYGEPNTLNVSMEQMVFHTRAVARAVKRALVLADMPFGSYEVSVEEGIKNAIKLIQAGADAVKIEGGYDHKKLVKRLVRMGIPVMGHTGLTPQRYLRLGGYRIMGSTEEEVEEIIRDAKALEKAGAFAVVLEFVLADVAKLVTEEVSIPTIGIGSGPYVDGQVLVWHDVLGLYEESPPFVKRYANLRDEILGAISEFKKDVKEGKFPGREHYWEFQDKEEFKRIKESVLRKVD

SEQ ID NO: 2479 - protein, 364 aa, Arabidopsis thaliana
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 2480 - protein, 245 aa, Frankia sp. EAN1pec
MPTLVLLRHGESTWNRENLFTGWVDVDLSEKGLKEATRGGELLQEAGVLPDVVHTSLLTRAIRTAWLALDAAGRTWVPVRRSWRLNERHYGGLQGLNKAETLAKFGDEQFLLWRRSYDTPPPPIEPGQPSGVDERYADLAPDVIPLTECLRDVVVRMLPYWYDSIVPDLRSGATVLVTAHGNSLRALVKHLDGISDTDIANLNIPTGIPLRYELDDDLKVLDSGYLDPAAAETAAAAVAAQGKKK

SEQ ID NO: 2481 - protein, 451 aa, Rubrivivax gelatinosus PM1
MADAPSSLAEFARSAGASLAAEGVHTLLVQFTDLHGVAKGKLVPLHQLETVLTDGAGFAGPSIWGTGLPRTGPRAEYYARGDAATLQALPWMPGVARLVGDGFVNGGAFDACPRQVLKRATARLAARGWTLQTGIEPEFFLLRREGVRYVPVDDADRLDKPSYDLKSLPRQQGFLQALRVALEGAGLQVLQIDHEDAHGQYELNFRHDEALRSADHVMLFKLAAHALAEQRGCVFSMMPKPFANQPGSGLHFHVSLWDAGRCLFDAADAAEPLSRLGRQFVAGVLAHSAALCALAAPTVNSYKRLVVGESLSGTSWAPAYVAHGPNNRTALVRTLAGRFEWRVPDASANPYLATAALIAAGLDGIDRELDPGPACTDDLFALSLAEIRTRRIAMLPQSLGEAVDAFEASELLHGALGDTLHREFVRLKRAEWIDYARHVSDWEHARYGATF

SEQ ID NO: 2482 - protein, 126 aa, Brassica napus
MQTVSVDETKNTVVLRAEHRDEEGRKAVDKFELKTRNPETIKQVEKKLMEKGVQRMERHPADGIPLKKQPKSGHGGKYTWEGPDRVEDYEMQPDPPAMDEGDPNYDEKQAKKNTGGGGDDVAVELV

SEQ ID NO: 2483 - protein, 586 aa, Pseudomonas putida KT2440
MHAISFIQDLAVIMLVAGVVTILFHRFKQPVVLGYIVAGFIIGPHTPPFGLIHDEDTIKTLAELGVIFLMFCLGLEFSLRKLFKVGATAFIAAFLEIVLMIWIGFEIGRWFGWSTMDSLFLGAILAISSTTIIVKALNDLKMKNERFAQLIFGVLIVEDILGIGIIALLSGIAVSGTVSSGEVFSTVGKLSLFMVVALVIGILLVPRLLAYVARFESNEMLLITVLGLCFGFCLLVVKLEYSMVLGAFLIGAIMAESRQLLKIERLIEPVRDLFSAIFFVAIGMMIDPEVLIDYAWPIVVITLAVVLGKMLSCGMGAFIAGNDGRTSLRVGMGLSQIGEFSFIIAALGMTLQVTSDFLYPVAVAVSAITTLLTPYLIRAADPLSQKLGNVVPARLARVLSLYGEWLRNIQPQGESAMLAAMIRRILLQVGVNLALVIAIFFSGGYFAGRLGNWLSEWVSDVSHQKAVIWGAALLLSLPFLIAAYRKLKALSMLLAEMGVKPEMAGRHTQRVRRVIAEVIPLLSLLVIFLLLSALSASILPTSELLLVIAVVAAVVVALLWRWLIRVHTRMQIALLETLENSRENSH

SEQ ID NO: 2484 - protein, 596 aa, Zea mays
MAGGGKKEKGEGLGRALIRQRNKAAAAAKERGEALAFGRRRAMPLESVIDVSDIDAVLQRAAEADQLAEAASVSSDSDLVIDLDATGETEDDRRRLRKEQEALHASSLRVPRRPPWHSQMTVEELDVNERRAFLVWRRNLARLEENDKLILTPFEKNIDIWRQLWRVLERSDLLVMVVDARDPLFYRCPDLEAYAKEIDEHKRTILLVNKADLLPLNIRKRWADYFKAHDILYVFWSAKAATATLEGKKLSGYSEGESASLDLDTKIYERDELLMKLQAEAESIVAQRRISPTVDDHEASSSDSVSSVTKHVVVGFVGYPNVGKSSTINALVGEKRTGVTHTPGKTKHFQTLIISEELTLCDCPGLVFPSFSSSRHEMVACGVLPIDRMTKHREAIQVVADRVPRDILEQIYKIALPKPKPYEPQSRPPTAAELLRAYCASRGHVSHAGLPDETRAARQILKDYIDGKIPHFELPPGVTGPEVDFEQIAGSESPTTSAANESVTDDLDEEDDDAVDPAESNMRDVLDDLESFDLGNGGSKTTAKKKEASHKHHKKPQRKKDRSWRVGNDGGDGTAVVRVYQKPAVNLSTVSLSGRV

SEQ ID NO: 2485 - protein, 535 aa, Magnaporthe grisea 70-15
MAKPPRMVICREQQCRRAGIFAVMAMQPEHENTAMWDMKTSEANTGTKIPDGNLGTNKTQPSCTNRRSKTMATTAEGDFLWGATMQARARKLLLEYQERYVAANPKSADSFGRASVSLAGGNTRSVLHYDPFPMVLVSGRDCFVSSEDGREYVDFVSEYSACMLGHSHPAVAEAVQAVMSRGINLGGASKEEQVLAALLTERIPSMARVRFCNSGTEANTMALTLARHHTGRRKILAFENGYHGGFIGFDSGVLPTTVPFEFVLARYDDATHVRELVDDSFAAIIVEPMQGVGGMIPASRRFLQTLREVADATSAVLIFDEVVTSRLNYNALQSHHGVFPDLTTIGKFWGGGGGGFSFGAFGGKADIMAAMDPPALGGSTSSAQQQRLSHSGTFNNNAFSMTAGAVACRLITREAIARANALGDRLREGITAAGRNAEASPWMWASGFGSMLNVHFGGFAAAELRDLFFFFMLDRGFYVSRRGLIALNLMHTDHHNSRSSSRHSSLVYKIEVLYLMQFFAITMFRNQKLILVSYS

SEQ ID NO: 2486 - protein, 499 aa, Escherichia coli K12
MSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 2487 - protein, 464 aa, Bacillus thuringiensis serovar konkukian str. 97-27
MDKNLKKDLKIRHITMISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 2488 - protein, 357 aa, Thermococcus kodakarensis KOD1
MKLVHDPVHGYIELDEFARKLVDTPEFQRLRRITQLGFAFLAYPSARHTRFEHSLGTFHLAKKIRAHNPEIEEGALYAALLHDIGHYPFSHTLEGLYPRHEENTLWVIEHGSVGDVIKENYSTQEFKKLLKHPIVSGDIDADRMDYLVRDAYYTGAAYGVVDLERLVRNLKFDGKMLVVEEKGIMAAQNLLLSRAMMYPTVYFHHTAKIAEAMLRKAVEIEGISLEEIRIMDEIDLVSRLRSSEKPEVRELIRAIDDRKLYKRAYCSNRELDEKTISTLKRELQEEFGYSALLDYPPKPKYEERNAFVKIGSETKRLSEVSPLVRSLVEMKDVYWRWCVYAREDVREDVEAFPKKLF

SEQ ID NO: 2489 - protein, 952 aa, Silicibacter pomeroyi DSS-3
MAFKLTDYEAYDFANRRHIGPSPREMADMLQVIGFKTLDQLIDATVPPSIRQKEALDWGPAMTERDALYHMKQVASKNKVLTSLIGQGYYGTTTPAPILRNILENPAWYTAYTPYQPEISQGRLEALLNFQTMVSDLTGLDVANASLLDEATAAAEAMAMAKRSSRSKANNAAFFVDKNCHPQTVAVIRTRAEPLGVDVQVGDPSELEAGAVFGAIFQYPGTYGHVRDYTAEIAALHEHNAIAIVAADILSLALLKSPGEMGADIAIGSTQRFGVPMGYGGPHAAYMATTDKLKRAMPGRIIGVSIDARGNKAYRLALQTREQHIRREKANSNVCTAQALLAVMASMYAVYHGPDGIKAIAQSVHRKTSRLAAGLEEHGFKVAPEVFFDTITVDVGPLQKTVIEAAVARGVNLRKVGSDRIGISLDEQTRSETIEAVWGAFGIDKKDDSVKNRAYRLPDYALRETPYLTHPIFHKNRAEAEMTRYMRRLADRDLALDRAMIPLGSCTMKLNATIEMIPVTWPEFANLHPFVPEDQAQGYLEMIDDLSEKLCQITGYDAISMQPNSGAQGEYAGLMTIRNYHAAQGQGHRNICLIPTSAHGTNPATAQMVGYQVVPVRSDDHGNIDLADFRAKAEQHSANLAACMITYPSTHGVFEETVREVCDITHEHGGQVYIDGANMNAMVGLAQPGEIGGDVSHLNLHKTFCIPHGGGGPGMGPIGVKAHLAEHLPGHPEYGTAVGPVSAAPFGSPSILPVSWAYVLLMGGAGLTQATKVAILNANYIAARLKDAYPILYTSATGRVAHECILDTRPLNDEGGVSVDDVAKRLIDSGFHAPTMSWPVAGTLMVEPTESEPKDELDRFCEAMLSIRAEAQQIIDGKIDPENNPLKHAPHTVRDLVGDWDRPYSREQACFPPGNLGVDKYWPVVNRVDNAYGDRHLVCTCPPMDAYEEAAE

SEQ ID NO: 2490 - protein, 104 aa, Oryza sativa
IPRAAGIRHEGDARALPNPTQPAAKKARSAAAAGVRRRRRAPCLLYRRLVARTNQLESEKAQKEAEVQKVVEENVRLRAMIDKKEAQLQAMSEQCKFMALSRPN

SEQ ID NO: 2491 - protein, 612 aa, Candida glabrata CBS 138
MENKEHHHHHHHHHHHHSNGSYVSNKVSSLADGSRVGNYQIVKTLGEGSFGKVKLAYHVTTGQKVALKIINKKVLAKSDMQGRIEREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISILPTSLPQIHRANMLAQGLPAASKISPLVTKKSKTRWHFGIRSRSYPLDVMGEIYIALKNLGAEWAKPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 2492 - protein, 421 aa, Zea mays
MPDAIPACFRAAAAPSGRASPAPSGSGSGSGAGTSLATSVYDTRLGLATLSWSRAPLGLSLRAVLRVSAGPAPAPSPSASDYGDGEVEYDDEEEEATVAVRVRPWLLWRRRGSKRFRVRERRVELAWDLSRARFPPSGSPEPSSGYFVAVVVDGEMAVVAGDMADEAYRKTRARRPAGPGPVLVSRREHVSMRDGAGGGGRCHRTCVVVRGREREISVDLVSRAQGQGRERDRAEVGMSVSVDGDRVLHVRRLRWKFRGTERVDLGGGDRVLVSWDLHNWLFPARDASPPDAAAAAPVPPAHAIFVFRFELADAGEERDPADAKEEELLDKAGTGGGGWPGYVSGWGRGDWSESSSNGGEKRRKRGQASRLAKASSSSSASVASSSASWASGSTVMDWGSAEEAQLQSGDGFSLLVYAWKN

SEQ ID NO: 2493 - protein, 399 aa, Burkholderia pseudomallei K96243
MSSNRGVVYQGPGKVEVRKIDYPKMVDPSGRAIGHGVILKVVSTNICGSDQHMVRGRTTAPVGLVLGHEITGEVIEVGRDVETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 2494 - protein, 597 aa, Buchnera aphidicola str. Sg (Schizaphis graminum)
MIDENKKKNTNLNKNEYEEKSILKDLFHFFGKDFCVVQDTCIDFPVIWINKSLLLKVGKFLSSSPKPYNMLFDLHGVDERFRLNRLNLPEADFSIFYHLISIERNSDILIKVPLLKDDLNVSTFISLFPNANWYERETWEMFGIIFDQHPNLTHIIMPNEWKGFPLRKDYPARATEHESFFLDEQKEDLEMENLRFKPELWGMKRKNDNVDFMFLNLGPNHPSAHGAFRIVLQLDGENIVDCVPDIGYHHRGAEKMAERQSWHSYIPYTDRIEYLGGCVNEMPYVLAVEKLANISVPEKVEVIRVMLSELFRINSHLLYISTFIQDVGCMTPVFLAFTDRQKIYDLIEAITGARMHPAWFRIGGVAHDLPKGWNVLLKEFLEWMPKRLKYYVQLALENPILIRRSKGIAQYNQKEALQWGVTGSGLRSTGLDLDVRKWRPYSGYQNYTFEIPIGQGISDCYSRVIIKVEEIYQSLSILKQCLKNMPEGPFKSDHPLTTPPPKERVLKDIDTMITHFLQVSWGPVIPANESFQMIEATKGINSYYLISDGGTMSYRTRIRTPSFPHLQQIPSVIRGSLISDLIVYLGSIDFVMSDVDR

SEQ ID NO: 2495 - protein, 495 aa, Neurospora crassa
MLTPTTLLLLSPLLYLLTLLFRTALYRLRARSLGCSPVAVYPHKDPILGLDLFRESLRAMNTHALLPLWDARFKRYGNTHYTLTLGKWVLMTNEPENVKVILGTKMAEWPIDGPRLHASVAVLGKKSIFTTNGAQWREARGMIRPSFVRDQVADLHCFAKHVGNFLNAIPKDGSTFDMQELLLSMTMDSSTDFLLGCSTNSLLQPSPEAKQFLEDFEYTSREAAKKSRLGTLLNWLPNGEFQATVTRVREYVRAYIRKSQAEKTDKKERDYVFLHEILKSGADEEHAIDQVLSVIIAGRDTTAAAMTACFYYLARNPEAVKKLRKEIFDMEDEMPTWEQLKNMKYLNMIIKEGLRLFPPASTNSRAPIKDTVLPRGGGPDGKQPILVPKGQVVRWSLYSLHRRKDIWGEDAHEFRPERWDENLRVGWEYIPFSGGPRICLGQQFALTQIEYALFKFFRAFKSIEPRDDNGPLLLRTNLTVTFAKGCLVSATPDSN

SEQ ID NO: 2496 - protein, 526 aa, Alkaliphilus metalliredigenes QYMF
MRVLITEKIAEKGIEVLKKEGLDVDVEVGIDRGELLKVINNYDAIIVRSVTKINEEFYQHATNLKVVGRAGNGVDNIDMDGATNRGIIVVNTPEANTVSAAEHTIGLLIASTRNVAQANAKIKNREWDRSNFKGVELQGKTVGVVGLGRIGGLVTTRLQAFGMKVIAYDPYITDERFRKYGVEKKERLQDLIKESDFITVHTPKTEETFGMIGEEEFKVAKKGVRVVNCARGGIIEEEALAKAVKEGIVASAGLDVLVNEPNTTSLLLDLDNVIITPHLGADTVEAQNNVGVTIAQEVFSALKGKMVPNAVNLPTLQYQELEAMKYYLKLGENLGKLYHQLEKEAIEKIEIIYSGAVADMETAVVTLAVLKGIFEPILKERVNYVNARLIAKNRGIAVTESKKMVNGNFMNLIRVKISTKNKEFTVAGTVFAKKDMRIVDVNGFVFDVTPTPYMLVANNTDKPGMIGKMGSLLGENNVNIATMQVSRKHKDKEAMMFLAVDSEVNKETLNIINKAEGILQIKFVKL

SEQ ID NO: 2497 - protein, 238 aa, Rhizopus niveus
MKAVLALATLIGSTLASSCSSTALSCSNSANSDTCCSPEYGLVVLNMQWAPGYGPDNAFTLHGLWPDKCSGAYAPSGGCDSNRASSSIASVIKSKDSSLYNSMLTYWPSNQGNNNVFWSHEWSKHGTCVSTYDPDCYDNYEEGEDIVDYFQKAMDLRSQYNVYKAFSSNGITPGGTYTATEMQSAIESYFGAKAKIDCSSGTLSDVALYFYVRGRDTYVITDALSTGSCSGDVEYPTK

SEQ ID NO: 2498 - protein, 954 aa, Pseudomonas syringae pv. phaseolicola 1448A
MTDRIELTTANEFIARHIGPRAADEQAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADEAELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIAKRVHQLTAILAEGLSTLGLKAEQAFFFDSLTLNTGSRTAALHAAARARHINLREIDDQHLGLSLDETTSQSAVETLWEIFASDGQNLPDFTALAASVPSRLPATLLRQSAILSHPVFNRYHSETELMRYLRKLADKDLALDRTMIPLGSCTMKLNAASEMIPVTWAEFGNLHPFAPAEQSTGYQQLTDELEAMLCAATGYDAISLQPNAGSQGEYAGLLAIRAYHQSRGDEHRDICLIPSSAHGTNPATANMAGMRVVVTACDARGNVDIEDLRAKTVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIESYQEA

SEQ ID NO: 2499 - protein, 319 aa, Campylobacter jejuni
MKKLILTTGPSLGGKINLNQIHQDKFIYRINGAHGDIESIKNTIINLRKQKADIDILIDLPGNKIRTSGISEAIQVEKDKDFSLKIDQFNYKEFYKLVKPGMEVYANDSVFLFIVKEVNDKEIIFTSKSTGLLLNNKGMHVRNLHDNIPFLFEKDKELIKLCNEFDIAYVGASFVRKASDIQEIKQVLHSNTKIISKIETLEAVNNLYSILQEVEYILIDRGDLSTEIGIEKIPRFQNYIVEMAHHNAIKVFLATQILKNMEEKPIPTIAEIDDLYNIAKSGVFGVQLSEETAVGHYVEECVKILNLMQDEINNEKIIL

SEQ ID NO: 2500 - protein, 255 aa, Saccharopolyspora spinosa
MVLVPRRFRATLESMSEQTIALVTGANKGIGYEIAAGLGALGWSVGIGARDHQRGEDAVAKLRADGVDAFAVSLDVTDDASVAAAAALLEERAGRLDVLVNNAGIAGAWPEEPSTVTPASLRAVVETNVIGVVRVTNAMLPLLRRSERPRIVNQSSHVASLTLQTTPGVDLGGISGAYSPSKTFLNAITIQYAKELSDTNIKINNACPGYVATDLNGFHGTSTPADGARIAIRLATLPDDGPTGGMFDDAGNVPW

SEQ ID NO: 2501 - protein, 230 aa, Bordetella bronchiseptica RB50
MSNVVPTPVSPLFAQPFATRLERALQHLRIGRPVILMDDFDRENEADLIVAADKLTVPVMAQLIRDGSGIVCLCLPGETLDRLELPPMVDSNRSRYSTAFTVSIEAREGVTTGVSAVDRVTTIRAAIAPGARSGDVVSPGHVFPLRAQPGGVLTRRGHTEGSVDLAALAGLRPAGVLCELMNADGTMMRGASLERYAAKEGLVALAIDELAAHLQARGATGAPAELAVAA

SEQ ID NO: 2502 - protein, 260 aa, Synechococcus sp. RS9917
MAQALLWPLLDEGVIAAKDVLAVVGHDASVQRLRGRCPAELTLLAATDPAAAAVWASAIQLLAIKPQQLDAVAASVPAVAPEASPLLISVLAGVSLERLQRAFPGRRCVRAVPNTPCLVRAGLTGLAWGQGVTVADRERVKAFFSPVSEVLELAEDRLDAFLALTSSGPAYVALVVEAMADGAVAAGLPRDLSHHLAHRTLAGTAALLQEQELHPSQLKDMVASPGGTTMAALRRLEQAGVRSALIEAVVAAAEHGRQLR

SEQ ID NO: 2503 - protein, 455 aa, Rubrivivax gelatinosus PM1
MVVRDNFTFSELEQWLNERRVTEIECLVPDLTGVARGKILPREKFTEDRGMRLPEAVVAMGVTGEFPEEGPYYDVISPTDQDMHLRPDPTTVRIVPWATDPTAQVIHDCFDRNGKLVPFAPRSVLRRVCELFESEGWNPVVAPELEFYLVARNTDPDVPLKAPVGRSGRSETSRQAYSIDAVNEFDPLFEDVYDYCEKMELNVDTLIHEVGAGQMEINFFHAHPLGLADEVFFFKRTVREAAMRHNMFATFMAKPIAGEPGSAMHIHQSIVSKATGRNIFSNADGTPSQEFYWYIGGLQKYVPAAMALFAPYVNSYRRLVRSNAAPINIQWGTDNRTVGIRSPVATAAARRIENRVIGADANPYAALAATLACGYLGIKNRIEPTPECKGDAYLGDFQLPRSLGEALELLRAEKDLAEVLGESFVTVYTEVKEIEYAEFMKVISPWEREHLLLHV

SEQ ID NO: 2504 - protein, 261 aa, Kineococcus radiotolerans SRS30216
MSRTPLIAGNWKMVLDHQQGTLLVQKLDWTLKDAKHDYSAVEVAVLPSHTSLRTVQTLIEGDKLSIALGAQDVSEHDSGAYTGEVSAAMLAKLGVTYVAVGHSERRQYHGETDATVRAKAAKALAAGLTPIVCVGEALEIRKAEQHVEFTVGQVTQALTGLTAEQAAGLVLAYEPVWAIGTGEVATPEDAQEVCAALREAVAELFDRATADAVRVLYGGSVKPASIAAIMRQPDVDGALVGGASTDAGDFAAIVRFRDHPA

SEQ ID NO: 2505 - protein, 334 aa, Kineococcus radiotolerans SRS30216
MTTRVGINGFGRIGRNFFRAALAQNADFEIVAVNDLTDAKALAHLLKHDSILGKLAEDVRVEGDSIVVGSRTIKVLADRDPANLGWGDLGVDVVVESTGFFTDGEKAKAHLTAGAKKVVVSAPATNDDVTVVMGVNDSDYDGSKHAIISNASCTTNCLAPLAKVLDDAFGIERGLMTTVHAYTADQNLQDGPHKDLRRARAAALNIVPTSTGAAKAIGLVLPQLKGKLDGYALRVPVPTGSATDLTVTVGREVTVDEVNAAYRAAADGPLKGYLTYSDEPLVSSDIVTDPSSCIYDSGLTKVIGNQVKVVGWYDNEWGYSNRLVDLVTLVGASL

SEQ ID NO: 2506 - protein, 282 aa, Glycine max
  misc_feature (169)..(169): Xaa can be any naturally occurring amino acid
  misc_feature (201)..(201): Xaa can be any naturally occurring amino acid
  unsure (1)..(282): unsure at all Xaa locations
FVFLFGELLLTFILVFFLVFSFRMLEVHAHTESCRAARFINGGRAILTGSPDCLILATDVETGSTIARLDDAHEAAINRLINLTESTVASGDDEGCIKVWDIRERSCCNSFNSHEDYISDITFVSDAMKLLATSGDGTLSVCNLRRNKVQAQSEFSEDELLSVVLMKRXRFTDLSSNSIDAMLKLDEDRIITGSENRIINXFSHDRKFLGSISHDQMLKLWDLDNILQGSGNTQSNEAGAVDSDDDEMDLDDDPSKNSKGNKRKNANNGNALGGSNNFFADL

SEQ ID NO: 2507 - protein, 798 aa, Bacillus subtilis subsp. subtilis str. 168
MFSSKERFADLFLKRLEMTCGKSFKDSAKLDQYKTLGNMVREYISADWIETNEKSRSNSGKQTYYLSIEFLLGQLLEQNLMNLGVRDVVEAGLKEIGINLEEILQIENDAGLGNGGLGRLAACFLDSLASLNLPGHGMGIRYKHGLFEQKIVDGHQVELPEQWLKNGNVWEVRNADQAVDVPFWGEVHMTEKSGRLHFRHEQATIVTAVPYDIPIIGYETGTVNTLRLWNAEPYAHYHGGNILSYKRETEAVSEFLYPDDTHDEGKILRLKQQYFLVCASLKSIVNNYRKTHKSLSGLHKKVSIHINDTHPALAVPELMRILLDEENMSWEEAWHITVHTISYTNHTTLSEALEKWPIHLFKPLLPRMYMIIEEINERFCRAVWEKYPGDWKRIENMAITAHGVVKMAHLAIVGSYSVNGVAKIHSDILKEREMRDFHLLFPNRFNNKTNGIAHRRWLLKANPGLSAIITEAIGDEWVKQPESLIRLEPYATDPAFIEQFQNNKSKKKQELADLIFCTAGVVVNPESIFDVQVKRLHAYKRQLLNVLHIMYLYNRLKEDSGFSIYPQTFIFGAKASPSYYYAKKIIKLIHSVAEKVNYDPAVKQLIKVVFLENYRVSMAERIFPASDVSEQISTASKEASGTGNMKFMMNGALTIGTHDGANIEILERVGPDCIYTFGLKADEVLSYQENGGYRSREYYQHDRRIRQVADQLINGFFEGEADEFESIFDSLLPHNDEYFVLKDFSSYADAQERIQADYRERRKWSEHSIVNIAHSGYFSSDRTIREYAKDIWGIKPMM

SEQ ID NO: 2508 - protein, 235 aa, Gibberella zeae PH-1
MPATIPQNNFDSIPDSIEAFRNGEFLVVLDDPSRENEADLIIAAEDVTTEKMGFLIRHSSGYVCVPLSPELTKSLDLPQMVPNNQDPRGTAYTISVDSADPSVTTGISATDRALACRTLADPKARPDSFRRPGHVLPLRARPGGVRQRPGHTEAATEFCRLAGKAQAAAICEIIDDGEETPGQALVQNHGMLRGEACITFARKWGLKVCTIADLVAYVEKTEGKLESNGAETEGN

SEQ ID NO: 2509 - protein, 428 aa, Pseudomonas putida KT2440
MVLLRGNILQMNYSDPVTFEILGVVANYGQEGCFMLAQLPPALQSLHLPLRLKLWDGNHFDLGPSPQVTILVKEPQLISQLTHPSMDQLGTAFVEGKLELEGDIGEAIRVCDELSEALLADEDETPPPRVSHDKTTDAKAISYHYDVSNAFYQLWLDQDMAYSCAYFREPDNTLDQAQQDKFDHLCRKLRLDAGDYLLDVGCGWGGLARFAAREYGAKVFGITLSKEQLKLGRKRVQAEGLADKVDLQILDYRDLPQDGRFDKVVSVGMFEHVGHANLALYCQKLFGAVREGGLVMNHGITAKHVDGRPVGRGAGEFIDRYVFPHGELPHLSMISASICEAGLEVVDVESLRLHYAKTLHHWSENLENQLHKAAALVPEKTLRIWRLYLAGCAYAFQKGWINLHQILAVKPYADGHHDLPWTREDLYR

SEQ ID NO: 2510 - protein, 392 aa, Streptococcus suis 89/1591
MDLLNRFNKNLNRIEVSMIRQFDQSISDVPGILKLTLGEPDFTTPDHVKEAAKAAIDANQSYYTGMAGLLELRQAAAEFVAEKYNLHYNPENEILSTIGATEALSASLVAILEAGDTVLLPAPAYPGYEPIVNMVGADIVEIDTTANDFVLTPEMLEEAIIEQGDKLKAVILNYPANPTGVTYSREQIQAFADVLRNYPVFVLSDEVYAELTYTGQPHTSIAEFLPEQTILIQGLSKSHAMTGWRIGLIMSQAPIIAQIIKSHQYLVTAASTAMQYGAVEALKNGKDDALPMRAEYVKRRDYIIEKMTDLGFKIIKPDGAFYIFAKIPAGYNQDSFSFLQDFARKKAVAFIPGAAFGQYGEGYVRISYAASMEKIQTAMACLKEYLEENGTN

SEQ ID NO: 2511 - protein, 576 aa, Arabidopsis thaliana
MVKKEKKANVSGKPKHSLDANRADGKKKTTETRSKSTVNRLKMYKTRPKRNAGGKILSNEYQSKELPNSRIAPDRRWFGNTRVVNQKELEYFREELQTKMSSNYNVILKERKLPMSLLTDNKKQSRVHLLDMEPFQDAFGRKTKRKRPKLVASDYEALVKKAAESQDAFEEKNGAGPSGEGGEEEDGFRDLVRHTMFEKGQSKRIWGELYKVIDSSDVIVQVIDARDPQGTRCHHLEKTLKEHHKHKHMILLLNKCDLVPAWATKGWLRVLSKEYPTLAFHASVNKSFGKGSLLSVLRQFARLKSDKQAISVGFVGYPNVGKSSVINTLRTKNVCKVAPIPGETKVWQYITLTKRIFLIDCPGVVYQSRDTETDIVLKGVVRVTNLEDASEHIGEVLRRVKKEHLQRAYKIKDWEDDHDFLLQLCKSSGKLLKGGEPDLMTGAKMILHDWQRGRIPFFVPPPKLDNVASESEVIVPGIDKEAIADNSQAAAALKAIAGIMSTQQQKDVPVQRDFYDEKDLKDDKKAKESTETDAENGTDAEEDEDAVSEDGVESDSDADEDAVSENDEEDESDSAE

SEQ ID NO: 2512 - protein, 146 aa, Anaplasma marginale str. St. Maries
MMFEKTLSILKPDVVERGIIGRVLSYIEAAGLRIVAQRMCALSHEQAEAFYAVHKARPFFPSLVGFMTSGPVVVQVLVGESAVKTYRDVMGATNPSEAAPGTIRGDLAESIDANCVHGSDSLENAEWEIKFFFKEHEIMSSMPNGK

SEQ ID NO: 2513 - protein, 535 aa, Aspergillus nidulans FGSC A4
MYNAHRGMVPAPNSRLNELLDQLRQEFENQSRSTGEFEHQLTGQLQEMEMIRQKVYQLEQAQLKMKQDYEAEIRMLRHELESRGVQPVASHVAVPAQHGGPSQAPPPALGHGPSNLFGGIMANQGGYGPPPPPTASPGPGKRPRAPPGPATPQQAHQLAYPESRVSPQLARPTPPNQPVVRDRPGNMLANWNPEDLPPSQKKEGVDWYAVFNPEVQRVLDVELVHHLVHDSVVCCVRFSRDGKYLATGCNRSAQIFDVTLGQNVAVLQDESVDKSGDLYIRSVCFSPDGKYLATGAEDKQIRVWDIATRTIKHIFSGHEQDIYSLDFAGNGRYIASGSGDKTVRLWDIAEGKLVYTLSIEDGVTTVAMSPDGLYVAAGSLDKTVRVWDTTTGYLVERLENPDGHKDSVYSVAFAPNGKELVSGSLDKTIKLWELNLPRQQYNSAGKGGKCHRTFEGHKDFVLSVCLTPDGHWVMSGSKDRGVQFWDPITGNAQMMLQGHKNSVISVAPSPTGNLFATGSGDMRARIWRYSAYTGR

SEQ ID NO: 2514 - protein, 395 aa, Silicibacter pomeroyi DSS-3
MKTTAITRRLTDLGGAKWGIYLRAKAMIAKGADVISLTIGAPDVPPPAELMDVAEAAMRAGRTTYSDGAGEPGLRAALAERYSASTGRAISADQVMCFPGTQTALYAVLMGVAEEGDEVLVGDPMYATYAGVIRATGADLVPVPLRPENGFRITAADIAARITPRSRAILLTTPHNPTGAILTPEDIAAIGDLACKHDLWIISDEVYEQLVFDGQGFSSPLAQPDLAERVIVVSSISKSHAAPGFRSGWCIGSEAFTAALLPLSETMLFGNQPFIADMTEAAVRNGSSVAPGMRARYAARADRLAARLNGRTCLHVLKPQAGMFAMIDVSGTGMTGEAYAAHLLDHAGVAVMPGASFGDTIDGWVRVALTADDAAFDTACERIAAHAAEFQSEDA

SEQ ID NO: 2515 - protein, 262 aa, Roseovarius nubinhibens ISM
MSGELSPIDQAKFVAAKKAVEYVEDGMRVGLGTGSTAAWMVRCLGEMVREDGLRIKGVPTSTRTAALAQELGIDVVSLDEAKWLDLTIDGADEFDGELNLIKGGGGALLQEKIVATASDQMIVIADVGKEVESLGHFPLPIEVIPFGWQTTRALVEEMLVSMDVLGRDVTLRMSGDRPYVTDEGNHILDLHLGRIGNPRQLSMVLNQVPGVVENGLFIDICDIVCVGYGDGRVEVRDINDGTVRQDRLDFVESDNLFSDLSD

SEQ ID NO: 2516 - protein, 317 aa, Aspergillus oryzae
MPQYNAPTTAEEVANDCRASIANKTILVTGVTLGSLGAGFATAIANYAPSLIILAARDVTKAQQTATEISIINPSVKTRILHLDLGSQVQIREAAKEVLEYEEHIDVLVNNAGVMAPPFSLTQDGVESQFGINHIGHFLFTNLIMSKLVTPGKSSRVVNISSDGHRLGPIRFDDWNFDDGNTYDPWLAYGQSKTANMLFSVSLAQKLGTKGLISVSLHPGVVSTQILRHDVDESVKALDETAICYYYIRYESVAANLTEIISEFASSRLQKALSEAYRTIRRLRPIVERDRRDGSGACYRELKQHLSPGTFKATSGL

SEQ ID NO: 2517 - protein, 247 aa, Treponema denticola ATCC 35405
MRLVLVRHGESEWNKLNLFTGWTDVDLSEKGVEEAKEGGTYLKKEGFDFDICYTSYLKRAIHTLNYILSQMDREWLPVIKTWKLNERHYGGLQGLNKAETAEKYGEDQVKIWRRSFDIAPPVLEEGDKRCPYLQEQYRGIEKSELPLTESLKDTIARAVPFFEKTIKPQMLEGKRILITAHGNSLRALVKYFENLSDEEIISVNIPTGVPLVYEFDKNFKVLSKRYLGDQEKINAKINAVANQGKKK

SEQ ID NO: 2518 - protein, 509 aa, Bacillus thuringiensis serovar konkukian str. 97-27
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 2519 - protein, 251 aa, Bacillus thuringiensis serovar konkukian str. 97-27
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 2520 - protein, 545 aa, Yarrowia lipolytica CLIB122
MLGRTLLVSDHCVDITASIFPGSSHPFTTTNPAMNTFHLLIALATFVVVYILSSSFVYQRRTNALEKQWKCGKPLYYASFPRSLWHFYVFLRESRKHKLLEGFQRSFEAKKPFLTNKVNIFGKDIFNTCDPENLKAMLATQFKDFCLGERHAQLFPVLGDGIFTLDGNGWQHSRAMLRPQFARDQVSDVHMVETHLKFLTSRITGSKPVDMQELFFNLTLDTATEFLFGQSVGCQIAESDPGAYSSDMPLDLRKSFQKDFNKAQEHLGERVRLQMLYWLWNPKELQTAGARVHAFVDHYVSKALVEAEEKVDDDKYVFLRELARETKDPKVLRDQALNILLAGRDTTASLLSWCFYLMARDDRVWQKLRSEVIEHFGDGENLENITFESLKRCDYLRYVLNEVLRLYPSVPANMRFATKDTTLPRGGGPVGQDPIVIRKGNVISYHVFTTHRLTQYWGEDAEEFVPERWAEGKARGWEYLPFNGGPRICLGQQYALTEAGYVLVRLAQMYDTLENADDKPEPPVKLHALTMSHLTGVHVKLYKKN

SEQ ID NO: 2521 - protein, 295 aa, Yarrowia lipolytica CLIB122
MGLSVAEIKKLMADLEKASGEAVYDILQVLHKEVEPTEKLLRETKLGIAVNKLRTSSDSRISDLVKKMIKSWKDTVTAQKRDASKKVEGKKETKEESRPVKSSSASSGNATSYTPPSGQRTPAKDGVSTEIYSDKVRNRCIDVTYTALAVGMTAHPNEVLACAKAIENEVYKMENGTGGNYRPKMRSLYINLKDPKNPGLRGNVISGKISAERLCRMSPQEMASDELKKEIEEMEKQNLFAARGATEQRAVTDRFTCGKCKQKKVSYYQMQTRSADEPLTTFCTCENCGTRWKFS

SEQ ID NO: 2522 - protein, 252 aa, Idiomarina baltica OS145
MSNASLVIANWKMNGNRALTRNMSEVLRDNQADFKGVNVVICPPYTLLSEMAGHIYYDDVALGAQNVSEYESGAHTGEVSVAMLQELGVEYVLLGHSERRAEQHESDQLVAAKAATVTQAGLTAVICVGEDKAQREADNTWSVIQAQLEKSLAGLSAKQMARVVVAYEPIWAIGTGETASPAQAQEVHAKIRGWLVENYQQVGAKTPLLYGGSVKANNAESLFSEADINGGLIGGASLNGEDFCAICRAAKG

SEQ ID NO: 2523 - protein, 447 aa, Desulfovibrio vulgaris subsp. vulgaris str. Hildenborough
MDIPVFNCKNGDDVIRAVKEYNVSFVQFWFVDILGNLKSFQVTPSELEAAFEEGMGFDGSSILGFTRIEESDMVAFPDATTFQICSWRPLERPVARMFCDIRTPDGTPYEGDPRYILRKLIDKAAQKGYTFYVGPELEFFFFSSPQCPTPIDAGGYFDAPPLDLGNDVRRDIIFALQRMGIPVEYSHHEVAPSQHEIDLRYNEAMKMADVVMTYKVVVKEMARKHGIYATFMPKPIFGENGSGMHVHQSLFRNGKNAFFDPNDQHNLSHECRSYIAGLLKHAREFCCVTNQWINSYKRLVPGYEAPVYIAWAQRNRSALIRVPMYKPGKEAATRIELRSPDPACNPYLAFAVMLGAGLEGIENNYELPKAVEANIFHMGEEDLGKHGIGSLPGSLYEAAMELRNSNLMKEILGEHTHANIVGNKLIEWDDYRTHISEFELKRYLPIL

SEQ ID NO: 2524 - protein, 534 aa, Arabidopsis thaliana
MGKKSGSSSSWLTAVKRAFRSPTKKEHNNNAHGNEVDEDEDKKKEKRRWLFRKSTNHDSPVKTSGVGKDAPAQKSTETTTIINPTVLSSVTEQRYDASTPPATVSAASETHPPSTTKELPNLTRRTYTAREDYAAVVIQTGFRGYLARRALRALKGLVKLQALVRGHNVRKQAKMTLRCMQALVRVQSRVLDQRKRLSHDGSRKSAFSDTQSVLESRYLQEISDRRSMSREGSSIAEDWDDRPHTIEEVKAMLQQRRDNALRRESNNSISQAFSHQVRRTRGSYSTGDEYEEERPKWLDRWMASKPWDKRASTDQRVPPVYKTVEIDTSQPYLTHGNSRTGASPSRSQRPSSPSRTSHHYQQHNFSSATPSPAKSRPIQIRSASPRIQRDDRSAYNYTSNTPSLRSNYSFTARSGYSVCTTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 2525 - protein, 276 aa, Methylobacterium extorquens
MQHATDLISIIALGLVCAFIGGMLAQRMRLPPLVGYLVAGIAIGPFTPGFVGDPALASQLAELGVILLMFGVGLHFSIGDLLAVRTIALPGAIVQITVATAMGAGLAWGFGWGAGAGLVFGLALSVASTVVLLRALEGQGLLDSDKGRIAVGWLIVEDLAMVVALVLLPALAPSLGGEAMQAAGHHGPPEHGLWVTLGLTLAKVGVFVAVMLVGGRRLIPYLLGLAARTGSRELFTLAVLASAVGIAFASSELFGVSFALGAFFAGMVLAESDLSH

SEQ ID NO: 2526 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPNINPVLLPKKTAEKEGKAPKSPKKAAKSPKKAATPKKA

SEQ ID NO: 2527 - protein, 154 aa, Haloarcula marismortui
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEAELVDWDQIDSSWLYE

SEQ ID NO: 2528 - protein, 358 aa, Solanum tuberosum
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYEAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVVPEVIAEYTVRALQRTMPAAVPAVVFLSGGQSEEEATRNLNAMNKLQTKKPWTLSFSFGRALQQSTLKAWSGKEENIGKAQAALLTRCKANSEATLGKYAGSSNLGDGASESLHVKDYKY

SEQ ID NO: 2529 - protein, 232 aa, Synechococcus elongatus PCC 6301
MDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 2530 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 2531 - protein, 449 aa, Sulfolobus tokodaii str. 7
MDMHPWLPNIKYIEEMLKSIGVNSIDDLFIDVPEEIKLKKELDLDYKKPLSEYEIILKLQELQNKNKRLKMPPFLGGGLCPHYVPEVVKFIIKRSEFYTAYTPYQPEISQGLLQALFEYQSLIAELFEMEVVNASLYDWGSALAEAIMMANRINKKKTVLVPKLMNPYHKEVVKTWTYGKGIKLVEIPPNERGTIDVSKLESMINEDDVSAIYIQQPNFYGIFEDEIEYIVDIAKKKKIITIMGVSPLALGLIKPPGEYEIDITVGDGQELGLSLNFGGPLLGILATRWDGQLVRQMPGRIVGLTKDSEGKRGFTLILQTREQFARREKATSNITTNEALMAIAAAVYLSLLGRNGIKELAKEIYIRSHYAKKRLEELGVNTVYNGDFFEEFAVDFRTDYDIIHSRLLEKNIHGGLKLGKTQALFCVTEVHTKSMIDELIESIREVFSG

SEQ ID NO: 2532 - protein, 421 aa, Candida glabrata CBS 138
MISLERAKELVEQKQYAEAEQVYLGILNQEVPMDEKKKDEREKAILAMGDMYVEQGDKAKLREFIPHSTEYMMQFAKSKTAKVLKTLIEKFSLVPNSLEDQIYVCKQSIDFAKREKRVFLKHSLEIKLATLHYETKEYKDSLALIENLLREFKKLDDKPSLVDVHLLESKVYHKLRNLAKSKAALTASRTAANSIYCPTVTVAELDLMSGILHCEDKDYKTAYSYFFESFESFHNLSTSNSYDKACQVLKYMLLSKIMLNLIDDVKSILNAKYTKETYQSRGIDAMRAVAEAYNNRSLHEFNTALKQYRTELMSDELTRSHFNALYDTLLESNLCKIIEPFECVEIAHISKMIGLDAQHVEGKLSQMILDKVFSGVLDQGNGWLYIYDTPHQDATYDSALELVGQLNKVVDQLFDKASVLY

SEQ ID NO: 2533 - protein, 381 aa, Zea mays
MAMATAKLSSPATSLLAGGRARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLIPHEGSNNESWCQGLDGLASRCAEYYKQGARFAKWRTVVSIPCGPSALAVKEAAWGLARYAAIAQDNGLVPIVEPEILLDGDHGIERTLEVAEKVWSEVFFYLAQNNVLFEGILLKPSMVTPGADHKEKASPEAIAKYTLTMLRRRVPPAVPGIMFLSGGQSEVEATLNLNAMNQSPNPWHVSFSYARALQNSVLKTWQGRPENVEAAQKALLVRAKANSLAQLGRYTGEGESDEAKKGMFQKGYTY

SEQ ID NO: 2534 - protein, 483 aa, Pseudomonas aeruginosa UCBPP-PA14
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVQAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 2535 - protein, 281 aa, Triticum aestivum
  misc_feature (186)..(186): Xaa can be any naturally occurring amino acid
  misc_feature (197)..(197): Xaa can be any naturally occurring amino acid
  misc_feature (222)..(222): Xaa can be any naturally occurring amino acid
  misc_feature (242)..(242): Xaa can be any naturally occurring amino acid
  misc_feature (255)..(255): Xaa can be any naturally occurring amino acid
  misc_feature (272)..(272): Xaa can be any naturally occurring amino acid
  unsure (1)..(281): unsure at all Xaa locations
TIEQVCTKKQAGTGPEFPGYRRPTRPVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTXAKLVAKYGPRXPILSVVVPVLTTDSFDWTVSSEGPXRHSLIYRGLIPLLAEGSAKXTDFESNEEILQAXLKSAVKKQLCKVGDAVXLLHRIGVAS

SEQ ID NO: 2536 - protein, 599 aa, Aspergillus oryzae
MSPFNSGTRSESSSPVQKNVKKWWKESTVYQVYPASFKDSDGDGIGDIQGILSKLDYIKSLGANILWLNPIFCSPQVDMGYDISDYYNIYRPYGTVEDLDQLIAAIHERGMKLVLDLVVNHTSDQHRWFQEARSSKANPYRDWYIWRKPIYGEDGKPQPPNNWKSYFGGSVWEYDEPSGEYYLHLFAKEQPDLNWENPYVRAAVHDIIRYWLNKGADGFRMDAINLISKDQNFPNAEITNPDSPWQDGTKHFACGPRLHEYLQGIGKILKQYDAFSVGEMPEVYDLNEMLRSVGSDRNELSMVFHFETVSLDHGPGGKFTSRKWELHELKTIVSRWQTFMHENNGWNTLYLENHDQPRIVSRFGSDEPEYRVPSAKMLATFLGFQSGTLFIYQGQELGMPNVPKHWGINQYRDIETLNHWNEITSNAPQNTPLHEACLAEYRLKSRDNARTPMQWDDSPNAGFSSVRPWLPVHDDYQSLNALDQVNDKESVYHYWASVLRLRKAYPDVLVYGSFELLSPEHPDLFVYARMASSGRAVIVTNFRPHEVTWSVPEKAFNSSGDVALSSYPGRTSHSLLQPTVTIKPFEAFVWLSGTETSRL

SEQ ID NO: 2537 - protein, 160 aa, Glycine max
  misc_feature (99)..(99): Xaa can be any naturally occurring amino acid
  misc_feature (119)..(119): Xaa can be any naturally occurring amino acid
  unsure (1)..(160): unsure at all Xaa locations
MGSKDSCRTELRIAIRQLSDRCLYSASKWAAEQLVGIEEDPAKFTPSNTRFQRGSSRICRKSRTHETAAVITPVVGVLYDATPVNVMEKDELVDGDFYXLAKSYFGCREYKTAAHVLRXEQTGRKSVFLRCYALCLMMGQVNKKRLARIPRRDTADGGYL

SEQ ID NO: 2538 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAREFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 2539 - protein, 528 aa, Prochlorococcus marinus subsp. pastoris str. CCMP1986
MTKVLITDPIDQKGIDILSQVAQVDQKIGISNSELASIIHDYDALMIRSGTQVTGDIINSSKKLRIIGRAGVGVDNVDVKAATQKGVLVVNSPGGNTIAAAEHTIAMMLALSRNIPIANSSTFLGKWERKKFVGNELFKKKLGVVGLGKIGTHVAKVANALEMDVYGYDPFVSSERAQQLQVRLSELKTLFEESDYVTLHLPRTSETENLVNMKVLKSMKKNAKLINCARGGIIDEEALAEALNNSLIGGAAIDVFAKEPLDSNSPLLKVDKNLILTPHLGASTREAQENVAVDVAEQIRDVLLGLSARTAVNIPGLSPDIMDSLKPHLQLAETMGLLISQLSGGQIQKLEVRLQGEFVQHPSQPLIIASLKGLLSKALGDRINYVNASLEAESRGISVVESKDEARPEFASGSLQLTTFGDNGEHSVAGSIFADGELRIISIDQYPVNVSPSRFMLITRHRDMPGIIGKLGSLLGDHNVNIASMQVGRKIVRGEAVMVLSIDDPIPTNLLESILEVEGITSSDPVTL

SEQ ID NO: 2540 - protein, 302 aa, Arabidopsis thaliana
MSPSKQRHRSSTGENKSKPVRSGSSSAISEWITESTNGGSLRRVDPDTGTDGWASPPGDVFSLRSDSYLSKKQKTPAGDYLLSPAGMDWLKSSTKLENVLARPDNRVAHALRKAQSRGQSLKSFIFAVNLQIPGKDHHSAVFYFATEEPIPSGSLLHRFINGDDAFRNQRFKIVNRIVKGPWVVKAAVGNYSACLLGKALTCNYHRGPNYFEIDVDISSSAIATAILRLALGYVTSVTIDMGFLAEAQTEEELPERLIGAVRVCQMEMSSAFVVDAPPPQQLPSQPCRTLSSAKVNHDEDED

SEQ ID NO: 2541 - protein, 309 aa, Prochlorococcus marinus subsp. pastoris str. CCMP1986
MTATTFRNKNSNWTISDIPNLDGKTAFITGANSGLGYYTAKALAEKNAHVLLACRSLEKANSAIDKLKSLNPKGKFTPVELDLSDLNNVSEIGLKISSEFENLDLLINNAGIMHPPKTLSKQGFEIQFAVNHLAHMLLTLKFLPLIEKKENSRIVTVTSGAQFFGKVGWNNLKAENYYNKWESYATSKLANVMFALELNEKIKQKNILSLAAHPGIAKTNLFSAQKPKPSPIETFSLELFSPIFQSAEMGALPQLLAATSPMAKGGDHYGPKFNFRGHPKLSPTSPFALNKKERKNLWEKSLEILNSFL

SEQ ID NO: 2542 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 2543 - protein, 444 aa, Geobacillus kaustophilus HTA426
MAKYTRDDILHIVKEENVKYIRLQFTDILGTIKNVEIPISQLEKALNNKIMFDGSSIEGFVRIEESDMYLYPDLDTFVIFPWTSEKGKVARFICDIYNPDGTPFEGCPRYNLKRMLKEMEALGFNAFNLGAEPEFFLFKLDEKGHPTMELNDRGGYFDLAPTDLGENCRRDIVLELEEMGFEIEASHHEVAPGQHEIDFKYADAVKACDDIQTFKLVVKTIARKHGLHATFMPKPIFGINGSGMHCNLSLFRNGENAFFDPNGDLQLSDTARQFIAGVLKHAPNFTAVTNPTVNSYKRLVPGYEAPCYVAWSARNRSPLIRIPASRGMSTRIEVRSVDPSANPYLAMAVLLAAGLDGIRNKLTPPAPVDRNIYVMTKEERLEEGIVDLPATLHEALENLKSDEVMIHALGKHLFEHFVEAKEIEWDMYRTTVHQWELDQYMELY

SEQ ID NO: 2544 - protein, 458 aa, Bacillus halodurans C-125
MSKQQAPVNKNDVVEVTIEDLTHDGAGVAKVDGYALFIPKALPGERLKAKVVKVKKGYGFGRVLNMIEASPDRVEAPCPVFNQCGGCQLQHMSYDAQLRYKQKQVQDVLERIGKITAVTVRPTIGMNEPWRYRNKAQVPVGEREGGLIAGFYQERSHRIIDMDECMIQHEENDKVIRQVKELARELGIRGYDEEKHRGTLRHVVARYGKNTGEIMVVLITRGEELPHKKTLIERIHKAIPHVKSIVQNVNPKRTNVIFGDKTKVLWGEEYIYDTIGDIKFAISARSFYQVNPEQTKVLYDQALEFANLTGSETVIDAYCGIGTISLFLAQQAKHVYGVEIVPEAISDAKRNARLNGFANVQFAVGDAEKVMPWWYAQGVRADVIVVDPPRKGCDEALLKTILNMKPDRVVYVSCNPATLARDLRVLEDGGYETKDVQPVDMFPWTTHIESVAVLELKN

SEQ ID NO: 2545 - protein, 103 aa, Neisseria gonorrhoeae FA 1090
MKQLTLKEAQEFYAVHKDRPFYAGLVEFMTGGPVMIQVLEGENAVLKNRELMGATNPTEAAEGTIRADFATSVSINAVHGSDSVENAALEIAYFFSQTEICPR

SEQ ID NO: 2546 - protein, 347 aa, Escherichia coli K12
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 2547 - protein, 339 aa, Triticum aestivum
  misc_feature (180)..(180): Xaa can be any naturally occurring amino acid
  misc_feature (199)..(199): Xaa can be any naturally occurring amino acid
  misc_feature (219)..(219): Xaa can be any naturally occurring amino acid
  unsure (1)..(339): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTXHAMTATQKTVDGPSSKDWXRGGRAASFNIIPSSTGARKXALAKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 2548 - protein, 800 aa, Arabidopsis thaliana
MAISTMLGSISCCPSPKGYEMVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPILGFFFAGVVLNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQISKNLVQTPEVDKPFHLRFSHCLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 2549 - protein, 161 aa, Arabidopsis thaliana
  misc_feature (96)..(96): Xaa can be any naturally occurring amino acid
  misc_feature (149)..(149): Xaa can be any naturally occurring amino acid
  unsure (1)..(161): unsure at all Xaa locations
MASSSLLKASPALDKYEWVRGLSVLFRQSSCATVVLRNRATFLTVRAAYSYADELGKTAKTIASAGRGILEKDESHATCGKRLDSIGLENTEANRXALRTLLVSAPRLGQYDFGANILEETLYQSTTVGKKKVDVLDEQKIGPGINYDXGLGPLAGPNNES

SEQ ID NO: 2550 - protein, 471 aa, Xanthobacter autotrophicus Py2
MTIKTAKDVLDLIKSEDVKYVDLRFTDPRGKWQHVTFDISMVDDEFLTEGTAFDGSSIAGWKAINESDMLLMPDPATTCIDPFFAETTLSIVCDVLEPTTNQPYGRDPRSIARKAEAYAKSTGIGDAVYFGPEAEFFIFDDVRFKADPYNTGFKLDSVELPTNGDTEYEGGNLGHRVKTKGGYFPVPPIDSAQDMRSEMLAAMAKMGAKVEKHHHEVASAQHELGLKFGSLVTMADHLQVYKYCIHQVANIYGKTATFMPKPVFGDNGSGMHVHQSIWKDGKPLFAGDKYADLSDYCLWYIGGIIKHAKSLNAFTNPLTNSYKRLVPGYEAPVLLAYSARNRSASCRIPYTNNPKAKRVEVRFPDPGANPYLAFAALFMAGMDGILNRIDPGQAMDKDLYDLPPAELKQIPTVCGSLREALDSLAADHEYLLKGDVFQKDFIESYIELKMTEVMRFEMTPHPVEFEMYYSV

SEQ ID NO: 2551 - protein, 379 aa, Shewanella sp. MR-7
MSNEKPQFIKSKAAVAWGPGQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLEEICLLGCGVTTGMGAVMNTAKVEEGATVAIFGLGGIGLSAIIGATMAKASRIIAIDINESKFELARKLGATDCINPKHFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 2552 - protein, 321 aa, Escherichia coli O157:H7 EDL933
MKDNTVPLKLIALLANGEFHSGEQLGETLGMSRAAINKHIQTLRDWGVDVFTVPGKGYSLPEPIQLLNAEQILGQLDGGSVTVLPVIDSTNQYLLDRIGELKSGDACVAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 2553 - protein, 477 aa, Synechococcus sp. RS9917
MGEVSAAPPAWVADAVVYQVFPDRFRRSGRVPIQESLALQPWGSDPRLQGFHGGDLYGVIEALDHLQGMGVTCLYLTPVFSSAANHRYHAYDYLEIDPLLGGDPAFEALIDALHARGMRLILDGVFNHCGRGFWPFHHLLENGAVSPYRHWFHVHHWPLRPYARVGESCGYSCWWNDPALPKFNHHHPAVQEYLLRVGRHWLERGIDGWRLDVPDEVPQPFWQRFRRMVKAVNGDAWIVGEIWGDARPWLQGDQFDGVMNYRMGWSSLSWAAAGELASDFDHPLYPLRPLDGPGLLEIWQQTLSWYRPEVRRAQLNLLDSHDVPRALHSLRGDRAALKLALVLLFLQPGAPCVYYGTEAGLAGGPEPGCREGVPWGEGWPQDLQVLLRDLAGLRHRYSALRDGVLRWRPLANDGLQAEADALLVVLNRSRHRALTLNADSGLIANGRAPHWQLGTWDPDERALGPQSVALFADGGSA

SEQ ID NO: 2554 - protein, 919 aa, Debaryomyces hansenii CBS767
MVLIGIARRGLGFIPAKSSPLSNRNSKMSEEYGRDDAGRKQPKVTRQPEIRRKQGEGRETGKNTGELEGKSKNNVEYSNDIDGEQDKRPGEFLDILHTFPIFKQAPESFVMKIVSQLRFKVYKPKEYVIRKGEPSESMYWIMSGTVGISDGESIQAELGRGSFFGEVGVIFNRPRTATVVTRSRVVVGVLESEALSFVLQYYPSIERKIRDEAQGRLALQDKKCKSGASRCNQNNSYAGGYRDELQTDSVLSPRFLKGFSLFQQMPTYIVEELLSYSELVKIPLFDYVFNEGDNDLDVYFIVSGKVEIINKDLNSKSGRKLTVLEPGCSFGILSFLSHLKGNKGSRRHASAISISPVELLKIQSCKLKLLCKQFSFIIDELEHESLDRTFLVTDKRTDAAPNSPPTTRLSIGFLMNENEDKWSEVSNHSQKNLRIKLLLSYSTYGPRYQNVSPISPISPVENIYSLTTQSQNINTTEQQVNTKKRKLSTEKYPLDFFEARASTESTKNEFVDHGGVKYSDAPNDKKLKLNKNENSLLSTDKSGKKILLKVFEYLTIPELMKLRIVCKQWNDILSTAPGLCNKLDLTPWNTSIDDKSLISITDFVGARPQYIDISNCFHVTDEGFTYMVNEIGISGEIKDLKMESNWEISGMAIMDLSLSIVGRHLEKIDLANCRKVRDDVLERLTGWNPSEINQTNNGLKEDDKMSDVGCKNLKIIDVGYCKHLTDKIMYHISQNANTRLESLNLTRCTTITDQGFEHWNKRSFPNLKKLSLKDCTFLTDKSIISIANSANNLEILDLKFCCALSDVSIDMLCLGCPKLKHLDLSFCGSAVSDFSLVAISLHLRFLERIILKGCIRVTRSGIDSLLSGCSPLNYLNISQCKNAHVYPGGIPAQELKIHSQSKTAFVTAGSYRNIIEIAV

SEQ ID NO: 2555 - protein, 255 aa, Rhodobacter sphaeroides 2.4.1
MGSAMLEGWLGRGLALSAVWVTDPRPSDWLKSLAARGLHLNEALPDEPAVVLVAVKPQMMSEALPGLAALGEGRVLFLTVAAGTPISYYERTLGAATPVIRAMPNTPAAVGRGITALVGNAAASEAQMALAEDLLSAVGQVVRLEGEHQMDAVTAVSGSGPAYVFHLIEALAAAGEAEGLPADLAMTLARATVTGAGELAHRAPESASQLRVNVTSPGGTTAAALGVLMDPESGLPPLLRRAVKAAADRGRELGR

SEQ ID NO: 2556 - protein, 412 aa, Neurospora crassa
MSTKLCQRIARTATLSPTSLVPRSSRLIPIVSSAAVRPSSAIPTRRPFSTTESRYLANVQAGMDKIRDAIAENFGGPAHNIGTTSFSLDDTPDLSGKVAVITGGSEGIGYGVAYTLIKHNLSKLFILSRKREVFDGALASIASELGQDKADRVHWIQCNLEDWAQTAVVAEQIKKDTDRLDILVNNSGRGIMTAGLTSYGVDKHMATNHMGHVVLTSHLLPLLQKTAEETGETVRISNQSSNLHSAAPKGTQFKSLEEINEDVGPNGQYGRSKLAGILYARYFDREVTRKMEGSKGRVVMNATHPGFVSTKQSVKDIHEPYPISGFAISHLAEPFKKDQFEGAVPTVYAVTMANEGGQWICAPAKAEAGTDLAQSDELADNLMELTRKIISEKTWPKSVAKGCPMDDVVVHV

SEQ ID NO: 2557 - protein, 320 aa, Salmonella typhimurium LT2
MKDTTVPLTLISLLADGEFHSGEQLGERLGMSRAAINKHIQTLRDWGVDVFTVPGKGYSLPEPIQLLDADRIHSQLDSGNVAVLPVIDSTNQYLLDRIGELRSGDACVAEYQQAGRGRRGRKWFSPFGANLYLSMYWRLEQGPAAAIGLSLVIGIVMAEVLRKLGADKVRVKWPNDLYLLDRKLAGILVELTGKTGDAAQIVIGAGINMAMRRVEEDVINQGWITLQEAGITLDRNMLAAKLIYKLRAALELFEQEGLSPYLSRWKKLDNFIDRPVKLIIGDKEIFGISRGIDTQGALLLEQDGVIKPWMGGEISLRSAE

SEQ ID NO: 2558 - protein, 567 aa, Synechococcus sp. RS9917
MQQPWWSGAVIYQLIVRSYADGNGDGTGDLQGLSSRLPYLRWLGVDAVWLTPIYPSPLQDGGYDITDFKAVHPDLGDLAAFHRFLTEAHGQGIRVILDLVLNHTSTLHPWFQRARWAPKGSLERDVYVWSDDPQRYADAPVLFRHFEASNWEWDSVAEQYYLHRFLRHQPDLNYDNPLVQEEMLAVVDFWVERGVDGFRLDAVPFLFEEEGSRCEGLPQTHAFLQVIRERLEQQGREVLLLGEAIQPVEEAAPYLVDEELHGAFNFVLTAHLFAAIASGSTRDLRQCLQASHQAVPGCRWALPLRNHDELWLGDGHLVPEEVIQTIRTGLHQGQGHWLNWGINRRLAPLLNGDPGSNRVLHALLYSLPGMPCVYYGDELGMGDWPGLRDRDPNRTPMAWTPARNGGFSTAPDPLLVLPPITAPGYDYRVVNVEVQKQLPGSLLNWHRRMLTCRRLLPALRSGDFALLHCAHPAVIVYVRCSEAMTVLVAANLSAAGASFRLDLSRWQGQRTREVLWGCEFPPASTDWFVYLPAHGFSWWLIGEVDAISDEPGAEPDPADGGEAVMPA

SEQ ID NO: 2559 - protein, 260 aa, Glycine max
MPQGDYIERHRRDYGYRLDHFERKRKKEARQVHKRSAIAQKALGIKGKMIAKKNYAEKAQMKKTLAMHEESTSRRKTDDNVQDGAVPAYLLDRDNTTRAKVLSNTIKQKRKEKAGKWDVPLPKVRPVAEDEMFKVVRTGKRKTKQWKRMVTKATFVGPGFTRKPPKYERFIRPTGLRFTKAHVTHPELKCTFNLELIGVKKNPNGPMYTSLGVITRGTIIEVNVSELGLVTPAGKVVWGKYAQVTNNPENDGCINAVLLV

SEQ ID NO: 2560 - protein, 141 aa, Legionella pneumophila subsp. pneumophila str. Philadelphia 1
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 2561 - protein, 275 aa, Bacillus anthracis str. 'Ames Ancestor'
MHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 2562 - protein, 522 aa, Magnaporthe grisea 70-15
MGNSSSKEGGGGSSRSGSGADRGSDGLQSYPSFSRSDTKESSRSFRSLRSKIPGSGRTDSPRNSAIVTTNGDYGDKSDAASVKSGVSRQGRTDSNLSATSPTDTIQSPIDEPQLPPSPVHASHKQGAKHDVSAAQASGEVDHVSDQPPGQGGVPNPTAQSQTPGQSILVKREDAVNPVRTAGSPREDGVAMSEIKDIDLDDFIKRLLDAAYAGKVTKSVCLKNAEIAAICHRARECFLSQPALLELDAPVKIVGDVHGQYTDLIRMFEMCGFPPNSNFLFLGDYVDRGKQSLETILLLLCYKLKYPENFFLLRGNHECANVTRVYGFYDECKRRCNVKVWKTFIDTFNTLPIAAIVAGKIFCVHGGLSPALVHMDDIRNIARPTDVPDYGLLNDLLWSDPADMEQDWEANERGVSYCFGKKVITEFLAQHDFDLVCRAHMVVEDGYEFFNDRVLVTVFSAPNYCGEFDNWGAVMSVSSELLCSFELLKPLDSNALKSHIKKGRNKRQHMLNSPPASVYPQSV

SEQ ID NO: 2563 - protein, 313 aa, Sulfolobus tokodaii str. 7
MAIYTVKALITDPIDEILIKTLREKGIQVDYMPEISKEELLNIIGNYDIIVVRSRTKVTKDVIEKGKKLKIIARAGIGLDNIDTEEAEKRNIKVVYAPGASTDSAVELTIGLMIAAARKMYTSMALAKSGIFKKIEGLELAGKTIGIVGFGRIGTKVGIIANAMGMKVLAYDILDIREKAEKINAKAVSLEELLKNSDVISLHVTVSKDAKPIIDYPQFELMKDNVIIVNTSRAVAVNGKALLDYIKKGKVYAYATDVFWNEPPKEEWELELLKHERVIVTTHIGAQTKEAQKRVAEMTTQNLLNAMKELGMI

SEQ ID NO: 2564 - protein, 105 aa, Medicago truncatula
MGSGERSFKGFLLHGKKQEFRGVPKGCLAIKVGQGEDQQRFVVPVIYFNHPLFMQLLKEAEEEYGFDHKGAITIPCRVEEFRNIRGLIDREKSLHHNHHVGCFGF

SEQ ID NO: 2565 - protein, 314 aa, Vibrio vulnificus CMCP6
MVNNSIQWFPGHMHKAQKEIAEAIPQIDVIIEVLDARIPFSSENPLISKIRGEKPVVKVLNKRDLADPELTELWIEHLEKEQNVKAMAITTSQTQEVHKILELCRKLAPHREEVGKNIRTMIMGIPNVGKSTIINTLAGRAIAQTGNQPAVTRRQQRINLQNGIVLSDTPGILWPKVENPHSGFRLAATGAVKDTAMEYDEVAFYTVEYLAKHYPEKLKERYQIEELPETDVELMEEIGQRRGALRSGGRVDLHKASEILLHELRSGTLGQITLERPEMITEELVEVELEAARRAEEKAKNKEERRKRYLRNKR

SEQ ID NO: 2566 - protein, 590 aa, Mycobacterium avium subsp. paratuberculosis K-10
MNDAREAVEHHPEEGSHVQDGVVEHPEAEDFDNAAALPTDPTWFKHAVFYEVLVRAFFDANADGAGDLRGLLAQLDYLQWLGIDCIWLPPFYDSPLRDGGYDIRDFYKVLPEFGTVEDFVALLNAAHERGIRVITDLVMNHTSESHPWFQESRHDPDGPYGDFYVWSDTSDRYADARIIFVDTEESNWTFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPADVVEYFGDPSTGGDECHMAFHFPLMPRIFMAVRRESRFPISEILAQTPQIPEMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRTPMQWTPDRNAGFSKANPGRLYLPPSQDPVYGYQAVNVEAQRDTSTSLLNFTRTMLAVRRRHEAFAIGTFEELGGSNPSVLAFVRQVSNDGDTVLCVNNLSRFPQPIELNLQHWSGCIPVELTGHVEFPRIGHLPYLLTLPGHGFYWFQLTACEEDT

SEQ ID NO: 2567 - protein, 247 aa, Solanum tuberosum
MLAVFEQSIGKPPSELSTQKKEAKTEEEIAESFKSWKPDSTFYHLSNGNFMAFSHENENPLHPRSIVVMDDIFCIFSGGLDNTFDLRKHYGLSRQATEAMIMVEAYKVLRDRAPYPPDQVIKELEGKFAFILFDSKASTLFLARDRDGSVPLHWGIATDGSLVCSDDSEFIQASCGKLYTPFPPGCIFISDTGLISFDHPMHKVKGIAREDDEGNVNAVIFQVDLYTKLHSIPRRGSAANWGWCYYG

SEQ ID NO: 2568 - protein, 267 aa, Oryza sativa
MAMASSSSASAAAARGGSLVEEWSGRVKALEAGFRKWMAEQPTHIEAAVTTAVGAVQGAALGGLMGTLTADGGSPFPTPPPPPPNANPQAMASFKQAQALAGGPLVQARNFAVMTGANAGISCVMRRIRGGEDIQGRKKCLFCMCSMAAAFGSGALFSIVSGMGTPNPVANAITTGAAFAIFQGGFFMIGQKFSKPQSEDLYYSRARSMLQKLGLEKYEKNFKKGLLTDQTLPLLTDSALRDVKIPPGPRLLILDQIKRDPEFGKAR

SEQ ID NO: 2569 - protein, 148 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 2570 - protein, 278 aa, Mycobacterium sp. JLS
MAGRTIVITGASDGVGAAAAKRLSRSGENVVVVGRSPQKTAAVADALEADSFVADFSDLAQVRDLAQRLLDAYPRIDVLANNAGGMVNTRETTVDGFEKTFQVNHLAPVLLTTLLLDRLVQCRASVLNTSSMANKFVRTGFDDLDAVQKQSGSVAYSSSKLANILFTKELHRRYHGAGISTAAFHPGPVASNFSAEVDNPMFGVIYRSPLRHLALIGTEQGSDELVWLASATPGVDWRSGEYYHKHKVAKANKLADDAGMAERLWENSLELLGERAVS

SEQ ID NO: 2571 - protein, 92 aa, Prochlorococcus marinus subsp. pastoris str. CCMP1986
MVRILIKSPCSASLIIQYGIKNWPIWEREPCNFSWIYREKEICYIIEGEAKIKTEAGESYLIKSGDLVEFPEGLSCEWKIIKSLKKHFRLGE

SEQ ID NO: 2572 - protein, 440 aa, Photobacterium sp. SKA34
MARFFKPQKRKTDTKHKEITISRLDHIGAGIGHLNNKPVFIDGALPDETVVVQLTEDKKNYARARVIKRLKDSAARIKPHCPIYDQCGGCNLQHLSHQGQVIAKQQALSELMAKFAITEKDDVTQVEPIVGQSEHYRRCARLSVRMLPNGKMVFGFRKKQSKDIVDVNACPVLATTLNDLLPPLRELLSNLKGRKHVGHIELVNADNGRVLLIRHLQPFNDNDLAAIKAFATEHALMLFLAPSSDELDHVLGEQPYYDIDDVRLTFSPKDFIQVNRDVNVKMVEQAINWLDIQPQDRVLDLFCGLGNFSLPLARRAKAVVGVEGVDEMVARATTNAAANGLGNATFYQANLDEDATKLVWAQEQFDKILLDPARAGAAGVMQHIVNLAPSKVVYVSCNPATLARDSQMLLQQGYKLARLGMMDMFPHTGHLESMALFVKS

SEQ ID NO: 2573 - protein, 481 aa, Helicobacter pylori 26695
MIVRTQNSESKIKEFFEFCKENEVEFVDFRFSDIKGTWNHIAYSFGALTHGMLKEGIPFDASCFKGWQGIEHSDMILTPDLVRYFIDPFSADVSVVVFCDVYDVYKNQPYEKCPRSIAKKALQHLKDSGLGDVAYFGAENEFFIFDSIKIKDASNSQYYEVDSEEGEWNRDRSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQVFSEEFIQAYQSLKFNAEVFPWESKPHPFEFITTYSC

SEQ ID NO: 2574 - protein, 140 aa, Brucella suis 1330
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKTFALSIGENSVHGSDAPETAAEEIAYWFSGTEIVG

SEQ ID NO: 2575 - protein, 247 aa, Saccharomyces cerevisiae
  misc_feature (1)..(1): Xaa can be any naturally occurring amino acid
  misc_feature (167)..(167): Xaa can be any naturally occurring amino acid
  unsure (1)..(247): unsure at all Xaa locations
XRTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 2576 - protein, 461 aa, Xanthomonas campestris pv. campestris str. ATCC 33913
MSIRTRSRKSTPKQPESALRRWLKERHITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLEAYAEVKLQPVVAPELEFFLVQKNTDPDFPLLPPAGRSGRPETARQSYSIDAVNEFDPILDLMYDYCDAMELDVDTLIHESGAAQLEVNFTHADALSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIREKLEPTAPISSNGKEQGYDLPRSLGEALDELEGCEALKEMLGPRFVRAYISVKRKEYETFFRVISSWEREFLLLNV

SEQ ID NO: 2577 - protein, 137 aa, Brassica napus
MSYSAAGHGKPGSGKRRIRELLTQSDNRFCADCGAPDPKWASANIGVFICLKCCGVHRSLGTHISKVLSVTLDEWSDEEVDSMIEIGGNDSANSIYEAFIPHGFTKPGPDASHDQRLRFIRSKYEHQEFLKPSLRIT

SEQ ID NO: 2578 - protein, 247 aa, Saccharomyces cerevisiae
  misc_feature (167)..(167): Xaa can be any naturally occurring amino acid
  unsure (1)..(247): unsure at all Xaa locations
ARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 2579 - protein, 469 aa, Agrobacterium tumefaciens str. C58
MTTANDILKQIKDNDIKFVDLRFTDPKGKLQHVTMDVVCVDEDMFADGVMFDGSSIAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGLDGIKNKIHPGKPMDKDLYDLPAKELKKIPTVCGSLREALESLDKDRKFLTAGGVFDDDQIDSFIELKMQEVMRFEMTPHPVEFDMYYSA

SEQ ID NO: 2580 - protein, 497 aa, Nocardioides sp. JS614
MSTSTRFVEQYGLYSSEQQRAAKQSLEKVLEHGIEIVRLVWPDQHGLLRGKALTVDAYIGALETGNEITMAPFFFDPANAIVFNPFSPDGGFAIDGLGGSPNVKMVPDPGTFTVLPWARNTALVFCDLYMTNGQPFPLAPRTILKDALAALAQHGAKLVTGVEMEWYLTRLVDDQLATGSLGAPGSPADPPQVAPVARGYSYLLMEHLDEIDHVLEPIRKAVLQMGLPLRSIDDEWAPSQVETTFDVLEGLAAADSAALFRTTVKQIAKRHGHLASFMCTPAIAGFYANGWHLHTSLADIDSGANLMVPTDNSPLSEIGRHYVGGTLEHGIAASVFTTPTINGYRRRRPYSLAPDRLAWGQDNRAAMMRVISAPNDKASHVENRVGDSAANPYLYVAAQAASGLDGVVNKIDPGPISLDPYAADVPQLPTTLADAVDALESDGFFRKVFGDVFVDYMVAMKRSEVDRYQAWVEQNPDPDTYVNGVTGWEHREYFELF

SEQ ID NO: 2581 - protein, 155 aa, Gluconobacter oxydans 621H
MMVLVGLFLWTIIEYIFHRYCFHASSSASWVNKVVFIMHGNHHEVPDDPLRNLMPLVVTVPLAVALWYLFGIGGRDYGRPAFVGFLIGYICYDFVHYMCHQSAMRGRLGFLIKRHHMLHHHALEDCNFGVTSTFWDVVFRTDFRNLIKRSDAHRH

SEQ ID NO: 2582 - protein, 218 aa, Nicotiana sylvestris
MFRSQLVSIFFILSFALSPVFGDFDQMQLVLTWPPTYCHEKSCARIPTNFRIHGLWPDNQHELLNNCKKSFTTITNSSKSNALDDRWPDLKYSKMKTIQTQDFWKYQYNKHGTCCTELYSQEAYFDLAMKLKDKFDLLQMLKSQGVIPGKTYTVNKIEEAIREVTQVYPNLNCIGNPLKTMELKEIGICFNREATEVVACHRRKTCNPLNKNEISFPL

SEQ ID NO: 2583 - protein, 431 aa, Myxococcus xanthus DK 1622
MNHAHSQALFARAQARIPGGVNSPVRAFRGVGGDPVFFREGAGAWLTDVDGNRYVDLVGSWGPLILGHAYPPILDAIIDAARRGSSYGAPHADEVEFAELICATMPAVEMVRLVSSGTEATVAAIRVARGFTGREHILKFEGCFHGAGDPFLVKAGSGVETLGLPDSPGVPSALAKLTLTAPFNDLAAVERIFAENGQDIACAIIEPVVGNMGVLVPKPGYLEGLQALCQKHGVLLVLDEVMTGFRLSRGGAQELYGLKPDLTTMAKVIGGGMPMGAYGGRRDIMEKVAPAGPVYQSGTLSGNPVAVAAGLACLKALAAPGTYARLEEVSRMLEVGLLAEAKAADVPVTVNRVGSMLTVFFTGEPVYDYTSAKKADTARFGKFFHAMLNESVYLPPSQFEAAFVSLAIGEPEVAHVLAAARKAFRSLGKTG

SEQ ID NO: 2584 - protein, 399 aa, Sulfolobus tokodaii str. 7
MPVDDFSLSANSISGESTLVYQDVARQVQKTKGIRIINFGIGQPDLPTFARIREAAKKSLDEGFTGYTSAYGIDELRQKIAEHLSSKYESVRKEEVIVTPGAKTALYLAFLLYINPGDEVIIFDPSFYSYAEVVKMLGGVPVYVKMKFNESTGFSLNLSELESKINKKTKMIVLNNPHNPTGMVFDPIEIEKLMEITKEKKVLLLSDEIYDYFIYEGKMKSVLEDPDWRDYVIYVNGFSKTFSMTGWRLGYVVAKEKVIKKMAEIAANIYTCPTSFAQKGALAAFESFDEVKEMISLFKKRRDIMYEELKKIKGIQVHKSQGAFYMFPFIGEILKKANLSVKDFSLKLIEEKGVTTIPGEVFPLEVGKDFVRLSFAVKEDDIREGIKRMKEFIDMLMTP

SEQ ID NO: 2585 - protein, 317 aa, Candida glabrata CBS 138
MAKADKKKYSGATTNKQVAAEKHLTSVFKFNTDLGQHILKNPLVAQGIVDKAQIKPSDIVLEVGPGTGNLTVRILEQARKVVAVEMDPRMAAELTKRVHGTPAEKKLEIMLGDFMKTELPYFDICISNTPYQISSPLVFKLINQPRPPRVSILMFQREFAMRLLARPGDSLYCRLSANVQMWANVTHIMKVGRNNFRPPPQVESSVVRIEIKNPRPQIDFNEWDGLLRIVFVRKNRTISAGFKSTTVLEILEKNYKTFLAINNQSIDETENLQSLIKQKIETVLKETGLAEKRAGKCDQTDFLKLLYAFHQVGIHFS

SEQ ID NO: 2586 - protein, 87 aa, Zea mays
  misc_feature (29)..(29): Xaa can be any naturally occurring amino acid
  misc_feature (62)..(62): Xaa can be any naturally occurring amino acid
  unsure (1)..(87): unsure at all Xaa locations
MYAYCGKCKDELIKNAAYIGTPGKGILRXEESTGTIGKRLSSINVKNVEENRRALRELLLCXPGALQDISGVILFEETLYHKTKDGK

SEQ ID NO: 2587 - protein, 395 aa, Staurastrum punctulatum
MTMLKTKADPMIVSMGPHHPSMHGVLRLIVTLDGENVIDCEPILGYLHRGMEKIAENRTTLQYLPYVTRWDYLATMFTEAVTVNAPERLANIQVPKRASYIRVIMLELSRLASHLLWLGPFMADIGAQTPFFYIFREREMIYDLFESATGMRMMHNYFRIGGVAVDLPYGWVDKCLDFCDYFLPKIDEYERLITRNPIFLKRVEGVGFIGREEAINWGLSGPMLRASGVQWDLRKVDHYECYDEFDWQVEWQTEGDCLARYLVRIGEMRESTKIIQQALKSIPGGPYENLEARRIGLIGTDSAQWNDFEYQFISKKPSPTFKLPKQEHYVRVEAPKGELGIYLIGDDSIFPWRWKIRPPGFINLQILPQLLRGVKLADIMTILGSIDIIMGEVDR

SEQ ID NO: 2588 - protein, 588 aa, Ustilago maydis 521
MLGRFKETVAEARAHVTACARTDGTSTQALGTSMLAGSVHLVVIHHGLWGSPANTEYLATTLAKYHGGLISPHCTLTPPECASTISALASTHPNSTNHIRMVVLNSEVNSGDHTYDGIDWCAERLIKDVYREVERIEQDENAKVAKLSLIGYSLGGLVIRYAAGVMYSDGLFAESKCNTGKKLMFTSRPVAASMSTIATPHLGVTLTGSMFSKVAAAVGRSNLGRTGKQLYLADRGWKADSHLSTQETPKHAHAQSDEDEGLCLIEALSDPRFNFITAMRLFSRIDVYANAVADLTVSYRTAAFEAHDPFVLADQIHLVRDPDHPPLVVSFSITKPCNKTTPFWSTLAAKLSPNNLPWMLNPQRFPIRFPLNYVALLCLPVVLPVMVGLVLHKLRSDSRVSNRRVEEFERLWAVENAGLSGKDPVIQDDSLNRKNGKKEKSVSTLVKLDAATRGELERKRVANLLATVEAEVEETFREVGEDYVRTSAPMASPAPSDSRYITKTNDATTFAPRSSYASLPEQQPLLPTQHRILSNLNNASLLPQVKKHLAHFPDVLNSHAVIIVRTPTMDAHKKGMQLIKAFVQRFEL

SEQ ID NO: 2589 - protein, 147 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 2590 - protein, 272 aa, Prochlorococcus marinus str. MIT 9313
MRPSELTQLKQDGRAISILTAWDGISAALVEAAGADVVLVGDSLAMVALCHATTLPVTVEQMLHHTKAVGRGFTRPLPQQPLVVCDLPFLSYQCGEDKAVAAAGSLLKHSCAAAVKLEGAEPEVLAVIERLVRMGIPVMGHLGLTPQAVHQLGYRRQAEDPRSQAQMLQQAKQLEQAGCFALVVEHVPSSIARCLSQQLTIPVIGIGAGEDCDGQVRVTADLLGLTPSQPPFSQPLIQGRQLCVEALQGWVKQLHQQAKTATTTTSPPEPDC

SEQ ID NO: 2591 - protein, 797 aa, Escherichia coli O157:H7 EDL933
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLKKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 2592 - protein, 263 aa, Buchnera aphidicola str. Sg (Schizaphis graminum)
MESITISKIQNWKKNQIKFAAITAYDFSFSRLFEKEGIPIMLVGDSLGMTIQGHNSTLPVKIQDIKYHTKAVRRGAPNSFLLSDLPFMSYYSIEETLKNTAKIIQSGANMIKIEGGKWLVETVKELSKRSILVCGHIGLTPQSINFLSGYKIQGKEKNDAQRIIDEAFILEEAGIKMLVLECIPSLLAKKITENLSIPVIGIGSGHHTDGQILVMQDLLGITDGKKLKFVKNFLCHNGSIQNAIKQYINEVKNGNFPSEKYSF

SEQ ID NO: 2593 - protein, 99 aa, Arabidopsis thaliana
  misc_feature (6)..(6): Xaa can be any naturally occurring amino acid
  misc_feature (8)..(9): Xaa can be any naturally occurring amino acid
  misc_feature (12)..(13): Xaa can be any naturally occurring amino acid
  misc_feature (17)..(17): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (42)..(42): Xaa can be any naturally occurring amino acid
  misc_feature (51)..(51): Xaa can be any naturally occurring amino acid
  misc_feature (59)..(59): Xaa can be any naturally occurring amino acid
  unsure (1)..(99): unsure at all Xaa locations
MVGTDXLXXPFXXFANXVLEEXYERXIVGDPYCDXPLGLYIXRGENVVLIXELDVEKEXLPAHMVQVPEAEIKRAQKAEKEEMLLKGTMRKRMEFLDLD

SEQ ID NO: 2594 - protein, 413 aa, Photorhabdus luminescens subsp. laumondii TTO1
MVKVSLEKDKIKFLLLEGVHQSTVENLRAAGYSNIEYHKGALDPKELKEAIRDTHFVGIRSRTQLTEDIFQAAEKLVAVGCFCIGTNQVDLKAAAKRGIPVFNAPFSNTRSVAEMVLGELLLLLRRIPLANAKAHRGVWDKQAKGCYEVRGKKLGIIGYGHIGTQLGILAENIGMDVYFYDIENKLPLGNAHQVRHLSELLNMSDVVSLHVPETPSTKNMIGATELTLMKPGSILINASRGTVVDIPALCDALESEHLSGAAVDVFPVEPATNNDPFESPLRKFDNVLLTPHIGGSTQEAQENIGYEVAGKLAKYSDNGSTLSAVNFPEVSLPVHADDTNRFLHIHENRPGILNSINQVFAEQDINIAAQYLRTSGDMGYVVIDIVTENPAQAEMVFQKLKALPGTIRSRLLY

SEQ ID NO: 2595 - protein, 411 aa, Pseudomonas syringae pv. phaseolicola 1448A
MRALTYHGANSVKVDTVPDPEIQEADDIILKVTATAICGSDLHLYRGKIPTVEHGDIFGHEFMGIVEETGPAVTAVQKGDRVVIPFVIACGSCFFCNIDLFAACETTNTGRGAIINKKSIPPGAALFGFSHLYGGIPGGQAEYVRVPKANVGPFKVPGTLADEKVLFLSDILPTAWQAVTNAGIGQGSSVAIYGAGPVGLMSAACARMLGAEKIFMVDHHPYRLAYAQKTYGVIPINFDDDDDPADTIIRQTAGMRGVDGVVDAVGFEAKGSTTETILATLKLEGSSGKALRQCIAAVRRGGVVSVPGVYAGFIHGFMFGDAFDKGLTFKMGQTHVHRFMLELLEHIEAGRLEPEAIITHRMSLEDAAKGYKLFDKKEEDCRKVILTPGNNTIVVPDATTEELVAGGVPAM

SEQ ID NO: 2596 - protein, 219 aa, Photorhabdus luminescens subsp. laumondii TTO1
MTQDELKKAVGWAALEFVTPGTVVGVGTGSTASHFIDALGSIKDQIEGAVSSSEASTEKLKSLGIPVFDCNEVDSLDIYVDGADEINGNMQMIKGGGAALTREKIIAAIAKKFVCIVDASKKVEVLGKFPLPVEVIPMARAYVARELVKLGGVPKYRQNVVTDNGNVILDVHNLAILDPAELENKINRISGVVTVGLFANRGADIVLMGTLDGVETITQ

SEQ ID NO: 2597 - protein, 741 aa, Mycobacterium sp. MCS
MTEAGLSEREPNLSHLRLTARLNTAALDSRRGVVRLHPEVIAALGIREWDAVSLTGARTTAAVVGIAPPGTPTGTALLDDVTLSNAGLPENSSVIVAPVTVYGARSVTVSGSRLATNSISPATLRQALLGKVMTVGDTVSLLPRDLGPGTSTSSATTALASSVGITWTSELLTVTSVDPPGTVSIQPNSSVTWGDGPAPKAASAGPTDGAAVGEATVTTPSVDRPAVSFDDLKGSHAQAGRLTEWLKLSLDEPSLLETLGATAHLGVLVSGPAGVGKATLVRTVCAQRRLVELDGPEVGALHAEDRLNRVSSAVSTVRDGGGVLLISDIDALLPATPEPVGTLILTELRTAVATPGVAFVATSARPDGVDARLRDPDLCDRELGLSLPDAATRKELLEVLLRSVPAQELHLDEIAGRTPGFVIADLCALVREAALRAAARASADGAPPQLTQADLTGALTVIRPLSRSATEEVSVGSVTLADVGDMTETKQALTEAVLWPLQHPDTFERLGIEPPRGVLLYGPPGCGKTFVVRALASSGRLSVHAVKGAELMDKWVGASEKAVRELFRRARDSAPSLVFLDEIDALAPRRGQSFDSGVTDRVVASLLTELDGIEPMCNVVVLGATNRPDLIDPALLRPGRLERLVFVEPPDAEARREILRTAGKSVPLADDVDLDTLAAGLDGYSAADCVALLREAAMTAMRRSIDAADVTAADVEAARQTVRPSLDPLQVDTLRAFAENR

SEQ ID NO: 2598 - protein, 454 aa, Lactobacillus plantarum WCFS1
MQRKLSTGQMQMIALGGTIGVGLFMGSSSTIKWTGPSVLIAYIVSGAFLYLIMRALGEMLYVDPNTGSFAKFASEYIHPVFGYLTAWSNIFQFVVVGMSEMIALGGYCRYWWPNLPDWIPGLIAIVFLCAANLISVKMFGTLETWFSLIKVVTIILMIIAGLGLIIFGIGNGGHPIGISNLWTHGGFFTGGVKGFVFALAIVLASYQGIELIGVTAGEAENPQSTIVKAIRSTVARILIFYVGAIFVIVSIYPWDKLSQIGSPFVQTFAKIGITAAASIINFVVITASLSGTNSGIYSASRMTYTLAESHQLPRKMTLLNRHGVPFYSVIAIATGILIGVVLNVVLPMFFKDASEIFVMVYSSSVLPGMVPWFVILVSQIAFRKQNAAKMANHPFKMPLSPYSNYLTLAFLALTLVFMFINPETRYSILVGVVFLVIMTLIYFRKYAGNKEETL

SEQ ID NO: 2599 - protein, 349 aa, Triticum aestivum
NKFVQKSRLVPVRNSRDIVDPRDYGKAITNLTLTRLSAVGERGFWVMANALGLQKLRCMSITSCPGVTELALVSIAKFCPSLKQLYLRKCSQISDGLLKDFAEAAKVLENLQIEECNRITLMGILSFLLNCSPKFKTLSLVKCTGIKDICSAPAQLPVCKSLRSLTIKQCPGFTDASLAVVGMICPHLENLDLSGLGAVTDDGLLPLIRSSESGLVHVDLNGCENLTDAAISALVKAHGTSLAHLSLEGCSKITDASLFAISESCSELAELDLSNCMVSDYGVAVLASAERLKLRVLSLSGCLKVTPKSVPFLGSMPASLEGLNLQFNFIGNHNIASLEKQLWWCDILA

SEQ ID NO: 2600 - protein, 138 aa, Propionibacterium acnes
MSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 2601 - protein, 306 aa, Mycobacterium sp. MCS
MSANTKWTAADVPDQEGRVAVITGANTGIGYEAAAVLAAKGAHVVLAVRNTDKGGAAAERIRSALPHADVTVRELDLTSLDSIREAADGLRADYPRIDLLINNAGVMMTEKGATKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVAQTPEMGALPTLRAATDPDVRGGQYYGPDGIGEQRGHPKLVQSNARSYDEAAQRRLWSVSEELTGVTFPV

SEQ ID NO: 2602 - protein, 916 aa, Arabidopsis thaliana
  misc_feature (297)..(297): Xaa can be any naturally occurring amino acid
  unsure (1)..(916): unsure at all Xaa locations
MKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNXLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 2603 - protein, 955 aa, Ipomoea batatas
MSRLSGITPRARDDRSQFQNPRLEIAVPDRTAGLQRTKRTLLVKCVLDETKQTIQHVVTEKNEGTLLDAASIASSIKYHAEFSPAFSPERFELPKAYFATAQSVRDALIVNWNATYDYYEKLNMKQAYYLSMEFLQGRALLNAIGNLELTGEYAEALNKLGHNLENVASKEPDAALGNGGLGRLASCFLDSLATLNYPAWGYGLRYKYGLFKQRITKDGQEEVAEDWLELGNPWEIIRMDVSYPVKFFGKVITGSDGKKHWIGGEDILAVAYDVPIPGYKTRTTISLRLWSTKVPSEDFDLYSFNAGEHTKACEAQANAEKICYILYPGDESIEGKILRLKQQYTLCSASLQDIIARFERRSGEYVKWEEFPEKVAVQMNDTHPTLCIPELIRILIDLKGLSWKEAWNITQRTVAYTNHTVLPEALEKWSYELMEKLLPRHIEIIEMIDEQLINEIVSEYGTSDLDMLEKKLNDMRILENFDIPSSIANLFTKPKETSIVDPSEEVEVSGKVVTESVEVSDKVVTESEKDELEEKDTELEKDEDPVPAPIPPKMVRMANLCVVGGHAVNGVAEIHSDIVKEDVFNDFYQLWPEKFQNKTNGVTPRRWIRFCNPALSNIITKWIGTEDWVLNTEKLAELRKFADNEDLQIEWRAAKRSNKVKVASFLKERTGYSVSPNAMFDIQVKRIHEYKRQLLNILGIVYRYKQMKEMSAREREAKFVPRVCIFGGKAFATYVQAKRIAKFITDVGATINHDPEICDLLKVIFVPDYNVSAAELLIPASGLSQHISIAGMEASGQSNMKFAMNGCILIGTLDGANVEIRQEVGEENFFLFGAEAHEIAGLRKERAEGKFVPDERFEEVKEFIKRGVFGSNTYDELLGSLEGNEGFGRGDYFLVGKDFPSYIECQEKVDEAYRDQKIWTRMSILNTAGSYKFSSDRTIHEYAKDIWNIQPVVFP

SEQ ID NO: 2604 - protein, 93 aa, Medicago truncatula
MGFHLPAAIVRASFRSSQTSLKVTNVPKSYLAVYFGEEMKRFVIPMSYLNQTSFQDLLSQAEEEFGYDHPMGGLTIPCTEGVFLRVTSRFNGI

SEQ ID NO: 2605 - protein, 448 aa, Streptococcus pyogenes MGAS10394
MAITVADIRREVKEKNVTFLRLMFTDIMGVMKNVEIPATKEQLDKVLSNKVMFDGSSIEGFVRINESDMYLYPDLDTWIIFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 2606 - protein, 92 aa, Medicago truncatula
MGFRLSAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 2607 - protein, 92 aa, Medicago truncatula
MGFRLPGIRRSSFSASQSSSKQVEVPKGHLAVYVGEKMRRFMIPISFLNEPLFQELLSQAEEEFGYCHPMGGLTIPCKEDMFLHTASVLNRI

SEQ ID NO: 2608 - protein, 486 aa, Oryza sativa (japonica cultivar-group)
MSKEAFTLWLFFLLLVHGAFADQAARVLEFSRSRMEMRDDQYTTEHTSQRANHQLYMSSQDGLKEADKVSELPGQPGRAGFDQYAGYVTVNATSGKALFYYFAEATDDPSTKPLVLWLNGGPGCSSLGDGAMLEIGPFLVNGDNRTLSINRYAWNNVANMLFLESPAGVGFSYSNTTSDYDNTGDTSTAADAYTFLTNWLERFPEYKGRDFFITGESYGGHYIPQLANAILSNNNITNVTIINLKGVAIGNAYLDDSTNTRATIDYYWTHALISKETHLAVQRNCSFNGTYMAQCRNALAEADTEKGVIDPYNIYAPLCWNASNPRQLHGSAINVDPCSRYYVESYLNRPEVQRTLHANTTGLKQPWSGCSNIITPENWKDAPVSMLPSIQGLISSGVSTWLYSGDIDAVCPVTSTLYSLDILELPINSSWRPWYSDDNEVAGYVVGYKGLVFATVRESGHMVPTYQPQRALTLFSSFLQGILPPE

SEQ ID NO: 2609 - protein, 92 aa, Medicago truncatula
MGFRLPAAIRRASFSSSQTSKVLNVPKGYLAVYVGEQMKRFVVPMPYLNQASFQNLLSQAEEEFGYDHPMGGLTIPCTEYVFLHITSHFNGL

SEQ ID NO: 2610 - protein, 274 aa, Ralstonia solanacearum
MSSYLQESTRKAVTVTSLQGMRAAGERIAMLTAYDASFAALMERSGVDVVLVGDSLGNVVQGQKTTLPVTLDHIVYHTECVARGTTKALLMSDLPFGTYGTPEQAFHSAVRVMQAGAQMVKLEGGEWLAPTLRFLVERSIPVCAHIGLTPQSVHAFGGFKVQGRGDEAAAQLKADALAVQDAGAQMVLMEAIPATLAGEVTRLLAVPTIGIGAGPECSGQVLVMHDMLGVFPGHRPKFVRNFMDGLTTIDAAVTAYVTAVKDGTFPGPEHSFTA

SEQ ID NO: 2611 - protein, 475 aa, Rhodobacter sphaeroides 2.4.1
MITQVLLCGGSGTRLWPLSRKGYPKQFASILGEHSLFAASARRLSGPGFGRPVIVTGSDFRFVVTEQLAEAGIDPGTILIEPEPRNTAPAILAAALHVAAGDPEALMVVAPSDHAIADPAAFRAAVMQGVPAARAGRIVTFGIVPTRAETGYGWLELDGAEDGAAVPLRRFVEKPDLDRAEEMLASGGFLWNSGIFLFSARTILATFEEHAPALLAPVRRAVEGAVPDLGFLRLDPQPWAEAEPISIDYAVMERTRNLSVVPFRGSWNDLGGWDAVALEMGTDGQGVSLSGGATAIDCRNALLRADSEGVELVGIGLDNIIAVAMKDAVLVAERSRAQEVKQAVEALKAKGARQAESFLRDRRPWGFFETLALGERFQVKRIVVHPGGALSLQSHLHRSEHWIVVRGTARVTIDADVHLMTENQSVYIPLGARHRLENPGKVPMELIEVQTGSYLGEDDITRYEDVYARGQGARG

SEQ ID NO: 2612 - protein, 319 aa, Aspergillus oryzae
MASPTVKLNSGHDMPLVGFGLWKVNNETCADQVYEAIKAGYRLFDGACDYGNEVECGQGVARAIKEGIVKREELFIVSKLWNSFHEGDRVEPICRKQLADWGVDYFDLYIVHFPVALKYVDPAVRYPPGWNSESGKIEFSNATIQETWTAMESLVDKKLARSIGVSNFSAQLLMDLLRYARVRPATLQIEHHPYLTQPRLVEYAQKEGIAVTAYSSFGPLSFLELEVKNAVDTPPLFEHNTIKSLAEKYGKTPAQVLLRWATQRGIAVIPKSNNPTRLSQNLEVTGWDLEKSELEAISSLDKGLRFNDPIGYGMYVPIF

SEQ ID NO: 2613 - protein, 92 aa, Medicago truncatula
MGFRLPGIRRSSFSASQSSIKQVEVPKGYLAVYVGEKMRRFMIPVSFLNEPLFQELLSQSEEEFGYCHPMGGLTIPCKEDMFLHTTSVLNRL

SEQ ID NO: 2614 - protein, 146 aa, Phaseolus vulgaris
  misc_feature (146)..(146): Xaa can be any naturally occurring amino acid
  unsure (1)..(146): unsure at all Xaa locations
MSSTEVATTTKKGGRGKPKTTKSVSRSSKAGLQFPVGRIARYLKAGRYAQRVGSGSPVYLSAVLEYLAAEVLELAGIAARDNKKSRIIPRHIQLAVRNDEELSKLMGSVTIASGGVLPKNSSKICCPRKTGKGEGEVWIYLVKGFX

SEQ ID NO: 2615 - protein, 92 aa, Medicago truncatula
MGFHLPAIRRTSFTSSQASSKAVNVPKGYLAVYVGEQMKRFVIPMSYLNQASFQNLLSQAEEEFGYDHPMGGLTIPCTEDIFMEITSRFNGL

SEQ ID NO: 2616 - protein, 92 aa, Medicago truncatula
MGFRLPAAIRRASFSSSQTSKVLNVPKGYLAVYVGEQMKRFVIPTSYLNQASFQNLLSQAEEEFGYDHPMGGLTIPCTEDVFLHITSHFNGL

SEQ ID NO: 2617 - protein, 388 aa, Medicago truncatula
MGKREKQKQKHDRSQRGRDYYLQDNNEDDTSTMLSPSHNEDEDEIEDAADSDADNNDNNDQHPSHDMPSKFLLYQQSVQSPKGDISYLQKFFLMYVGGRVPLHLQEDFCGTALLSAEWLRSDPRKTAVGLDLDLEALNWCLENNIPKIGADGFSRISLFHGNVLQPLQSKLVKIDPEELVRNISLSQNTENLQTDVIESDVPTSSAAQDDELTMNNFTLSGRDIVCAFNYSCCCLHKRAELVLYFKHARDALSKKGGIFVMDLYGGTSSENTLKLQRRFPNFTYVWEQAEFDIIQRKTRISLHFHLKKEKRKIRHAFSYSWRLWTLPEIRDCLEEAGFRAVHFWVREMPDSTEITRTEGFGVGKDIKYEEATSFQQQDSWNAYIVGVA

SEQ ID NO: 2618 - protein, 180 aa, Arabidopsis thaliana
  misc_feature (112)..(112): Xaa can be any naturally occurring amino acid
  misc_feature (133)..(133): Xaa can be any naturally occurring amino acid
  misc_feature (147)..(147): Xaa can be any naturally occurring amino acid
  misc_feature (149)..(149): Xaa can be any naturally occurring amino acid
  misc_feature (152)..(153): Xaa can be any naturally occurring amino acid
  misc_feature (155)..(155): Xaa can be any naturally occurring amino acid
  misc_feature (162)..(163): Xaa can be any naturally occurring amino acid
  misc_feature (166)..(166): Xaa can be any naturally occurring amino acid
  unsure (1)..(180): unsure at all Xaa locations
MASSMLSSTAVVTSPAQATMVAPFTGLKSSASFPVTRKANNDITSITNNGGRVSCMKVWPPIGKKKFETLSYLPDLSDVELAKEVDYLLRNKWVPCVEFRVGSTGLCNVSTXNTPGTMVGRYWAMWGLPLSGXTGSGQVFKGVENPXGXPGXXIXGTGFGKXXSQXLVYSNPKFGNPGTV

SEQ ID NO: 2619 - protein, 261 aa, Nicotiana tabacum
MASSKERENFVYVAKLAEQAERYDEMVDAMKSVANMDVELSVEERNLLSVGYKNVVGSRRASWRILSSIEQKEESRGNEQNVKRIKEYRQKVETELTSICNDIMVVIDQHLIPSCTAGESTVFYHKMKGDYYRYLAEFKSGNDKKEVAELSLKAYQSATTAAEAELPPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 2620 - protein, 361 aa, Rhodospirillum rubrum ATCC 11170
MSTYTIPVGPLHVALEEPMYFRIEVDGEKVVSVDITAGHVHRGIEYLATKRNIYQNIVLTERVCSLCSNSHPQTYCMALESITGMVVPPRAQYLRVIADETKRVASHMFNVAILAHIVGFDSLFMHVMEAREIMQDTKEAVFGNRMDIAAMAIGGVKYDLDKDGRDYFIGQLDKLEPTLRDEIIPLYQTNPSIVDRTRGIGVLSAADCVDYGLMGPVARGSGHAYDVRKQAPYAVYDRLDFEMALGEHGDVWSRAMVRWQEALTSIGLIRQCLRDMPDGPTKAGPVPPIPAGEAVAKTEAPRGELIYYLKTNGTDRPERLKWRVPTYMNWDALNVMMAGARISDIPLIVNSIDPCISCTER

SEQ ID NO: 2621 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKLLRKWYDLLMVHKEELAQLITLEQGKPLKESVGEIVYGAGFIEFAAEEAKRIYGDIVPAPFSDRRLFVLKQPVGVVGAITPWNFPLAMITRKVGPALACGCTVVIKPSELTPLTALAAVELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDAVQNMKVGDGFSEGVSQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 2622 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 2623 - protein, 815 aa, Escherichia coli O157:H7 EDL933
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADLDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 2624 - protein, 392 aa, Glycine max
RLREDNSRGHSLFKTVVFSLRQNQPNPSPILKPTMSSFKSKYQDELIANAAYIGTPGKGILAADESTGTIGKRLASINVENVEANRRALRELLFTTPGAFECLSGVILFEETLYQKTASGKPFVELMKEGGVLPGIKVDKGTVELAGTNGETTTQGLDGLGARCQKYYEAGARFAKWRAVLKIGPNEPSELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGQSEEEATLNLNAMNKSQGKKPWSLSFSFGRALQQSTLKAWGGKDENIKKAQDALFARCNANSHATLGTYKGDATLAEGASESLHVKDYKY

SEQ ID NO: 2625 - protein, 226 aa, Oryza sativa (japonica cultivar-group)
MPGTAGGLGLRLAQFAFAAVALAVMASTNDFPSVTSFCFLVAAAILQCLWSFSLAIVDIYALLVKRCLRNRRAVCLFAIGDGITAALTFSAACASSGITVLIDNDLDLCSENHCASFESATAMAFLSWGWPVLQVFNVELSKSLLSKPQHHYITRVVPNFHGTFQLKVVLKEPLKLVENLLSSADILVCNTHPWLLAKSSALTRANCGAVIYHTDPSVDGTLLFSH

SEQ ID NO: 2626 - protein, 483 aa, Xanthobacter autotrophicus Py2
MTTSSTVTSKSASGKIVPVILAGGSGTRLWPLSRNSLPKQFLPLATENTMFQDTLLRAAPGAVFADPVVVANEEFRFFAQRQARAVGIDATVMLEPARRDSAPALIAAAVWVAETYGPETLVLALASDHVVLDPAGFVKTVEIGAEAARLGRIVTFGIEPTEPRTSYGYIRLGAQIDERGSYEVDSFVEKPDRATAERYVAAGYLWNSGNFLFPAGLLLKEADVFEPAIADAARAAVAEAKSDLGFLRLDPAAFKSSPSKSIDFAVLERTRHAAVVRGSFGWSDVGSWDALHEIGNQDERGNVTVGTVQLLDSSNSFVRSDGPLVTAIGLDGVSVIATEDAVLVMPSNRSQDVKALVSALKDSNRKEVEEHLTIHRPWGTYQTVCKGDRFQVKKIVVEPGGILSLQKHHHRAEHWVVVRGTAEVTVADRSYMVHENESTYIPIGSVHRLGNPGRIPLELIEVQTGSYLGEDDIHRFEDIYQRA

SEQ ID NO: 2627 - protein, 300 aa, Mycobacterium sp. MCS
MTKWTTADIPSQSGRTAVVTGANTGLGLETAKALAARGAHVVLAVRDTEKGKRAADEITAAHPEAAVGVQSLDLGSLRSVRTAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPPVFNPLVGVLTQSPTMGALPTLRAATDPTVRGGQYFGPSGLGEIRGYPELVTSSAQSRDVDLARRLWTVSEELTGVAFPL

SEQ ID NO: 2628 - protein, 463 aa, Pseudomonas putida KT2440
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 2629 - protein, 92 aa, Medicago truncatula
MGFRLPVIRRSSLSASQSSSKQVEVPKGHLAVYVGEKMRRFMIPVSFLNEPLFQELLSQSEEEFGYCHPMGGLTIPCKEDMFLYTTSVLNRL

SEQ ID NO: 2630 - protein, 395 aa, Pseudomonas fluorescens PfO-1
MRYSALTQRIAGEGAAAWRIHDRALELRAEGIDVLLLSVGDPDFDTPLPIIHGAIDSLLAGDTHYSEVRGRLELRKRIAERHRRSSGQDVDAEHVIVLPGAQCAVYSVAQCLLDPDDEVIVAEPMYVTYEGVFGACGATVVPVPVRPENGFRVDPVDVAARITSKTRAMLLNSPNNPSGASLSLLIWQELAALCIRHDLWLISDEVYSELLYEGEHVSPASLPGMAERTATINSLSKSHAMTGWRIGWMIGPKPLAEHLVNLSLSMLFGLPDFVQKAAQVALEKDLPEVTQMREEYRLRRDLVCERLRGCPGLYPIKPDGGMFVMVDVRQTGLGAQDFAERLLEGYGVSVLAGEAFGPSAAGHIRIGLVVDRVKLADACSRIALCAAQLLQVRSA

SEQ ID NO: 2631 - protein, 92 aa, Medicago truncatula
MGFRLPAIRRTSFTSSQASSKAVNVPKGYLAVYVGEQMKRFVIPMSYLNQASFQNLLSQAEEEFGYDHPMGGLTIPCTEDIFMEITSRFNGL

SEQ ID NO: 2632 - protein, 392 aa, Corynebacterium glutamicum
MKALTWQASNTVNVEEVPDPQIQEPTDAVIRVTSTAICGSDLHLYEVLTPFMDKGDIIGHEPMGIVEEIGSAVTHIKPGDRVVIPFNISCGHCFMCRQGLQSQCETTQVREYGTGAQFLGYSRLYGSVPGGQAEYLRVPHADYGAIKVPNVGEDERYLFLSDVVPTAWQAVDYAAVPDGGTLAVLGLGPIGQMSARIGKHLGYRVIATDAVPERRAMAERYGIETLDSSEDGVAEQLKDLTDGRGPNSVVDAVGMEAHGSPVASAVQAAVGKLPSPLDRKAMERAGVDRMSALYTAIDSVRRGGTISISGVYGGMKDPMPMLTMFDKQIQLRMGQCNVRSWTETLLPLVDDPSDPLGVLDLKTHTAPLEEAPAMYEKFQKKQDGCIKVVLKP

SEQ ID NO: 2633 - protein, 151 aa, Pyrus communis
AVCHFNPTPCKDPPDKLFTVHGLWPSNSTGNDPMYCKNTTLNSTKIANLTAQLEIIWPNVLDRTDHITFWNKQWNKHGSCGRPAIQNDMHYLQTVIKMYITQKQNVSEILSKAKIEPVGRFWTQKEIEKAIRKGTNNKEPKLKCQRNTQGT

SEQ ID NO: 2634 - protein, 480 aa, Yersinia pestis biovar Medievalis str. 91001
MSRRLRRTKIVTTLGPATDRDNNLEKIIAAGANVVRLNFSHGSAEDHELRANKVREIAARLGRHVAILGDLQGPKIRVSTFKEGKVFLNINDKFLLDANMAKGEGDKNKVGIDYKGLPADVVPGDILLLDDGRVQLKVVEVQGMKVFTEVTVGGPLSNNKGINKLGGGLSAEALTEKDKADIVTAAKIGVDFLAVSFPRTGEDLHYARRLARDAGCNAQIVAKVERAEAVATDEAMDDIILASDVVMVARGDLGVEIGDPELVGIQKKLIRRARQLNRAVITATQMMESMITNPMPTRAEVMDVANAVLDGTDAVMLSAETAAGQYPAETVAAMARVCLGAEKIPSINVSKHRLDVQFDNVEEAIAMSTMYAANHLKGITAIIAMTESGRTALMMSRISSGLPIFAMSRHDHTLNLTAIYRGVTPVYCDPHTDGVLAATEAVKRLQDKGFLVSGDLVIVTQGDVMGTIGTTNTSRIIRVE

SEQ ID NO: 2635 - protein, 542 aa, Streptococcus suis
MTIDKRKVVYQIYPKSYKDTTGNGVGDLRGIIEKLPYLKELGIDMIWLNPFYPSPQRDNGYDISDYTAVNPDFGTMADFEEMVTVGKELGIEFMLDMVLNHCSTDHEWFQKALSGDQYYQDFFILRDQPTDWVSKFGGNAWAPFGDTGKYYLHLFDVTQADLNWRNPHIREELFKVVNFWKDKGVKGFRFDVINLIGKDEAREDCPINDGKPAYTDRPITHDYLKMMNNATFGSEKGFMTVGEMSATTIENCILYTAPERKELSMAFNFHHLKVDYKDGQKWTIMDFDFEELKHLFHTWGEEMSVGNGWNALFYNNHDQPRALNRFIDVENFRKEGATMLAASIHLSRGNNLTSTWVRRSVSSTLTTIAWTTTWTWSLSMPTRCSWTKVTRLSRPSRLSRPSPVTIPAPRCNGTLLTMQASQQATPWLKAGKSYQTINVEQEKTGPIFTFYKRTHPLRKELPLISEGDYKAAYKDSQKVYAFERLLNDEKLLVLNNFFAEEVELDLADDYAHGQVLISNYPDNKLGKKIILKPYQALAIQVK

SEQ ID NO: 2636 - protein, 209 aa, Anaplasma phagocytophilum HZ
MSFEPSAAVFSSIEEVVRDAAEGKVFVLLDDEERENEGDLVALADRVSPEAINMMIRYGSGIVCLAFSEYHAKKLGLGLMSRRNANDGCPAFAESIDARHGITTGVSASDRAATILKAVSDDSSADDIVTPGHVFPIVANPGGVLKRGGHTEAGVDIAKLAGAAHAAVICELMNPDGTMARLPEIMEFASANGIKVTTIKKLREYLSSS

SEQ ID NO: 2637 - protein, 657 aa, Ustilago maydis 521
MPLLDPREVLLRRGIPIPAAASFHVPGLPDLHAESSSSTALAHPLQMSAGYLPARPIEADGQPKDNAHLFFLLLRARHVPAKRKLIIWFNGGPGCSSFDGAMMEVGAWRMDGKGGLVWVKDGASWNEYADILFLDQPAGTGFSYVNTNAYTKSLPQAADEVVHFLEQFVQVYPEYSRDVELEYGSQGSGVDVYLAGESFAGQYIPYTAKAIVKSPKPPVSLKGIAIGNGFIDPKSQYGTELETMVQKNIWTTSSGEYKHVAGLVKACHEELDKSNQREIGKCELILQTIIASTTTKTQGASGYTCINVYDVRLSDSSPACGMNWPTTLPAMYDYLRRPDVRKALHVDEHHKPEAWVECNANVGSAMRTDTTSPPSVQLLPELLDSGVKVLLFAGEEDLICNAIGVQRAAENLEWGGAKGFDDKQPAQDWYVNGTHAGTWRTARNLTYVGIKGASHMVGVDKPIESHDMIVRFMGIDYMKVAGPNALIPSRVGNEPDRVLITGGGGGIAQIGKDGSRVIPGSGKTEEEVAEEARWRAYYDAGSFALMVLLIAVGIGTWLLLRARKQRRLNRNRIGRGGALRLATTTELGASRSTTGNGDTDETSNNHELERLVGGKHVEDDDDDVEEHIFNVGDEDLSDSNGENGPPVVKARHTGSQR

SEQ ID NO: 2638 - protein, 394 aa, Spinacia oleracea
MASASLLKTSPVLDNPEFLKGQTLRIPSVAGVRFTPSGSSSLTVRASSYADELVKTAKTVASPGRGILAMDESNATCGKRLASIGLENTEANRQAYRTLLISAPGLGQYVSGAILFEETLYQSTTDGKKMVDVLIEQGIVPGIKVDKGWLPLPGSNDESWCQGLDGLACRSAAYYQQGARFAKWRTVVSIPNGPSALAVKEAAWGLARYAAITQDNGLDPILEPEIMLDGEHGIDRTFRVAQQVWAEVFFNLAENNVLLEGSSLKPSMVGPGALSARKGPPEQVADYPLKLLHRRRGPVVPGIMVLSGGQSEVEATLNLNAMNQSPNPWHVSFSYARALQNTCLKTWVEGQENVKAQDFACAKSNSLAQLGKYTGEGESEERKKDMFVKATLTY

SEQ ID NO: 2639 - protein, 279 aa, Borrelia burgdorferi B31
MANKINWFPGHMKRALDLIKNNLQKANIVLEILDARAPFSSKNPLTEKITKNQAKIILLHKSDVAQINEIIKWKKYFENLGNTVIISNIYKKGMRKQIIDIIKKLAIVKKIKNYKEKIKVLIIGVPNVGKSSIINLLSGKKSAKVANKPGYTKNIQIVKINEEINLFDMPGILWHNLVDQSIAKKLAILDMIKNEIVDNTDLALYLLEIMDQNNKNILLKKYEIYHKNSLDILQNFAKARKLIGKKNELNLEKASKILIKEFREGKFGKIILDKNYNAF

SEQ ID NO: 2640 - protein, 566 aa, Zea mays
  misc_feature (497)..(497): Xaa can be any naturally occurring amino acid
  misc_feature (513)..(513): Xaa can be any naturally occurring amino acid
  unsure (1)..(566): unsure at all Xaa locations
MALRDVLLSIAQTPHRLRRRALVTWTPTQELNEVRDRSGARMKRRLEWYDLVGLGVGGMLGAGVFVTTGRVARDTAGPAVFASYVVAGVSALLSSLCYAEFSVRVPVAGGAFSYLRVTFASYILSGEFVGFFGGANILMEYVLSNAAVARSFTDYLASTFGVTERNAWRIVVDGIADGYNELDVPAVALILLITVCLCYSTKESSMLNMVLTVFHLLFFAFIVAAGLWNGSARNLVRPHGLAPYGVRGVLDGAAVVYFSYIGYDSACTMAEEIRDPSRALPVGIAGSVLVVSGLYCLMSVALCVMLPYTEISEAAPFSSAFREKVGWRWASSVVGAGASIGIVASLMVAMLGQARYLCVIARARLVPLWFAKVHPSTGTPMNATIFLGFCTASLALFTELQIVFEMISIGTLLVFYLVANALIYHRYVKVGTNRPLHVLLFLLLLTLSSLGFSLSRKIDGWCQWGMTLFGAVSIAITTIFHCTARQDIAGPSLEWSXPLMPWPAAASVFLNVXLITTLKVRSYQRFGIWSLVTIVFYVCYGVHSTYSAEENEIVNAMIHHANLDIS

SEQ ID NO: 2641 - protein, 271 aa, Xanthomonas campestris pv. campestris str. ATCC 33913
MSSHADSKPWTVPALAQAKRDGRKLVMLTAYDAGFARTFDANGVDLILVGDSLGMVVQGHESTLPVTTADMVYHTAAVARVLERALLVADLSFQADATPERALDAATQLLQAGAEMVKIEGAGHKLDVIRYLVEREIPVCSHLGLTPQSVLRFGGYKVQGRGEAGEQLRRDAQAAVDAGASLIVLECVPTPIAAQISAELRVPTIGIGAGPGCDGQVLVMHDMLGLDSGHRRPKFVKDFLAEGGSVAGAVQAYAQAVRDGSFPDAEHAYAA

SEQ ID NO: 2642 - protein, 141 aa, Triticum aestivum
RRTRGGGTSRSPRRPPPRAPPSSCPSPASPGSLDLFDYYIRTDERHVFSQELRLDTKVFYFHIGEDKTGRYLQVSEASLNRHRSTIIVPAGSSGEEGWEAFRNVLLEINDEASRLYVLPNHPSQQHLEPPERLPGLSDDVG

SEQ ID NO: 2643 - protein, 488 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEYLVDTPDWSTILQANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVMTLLYSQVLDVTRTKSRWKCSLKDGIMHINDKDILFNKVICASQIRLELFWQQASLTSDLNTSNDASRKVLQIPTERDMSIHGKVYSGWLVVQKEKFFLSKKAYQLSPCFMNSYCLSRNGKLTSQKLDLAYSCI

SEQ ID NO: 2644 - protein, 112 aa, Zea mays
  misc_feature (18)..(18): Xaa can be any naturally occurring amino acid
  misc_feature (97)..(97): Xaa can be any naturally occurring amino acid
  unsure (1)..(112): unsure at all Xaa locations
TGRALRRTVRPAVPGVTXLSGGQIEEEASINLNAINKCPLRKPWALTFSYGRALQASALKAWGGKKENLKAAQEEYIKRALANSLACQGKYTPSGQXGAAASESLFISNHAY

SEQ ID NO: 2645 - protein, 1003 aa, Rubrivivax gelatinosus PM1
MLRPLALPLAALEHTTDFAGRHIGIDPADEQHMLSVIGAASRQAMIEAIVPRSIARARPMVLPEPVGEVQALAELKAIAAKNRVYRSYIGQGYHGTHTPGVILRNILENPAWYTAYTPYQAEISQGRLEALVNFQTMVCDLTGMAIANASMLDEATAAAEAMTLARRSVKSKSATVIVASDCHPQTIEVIRTRARPLGIEVLVGLVPELMAQHEYFAVIAQYPATGGIVHDMKPYVDAAHASGAAFVVAADLLALTLLTPPGEWGADIAIGSTQRFGMPMGAGGPHAAFLACRDEFKRSMPGRLAGVSVDAHGRPAYRLALQTREQHIRREKATSNICTAQVLPAVVASMYAVYHGPQGLKRIAQRVASYTAILAHGLRAMGFELAGDSAFDTLCVETGIETNAIARRARDAGANLRRLSATQLGITLDETTTREDLTALWSWFARSEGMVPNVAAFAHGADPLIPSELRRTSAYLTHPVFNSHHSETEMLRYLRSLADKDLALDRTMIPLGSCTMKLNATSEMIPITWPEFAHIHPFAPAEQLAGYAELDAQLRQWLCEATGYAGISLQPNAGSQGEYAGLLAIQAWHASRGDAQRDVCLIPESAHGTNPASAQMAGMRVVVTKCDAEGNVDLDDLRAKCEQHSSQLAAVMVTYPSTYGVFDPHIKALCALVHQHGGRVYVDGANMNALVGVAAPGEFGGDVSHLNLHKTFCIPHGGGGPGVGPVCVVEDLVPFLPTHRTGASASSVDAYVGSAVEPTPGRPKVASALSGGSEVPAGPSVGAVSASPLGNAAVLPISWMYVRMMGAAGLTAATETAILSANYIAARLADHYDIHFSGEVDGLKGGGVAHECILDLRPLKDSSGVSAEDVAKRLIDYGFHAPTLSFPVAGTLMVEPTESESLHELDRFCDALIAIRAEIARVEQGHWPQDDNPLKHAPHTAEALLKADWPHPYSREEAAYPVSSLRRQKYWAPVGRVDNVHGDRNLFCSCVPLSAYAEADKQA

SEQ ID NO: 2646 - protein, 543 aa, Candida tropicalis
MSSSPSIAQEFLATITPYVEYCQENYTKWYYFIPLVILSLNLISMLHTKYLERKFKAKPLAVYVQDYTFCLITPLVLIYYKSKGTVMQFACDLWDKNLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 2647 - protein, 482 aa, Citrobacter freundii
MSDAPLIPVIMAGGTGSRLWPLSRELYPKQFLHLTEDNSLLQTTLLRLSSLSCKTPLVISNEQHRFIVAEQLRQINQLHDNIILEPCGRNTAPAIALAAFSALKRNEKKEPLLLVLAADHVINESSAFCEAVKNSIPLAEDGHVVTFGIIPEYAETGYGYIERGLPLEKNKSSGDSLFYHVNKFVEKPNRRLAEEYVSSGNHFWNSGMFLFKASTYLCELKKYRPDIYDACESAMSTSYHDLDFIRLSEESFKGCPAESIDFAVMEKTECCVVYPLNIGRSDVGSWQSLWNISEKTETGDVCKGDVLTYNTKNNYIYSDSTLVAAIGIEDVVVIQTKDAILVSKKSEVQNVKKIVDMLKHQNRTEHVTHREVFRPWGKFDAIDQGDRYKVKKIIVKPGEGLSLRMHHHRSEHWIVLSGTAKVTLNNEIKLITANESIYIPLGAVYSLENPGVIPLNLIEVSSGDYLGEDDMVRQKERYRNED

SEQ ID NO: 2648 - protein, 253 aa, Borrelia burgdorferi B31
MLGDFMYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 2649 - protein, 230 aa, Medicago truncatula
MEFKGSFLIKLLLLLHVSILCASQSHDFDFFYFVQQWPGSYCDSQKSSCCYPTTGKPAADFGIHGLWPNYKDGTYPSNCDPSNAFKPSQISDLTSNLQKNWPTLACPSGNGITFWTHEWEKHGTCSESVLSQHDYFETTLNLRQKANLLQALTSAGIQPDGGSYTLSSIKGAIQNAIGYTPYIECNVDSSKNSQLYQVYLCVDTSGSDFIDCPVFPKGKACGSKIEFPSF

SEQ ID NO: 2650 - protein, 228 aa, Medicago truncatula
MESKGSVLIKLLLLLNVTVLCASQSQDFDFFYFVQQWPGSYCDSKKSCCYPTTGKPAADFGIHGLWPNYKDGTYPSNCDPNNAFDPSQISDLKSNLQQNWPTLACPSGDGIQFWTHEWEKHGTCSESVLKQHDYFETTLNLRQKANLLQALTSAGVQPDGNSYSLSSIKGAIQNAVGFAPFIECNVDSSGNSQLYQVYLCVDTSGSNFIDCPVFPHGKCGSEIEFPTF

SEQ ID NO: 2651 - protein, 444 aa, Oryza sativa
MMSNTLSFSFVLIICVAALHANGSPEEARFREFVRSRRSSTVTVSGSNGYSAHEPGARVSSRLKEEYSVSDQSNLKAADKITALPGQPKGVGFNQYGGINSDNKTLSRNEYAWNNVANVLFLESPAGVGFSYSNTSSDYDKSGDQRTANDSYIFLVNWLERFPEYKGRAFYISGESYAGHYAPQLAATILTHNMESKRMIINLQGILVGNPCLDEFKNLKGQIDYLWSHGVISDEVLANITKNCRFSPSDGKACSDAMDAFDSGNTDPYDIYGPVCINAPDGKFFPSRIVPGYDPCSNYYIHAYLNNPVVQKALHARVTTWLGCKKSYNMKRRKYISAKMQACGKYSNRTVTSTIFLSGDLDSVCPLTATRYSVGDLGLAVTEPWRPWTANREVGGYVQQYTGGLVFISVRGAGHQVPYFQPEKALIVVSSFLRGALPPYVKQQ

SEQ ID NO: 2652 - protein, 136 aa, Corynebacterium diphtheriae
MTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 2653 - protein, 396 aa, Sinorhizobium meliloti
MTEHNVRNFNINFGPQHPAAHGVLRLVLELDGEIVERVDPHIGLLHRGTEKLIEAKTYLQAIPYFDRLDYVAPMNQEHAFALAVERLTGTQVPIRGQLIRVLYSEIGRILSHLLNVTTQAMDVGALTPPLWGFEEREKLMVFYERACGARMHAAYFRPGGVHQDLPHQLVEDIGNWIDPFLKTVDDIDELLTGNRIFKQRNVDIGVVSLEDAWAWGFSGVMVRGSGAAWDLRRSQPYECYSDLEFDIPIGKNGDCFDRYLIRMIEMRQSARIMRQCVDRLLGDAKIGPVSSLDGKIVPPKRGEMKRSMEALIHHFKLYTEGYHVPAGEVYAAVEAPKGEFGVYLVSDGTNKPYRCKIRAPGYAHLQAMDFLCRGHQLADVSAVLGSLDIVFGEVDR

SEQ ID NO: 2654 - protein, 159 aa, Triticum aestivum
MPKKSKKSKSKRVTLKAKHKVLRKVKEHHRKKRKEARKEGKTGRSKVEKDPGIPNEWPFKEQELKNLEVRRAMAIKEQEDKKEARRERARKRKLGIPDDEDMANDNDAAEETAALAVPKTNDHSERAFYKELVKVIEASDVILEVLDARDPLGTRCVDM

SEQ ID NO: 2655 - protein, 331 aa, Yersinia pseudotuberculosis IP 32953
MTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 2656 - protein, 232 aa, Brassica napus
MSQIYSFAGESEFYRRGSNPKEANIFLSLVDCYYPPCKRSRVVAAAPSLFSAFEEEEKPVSIDLLPDECLFEIFRRLPGPQERTACAFVSKHWLTLVPPIRPRELDVVASDKTEDDCEGCLSRSLDGKKKATDVRLAAVAVGTAGRGGLGKLSVRGSDKVSDLGLRSIGRSCPSLGSLSLCNLSAVTDVGLLEIAEGCPQLEKLDLSRCPAITDKGLVAIAKSCPNLSELSL

SEQ ID NO: 2657 - protein, 448 aa, Lactobacillus plantarum WCFS1
MAKQSYSKDDIRRIVKEENVNFLRLMFTDLFGTIKNVEVPVSQLDKLLDNKLMFDGSSIDGFVRIEESDMYLYPDLSTWLIMPWNTEHGKIARIICEVYTSDRKPFEGDPRNNLIRVLNDMREAGYTSFNCGTEPEFFLFKMNEKGEPTTELNDKGSYFDLSPMDLGENCRRDIALELERLGFNVEASHHEVAPGQHEIDFKYADALSAADHIQTFKLVVKTIARKYNLWATFMPKPLNGVNGSGMHVNMSLFHDQGNAFYDANDKNGLELSSDAYHFLGGLMKHARSYTAVTNPTVNSYKRLVPGYEAPVYVAWSASNRSPMIRIPSARGLSTRLELRSVDASTNPYLAFAAVLEAGLDGIKNGIEPPKSVDRNIYVMDEDERAAAGIADLPSTLHNALKEFQTDPTMKKALGPHIYQSFLEAKRLEWASYRQQVSEWERDQYMELY

SEQ ID NO: 2658 - protein, 496 aa, Zinnia elegans
MCSTTLNMCDLEFFILASCLVLALFLILKLVKRRTNNGSTRNLPPGNMGWPFIGETIGYLQPYSATTIGKFMEQHISKYGKIYKSSLFGEPTIVSADPGLNKYILQNEGRLFECSYPRSIGGILGKWSMLVLVGDMHRDMRQISLNFLSNARLKTQLVNEVEKNTLWVLDSWKENSPFCAQEEAKKFTFNLMATHIMSLDPGEPETERLKKEYVTFMKGVVSPPLNFPGTAYWKALKSRATILKFIETKMEERIRMDEGNGLGKLDNDLLGWSMKNSNLTKEQILDLVLSLLFAGHETSSVSISLAVYFLEACPTAVRQLREEHEEIVMKKKLLGEKYLTWDDYKKMEFTQCVINETLRFGNVVRFLHRKAIKDVRYKGYDIPCGWKVLPVIAAVHLDPTHFDQPYLFDPWRWQNASVTSSTCSTPPSASNFMPFGGGPRLCTGSELAKLEMAIFIHHLVLKYEWELVDSDEAFAYPYLDFPKGLPIKIRHRKQSC

SEQ ID NO: 2659 - protein, 526 aa, Dehalococcoides ethenogenes 195
MKIPDLYTYLSEFLSPAINPLRLEKGANKDYYLGLDWAEAAALYPKLAEDGFGLIGLFGLEGFRGYEGLSLLYVFEKRNYSGALVIIRRTDSPVASIAAIFPSACYFEREIRDGYGCEFENAFDRRRLWLHETYPANFHPLVKSFKNQPLSLPAGVEDEALYPFKKVSGEGVYEVGVGPVHAGIIEPGHFRFSAIGEPVLNLEIRLFYKHRGLEKLAVGRDIDFGLKIAESVSGDESAANTYAYSSAVEHICSVRPPRRAEQLRLILLEMERLYSHLSDLSGMLTDVAYPVGAAALMALREELMRWNKRLSGSRFLKGIITPGGLLRDIPAGIVNELADYLRVFEGRFNQQVEKALAKTSVVDRFETTGIINNRLLVPLNITGVAARASGADIDTRLNQPYGLYSELAFEPPVLPEGDVMARFKVRVSEVQTSLGLILQTASRLSAGEYIVPLKPQNGYSLVLVESPRGQSLHWLWLRDGKIERYKVRTASYCNWQAIEHAVLGDIIPDFPLINKSLNLSYAGTDL

SEQ ID NO: 2660 - protein, 323 aa, Yarrowia lipolytica CLIB122
MIRAKFTEYKQALRNNWVGQPQYTEKDYPDIDGKNFVVTGATGGVGLEVTKLLLDKKSHVIMVGRSRSDWQPVLDQLQKDHSHGTLDFVEADLADLTTVQRAGEYIRTKYPTLDGAIFNAGVMAPPYSLTPQGQESQWGVNVVSHFLLAKYISPAVIAAAKTAPKDSVRLVWLSSSVTFVSPYEGGIKFDDINHQDDKNPSPWTLYSQSKIGDAYLAYLWSKHHPDSGVVSVSVDPGNLSSNLSRHYPILSTLKSYIQYPPKYGAYTELSALLNPAVKNNEHLIPWGVRGHLRLDVDDGRRGSVGEELWQRLNKDVAPYFKEE

SEQ ID NO: 2661 - protein, 523 aa, Candida albicans SC5314
MYQHQDQTQHQYYQQYNSYNPSIEDLIASSDDKRYQNGGIGNSLQRPPVAGLPYISSQVNPNTSSANLSKLTNNINNYGYNNNNNSYIQLHTPPLSSNPSFTSFQNLNYPLSPLSKPTSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIIQTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWESKQFSNSQSIGLVITLFGLYCYDRWGTVSNSGSASNPGKY

SEQ ID NO: 2662 - protein, 451 aa, Triticum aestivum
  misc_feature (415)..(415): Xaa can be any naturally occurring amino acid
  unsure (1)..(451): unsure at all Xaa locations
MGSDADMEDYGFEYSDDEPEEQDVDIENQYYNSKGMVETDPEGALAGFDAVVRMEPEKAEWGFKALKQTVKLYYKLGKYKEMMDAYREMLTYIKSAVTRNYSEKCINNIMDFVSGSASQHFNLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRVQGHIDQVNKLLECGDRSKGMXEISSHRQVEYSAQIYLPDGVQQSWVRDGRFPLVPAG

SEQ ID NO: 2663 - protein, 470 aa, Ashbya gossypii ATCC 10895
MTSPQQINNLQAAFQDALNMSGSPGVVSTSPTTSFMNTLPPRTSVAKQAKALKPFSTGDIKILLLENVNQTAIDIFDKQGYQVEFHKSSLGPEELIEKIRDVHAIGIRSKTKLTPEILKHAKNLVCIGCFCIGTNQVDLDYAAKMGVSVFNSPFSNSRSVAELVIGEIISLARQLGDRSIEMHTGTWNKVSHHCWEVRGKTLGIIGYGHIGSQLSVLAEAFGMHVLYYDVVTIMALGTAKQVATLDELLNNSDFVSLHVPATDETKNMISAPQLAAMRNGAYLINASRGTVVDIPSLIQAMKAGKIAGAALDVFPHEPAKNGSGAFGNQLSPWISDLVSLPNIILTPHIGGSTEEAQSAIGVEVATSLSKYINDGTSVGSVNFPEVSLRSLDLDQENTVRVLYIHQNVPGVLKTVNNILSDHNIEKQFSDSSGDIAYLMADISNVNYSDIKDIYDKLNATEYKISIRLLY

SEQ ID NO: 2664 - protein, 228 aa, Borrelia burgdorferi B31
MENQKILVAKHAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 2665 - protein, 315 aa, Glycine max
MELVQFLVLQYMQTKPPPMSLLPPPKPHRSSGNSPGDSIPDWISESINGGSLRRVDLNSGTNGWASPPGSVFSLRSESYFQNRQKCPAGDYLLSPAGMDWLKSAAKLDHVLSRADNRVMHALRRCQTLGRSLKSFVFAVNLQIPGAKEHHSAVFYFATEEPDPVRTGSLLNRFVHGDDAFRNQRFKLVNRIAKGPWIVKKAVGSHSACLLGKALNCAYYKGSNYLEIDVDIGSSAIANAILHLALGCVTTVTIDMGFVVEAQAEDELPERLIGAIRVCQMEMASATVVEALHVPRGVGWAKVNHHKSADELALDD

SEQ ID NO: 2666 - protein, 413 aa, delta proteobacterium MLMS-1
MISPIEDVVADIQAGKMVILVDDEDRENEGDLCMAAEMVTPEAVNFMATHGRGLICLTLTPEQLERLQLPMMVRDNRSPFETAFTVSIEARTGVTTGISAADRARTIQVAVNPEAKPADLISPGHIFPLRAKRGGVLVRTGQTEGSVDLARIAGLNPAGVICEIMKDDGTMARMPDLQEFAQKHELKIATIADLVAYRVRKDKLVHRAAEVQLPTMHGEFQAIVYNNDVDELEHVALVKGEIDPEKEVMVRVHSACLTGDVFGSKRCDCGGQLFNALRMIDREGCGVLLYMQQEGRGIGLINKLKAYALQDQGMDTVEANLKLGFKPDLRDYGIGAQILRDLGVRKMRLMTNNPKKIIGLEGYDLQVTDRLPIEMEAEPENVSYLTTKKDKMGHLLERLAYSKAATQMARNEP

SEQ ID NO: 2667 - protein, 608 aa, Triticum aestivum
  misc_feature (267)..(267): Xaa can be any naturally occurring amino acid
  unsure (1)..(608): unsure at all Xaa locations
MAAPSPTTAAATHHRALLPAPARRAALSLARASRGRICVSAPAAPAASTASPPATAAVAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLISMEEAMTTADFISLHMPLXTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPSPETPLEYIQVQIANVESKFPSAISESGFITVEGRVKDGIPHLTKVGAFEVDVSMEGSLILCRQVDQPGMIGSVGSVLGEENVNVSFMSVGRIAPRKTAVMAIGVDEEPSKATLTKIGEIPAIEEFVFLKL

SEQ ID NO: 2668 - protein, 397 aa, Desulfitobacterium hafniense Y51
MYRSALPGESYLQNNFLEGVGMKAIVYEGIRDVKVKNVGDPGIQKPDDIIVKVTSTAICGSDLHLIHGMVPGMPEGFVLGHETMGIVEEVGGDVHKVKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKGDTVVVLGCGPVGLLTIKWAIFQGAKRVIAVDHISYRLDHAYRYYGVEVINFEDHDNTGEYIKEITHGGADVVIDCVGMDGKASTFEKIETLLKLQGGSKSAIEIATQAVRKGGTVALVGVYGSKYNLFPLGDFFSRNITLKMGQCPAHSYVEPILELIKTGRFDATDIITHRLSLDKGEHAYEIFDEKKDNCIKVVLKP

SEQ ID NO: 2669 - protein, 259 aa, Sulfolobus tokodaii str. 7
MRVSIIGVGKIGYAILKGLKSLNVEIIGTGRSEETLDKIKKEGVEATRDNEYAIKKSDIIILAVKPQHFHSILDKVSKTAWEGKKVVSVMAGIRISTLTRLTNAKVYRAMPNINAVIGKATTALAEERDEEVERIFRTIGNVYWIPEELFDAWTAIIGSGPAFVAEIIDAFALGAVACGMSRELAYQAILDMVEGTVYTLRKDKTHPVLLRDQVTTPAGTTIRGLMVMESEGIKSAIIKTIEAAYQRSMAIGKEIDKMY

SEQ ID NO: 2670 - protein, 243 aa, Synechococcus sp. RS9917
MRKPVIAGNWKMHMTCAQARDWMTVFLPLIANTPEDRHLVVAPPFTAISTLAAMGQGSRLELSSQNVHWEGEGAFTGEISPTMLLEHGVRYAIVGHSEPRKYFSESDEQINHRGRSAQSHGLIPIVCVGESDEQRSRGEAERVIRRQVEQGLEGLDPAKLVVAYEPIWAIGTGKTCEASEANRICGLIRSWVGSPDLIIQYGGSVKPGNIDQLMAMSDIDGVLVGGASLDPESFGRIANYQKS

SEQ ID NO: 2671 - protein, 416 aa, Neurospora crassa
MAAVTSQTPQTGQDEVTDLSKQYDTPMGLAHSTMQALKDRIKLHYDLASDYYLNLWGEHIHHGYWATDEAKAKDTKEVAQVNLIRLLLEISKVSEGARVLDTGCGIGGTSRFLASELGCTVTGITISTKQVEMATRLTKAEAAKQIQGDDKTVTPDADGFIALGKGKVRFLELDAEKMGEYFASDAGTLDAVWISEALSHFPNKALFFQNAFKVLKQGGKLVLADWFKGEELNQTQFDNDIKPIEDGMLLPPLCTQPDYVKFATDAGLKVFHEPKDISKDVSKTWDISWSLVQNPSLWAFAFSQGRDGIAFLQAFRAMRRGYSNGSFRYAVMSFQNREQSYPTSIDISRPQPPPPPAHLLSSGPVRSDPSKLMAAYPQPRNQRGSELGILVPPRMNVGEVRISKTENRINGWSPDA

SEQ ID NO: 2672 - protein, 575 aa, Rickettsia akari str. Hartford
MNDHILINVIILLGTAVFIVAILKRLRLSPVLGYLIAGAAIGDHGLKIVTYDQTKLLGELGVVFLLFAIGLELSFERLKAMRRYVFGLGSLQVVTTAIVIAGAMVLIDGNSSAAIITGGGLALSSTALVMQVIEENRSQSTQIGRISLAILLLQDLAVVPLLVIVPLLAGNNKASLAGALGIALLKAVTALLTIFIVGRVFLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALIGIKTLIITAFCLLFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYEAGLQIGGTVLKNIGISEQEINRIKVQFRLGNYIIAKKEDALSEVEDND

SEQ ID NO: 2673 - protein, 187 aa, Triticum aestivum
  misc_feature (72)..(72): Xaa can be any naturally occurring amino acid
  misc_feature (78)..(78): Xaa can be any naturally occurring amino acid
  misc_feature (99)..(99): Xaa can be any naturally occurring amino acid
  unsure (1)..(187): unsure at all Xaa locations
PGSDAKKVAPEVIAEYTVRTLQRTVPAAVPAIVFLSGGQSEEEATLNLNAMNKLQTKKPWNLSFSFGRALQXQSTLKXAWSGKTENEEKARTASWVRSXQSEAPWTYKGDPPWRRASETSTQGLQLIYCFRTVAVWPLTIHCLVSDPEYLGTNTFNNMDFKNVYSLDYGLYMSLSCSPNLTSEILEP

SEQ ID NO: 2674 - protein, 254 aa, Xanthobacter autotrophicus Py2
MPASRRVLIAGNWKMNGLKSSLAEIEALAAGYDGDLKAKLDLLVCPPATLLISAAERLAGSGVQLGGQNCHPAPAGAHTGGISAEMLKDAGVTSVIVGHSERRTNLSESDAVVMAKVKAAWCFGLLPIVCVGETAEERDAGEAVGVVTRQVHQSLPEGCTASNLVIAYEPVWAIGTGRTPTPEDVANIHGTIRSVLRSQFGAEADGIRILYGGSVKPDNAATLMAVADVDGALVGGASLKAADFLAIARATPAR

SEQ ID NO: 2675 - protein, 211 aa, Solanum chacoense
EFFVLFFCLSPVYGTFDYMKLVLQWPPMYCRNKFCERIPRNFTVHGLWPDNKKYLLNNCRSYAYNALTNVREQSKLDDRWPDLTSNKSMTMKEQKFWEYEYNKHGTCCEKLYNQAQYFNLTMNLKDKFDLLRILRNHGIVPGSLALLSNSGRPLRQLTNKVFPSLKCIDNNGIMELLEVGICFDPAATKVIPCHRPWICHADENTRIELVK

SEQ ID NO: 2676 - protein, 209 aa, Triticum aestivum
  misc_feature (53)..(53): Xaa can be any naturally occurring amino acid
  unsure (1)..(209): unsure at all Xaa locations
SFYRRWTKNQDTVTLEEVLQPGNDMIAAGYCMYGSSCTLVLSTGNGVKAAHAXGFTLDPSLGEFILTHPNIKIPNKGKIYSVNEGNARNWDAPTAKYVERCKFPQDGSSPKSLRYIGSMVADVHRTLLYGGIFLYPADKKSPNGKLRALYEVFPMSFLMEQAGGQSFTGKHRALEIVPSEIHQRSPIFLGSYDDVEEIKSLYAAESSTA

SEQ ID NO: 2677 - protein, 153 aa, Emericella nidulans
MTSEQTFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 2678 - protein, 512 aa, Francisella tularensis subsp. holarctica
MKKTTLLVILDGWGYSDSDYFNAIKNANTPTWDSIWQEFPKTLINASSLEVGLPRSQMGNSEVGHVNIGCGRVVYQELTKIDKAIEEKTFGDNKAICAAIDNVIKNDSNLHLIGLLSPGGVHSHEEHIFEMIKIAKQKGIKRLYLHAFLDGRDTPPRSAEKSIKKADKLLQDLNLGYIASVCGRYYAMDRDNRWDRVEKAYNAIVNANADFIYDSALEALEQSYARDQSDEFVIPTCIKKDGHLVKVQDNDSVIFMNFRADRAREISHAFTDESFDHFPRKKHLNINFTTLTEYDSKLKCAVAFPPEQPINTLGEVLMKNHKTQLRIAETEKYPHVTFFFNGGREEQFEGEDRILIPSPKVATYDLQPEMSAPEVTDKLVAAINSGKYDCIVCNYANSDMVGHTGNYEAAMQAIEYLDKCIARLKDAILEHDGNMFITADHGNADMMVNPETQKPHTAHTTNLVPFIYVGHKKAQVALEHGKLSDIAPTLLNVMGIAQPKEMTGKTIFNFEK

SEQ ID NO: 2679 - protein, 521 aa, Yarrowia lipolytica CLIB122
MLEILIGVTLFFTLWRVLVLADLKRRQKKSGYGYPPIASNGLLGWRGLVHQLSGFVKDIGPAGWGAQFKEHGKTHLYPVFPTQLLVTRDPDNVKAILATQFKDFSFGIRKEALCPSLGYGIFTVEGSSWSHSRALLRPQFSREQISRLDSVEHHFQEFAQCVDNFKGEYFDIQKLFFAQSMDTSTDFLLGESVGCLKELLETRDGDESSKKFGANFQHAFDRVQRLVALRVVFQENYWIIGDVFFRNEFRQVNELIQKFVQGYVDKALKARAHKAPIYTNPDKYIFLYELARDTTNPRVLRDQVLNILIAGRDTTAATLSWLMFELAQKPHIFHKLRKAVIEDFGTTIENISFESLKQCEYLRYVLNEVLRLHPVVPINLRVALKDTTLPRGGGPNGDEPIFVPKGQKINYAVYWTHRDEQYWGEDAEEFKPERWDTTNHPGPLGKGWEFLPFNGGPRICLGQQFALTEMGYILTRLVQEYSDIGIDEEYHDRPLRVRHSITMSHGDGVHVRLSREGTVVS

SEQ ID NO: 2680 - protein, 492 aa, Burkholderia vietnamiensis G4
MLPGHPVLFKSMCYVDGRWIHSDSAATRAVVNPADQSVIGHVPMLERAQIVGAVDAAQRAFGTWRWTPQAARSAALLRWHALILRHLDDLAALLSLEQGKPLAEARGEIRYAASFVEWFANEAKRAVGRTIPTHIDGAHLGTVMEPVGVAALITPWNFPAAMITRKAAAALAVGCTVIVKPAHETPFSALALAQLADEAGFPAGVFNVVLGEPQMAMEALVGDARVRAVSFTGSTRVGRLVTETAAKAGIRKIALELGGNAPFIVTDDADLDDAVRIAVGAKFQTSGQDCCAANRIFVARALYDAFVGRYASAVRALKTGPAFEPGVDVGPLMHQAAFDATVARVDDARARGARIVAGGRPHALGGWFYEPTVIADAAPGMRVYDEENFAPISAVCAFDTLDEVVARANDTEYGLAAYVCATRIDTIFRLVRRLDFAMVSVNGVKFTGAPIPFGGMKASGLGREGGVEGFEPFTETKYFCFGNLGLPVAATA

SEQ ID NO: 2681 - protein, 390 aa, Oryza sativa
  misc_feature (296)..(296): Xaa can be any naturally occurring amino acid
  misc_feature (348)..(348): Xaa can be any naturally occurring amino acid
  unsure (1)..(390): unsure at all Xaa locations
MCDLLTHPQAHLFLPKKSEWGATRRAAAPKPVTVSMVVRAGAYDDELVKTAKTIASPGRGILAMDESNATCGKRLASIGLENTEANRQAYRTLLVTAPGLGQYISGAILFEETLYQSTVHGKKIGDILTEQKIVPGIKGDKGLVPLAGSNNESWCQGLDGLASHEAAYYQQGARFAKWRTVVSIPNGPSELAVKEAAWGLARYAAISHDNGLVPIVEPEILLDGEHGIDRTFEVAQKVWAETFFYMAENNVMFEGILLKPSMVTPGAECKDRATLEQVSDYTLKLLHRRIPPAVPXIMFLSGGQPEVEATHNLNAMNQGPQPVARVRFSYAEGAAKHAPFKTWGGQPXNREGRRRTALPPPRPRPNSLGQLGKSNQRREAPEAQEDAPKN

SEQ ID NO: 2682 - protein, 797 aa, Schizosaccharomyces pombe
MLNYQCLETDSYCGTSHIELDGIHIYIDPGSDDSLKHPEVPEQPDLILLSHSDLAHIGGLVYAYYKYDWKNAYIYATLPTINMGRMTMLDAIKSNYISDMSKADVDAVFDSIIPLRYQQPTLLLGKCSGLTITAYNAGHTLGGTLWSLIKESESVLYAVDWNHSKDKHLNGAALYSNGHILEALNRPNTLITDANNSLVSIPSRKKRDEAFIESVMSSLLKGGTVLLPVDAASRVLELCCILDNHWSASQPPLPFPILFLSPTSTKTIDYAKSMIEWMGDNIVRDFGINENLLEFRNINTITDFSQISHIGPGPKVILATALTLECGFSQRILLDLMSENSNDLILFTQRSRCPQNSLANQFIRYWERASKKKRDIPHPVGLYAEQAVKIKTKEPLEGEELRSYQELEFSKRNKDAEDTALEFRNRTILDEDLSSSSSSEDDDLDLNTEVPHVALGSSAFLMGKSFDLNLRDPAVQALHTKYKMFPYIEKRRRIDEYGEIIKHQDFSMINEPANTLELENDSDDNALSNSNGKRKWSEINDGLQQKKEEEDEDEVPSKIITDEKTIRVSCQVQFIDIEGLHDGRSLKTIIPQVNPRRLVLIHASTEEKEDMKKTCASLSAFTKDVYIPNYGEIINVSIDVNAFSLKLADDLIKNLIWTKVGNCEVSHMLAKVEISKPSEEEDKKEEVEKKDGDKERNEEKKEEKETLPVLNALTLRSDLARAPRAAPLLVGNIRLAYLRKALLDQGISAELKGEGVLLCGGAVAVRKLSGGKISVEGSLSNRFFEIRKLVYDALAVV

SEQ ID NO: 2683 - protein, 253 aa, Borrelia burgdorferi B31
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 2684 - protein, 510 aa, Pseudomonas syringae pv. phaseolicola 1448A
MTATPKPLVLIILDGFGHSESHEGNAILAAKMPVMDRLYETMPNGLISGSGMDVGLPDGQMGNSEVGHMNLGAGRVVYQDFTRVTKAIRDGEFFENPTICAAVDKAVGAGKAVHIMGLLSDGGVHSHQGHLVAMAELAVKRGAEKIYLHAFLDGRDTPPRSAKKSLELMDATFARLGKGRTATIIGRYFAMDRDNRWDRVSTAYNLIVDSTAEFHADSGVAGLEAAYARDENDEFVKATRIGEPARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVECLDVCVGRITAALEKVGGEALITADHGNVEQMTDDSTGQAHTAHTSEPVPFVYVGKRPLKVREGGVLADVAPTMLHLLGMEKPQEMTGHSILVAK

SEQ ID NO: 2685 - protein, 329 aa, Xanthobacter autotrophicus Py2
MSELVTLKTYLGTWAGADTGRTAVAQAVTAIAEAGVGIADLVARGPLEEGLASIRGVDPNAGGDAQKELDVVAEERIKAALLPTPTAFLASEESEELIPLNPDGRLVIAVDPLDGSSNIDTNVSVGTIYSILPYDAAVHTDPVSAVMRPGVNQVASGFLAYGPATILVATFGEGTQVFVHDRQTGEFVLARTNVEIPAETKEYGVNQSNVRHWAEPMSAYIADCLAGKDGPRGKDFNMRWVGSMVADAFRIFTRGGVYVYPGDKRKGYENGRLRLIYEANPVAFLTEQAKGAATDGKTRILDIQPHHIHQRIPLVFGSKAEVEKIASYY

SEQ ID NO: 2686 - protein, 233 aa, Zea mays
  misc_feature (226)..(226): Xaa can be any naturally occurring amino acid
  misc_feature (229)..(229): Xaa can be any naturally occurring amino acid
  unsure (1)..(233): unsure at all Xaa locations
MESATAAVRSASLARARPAPLVHGRARGAGRVVGAGLAARARRRALVAVASHQEHHEPLPPRAQEGGAVAVATQADEAEVHAIDAPAAAAETSSSQLAAGKTVRVRFVLKRQCTFGQSVCLVGDDPALGLWDLSNAFPLKWAESHDWTLEKDLPANKLIEFKFLLQDSTGKLHWQGGPNRSFQTGETAANTLVVFEDWGDVKNQKIVEEGGVASAGIEQTVVSNVXESXKDNV

SEQ ID NO: 2687 - protein, 379 aa, Neurospora crassa
MPSTIALEKEDHQRDAEFKKVMHGDSAKAAGGVAALLKKNTEAQQIAVDEYFKHFDNKTAEAETQADREARTKEYATLTRHYYNLATDIYEYGWGQCFHFCRYSPGESFYQAIARHEHYLAAQIGIKKDMKVLDVGCGVGGPAREIAKFTDAHITGLNNNDYQIDRATHYAVRDGLSGQLKFVKGDFMQMSFPDNSFDAVYAIEATVHAPKLEGVYGEIYRVLKPGGTFGVYEWLMTDNYDNDNVEHRDIRLAIEVGNGISNMVTISEGLAAMKNVGFELVHHEDLADRNDPMPWYWPIAGELRYMQSYLDFFTVVRMTHTARRILHGFAGILETVGLAPKGTKKTADALARGADGLVAGAKKKLFTPMYLMVGKKPLN

SEQ ID NO: 2688 - protein, 319 aa, Lycopersicon hirsutum
MGSKYSKATNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYALRLQESVI

SEQ ID NO: 2689 - protein, 221 aa, Microcystis viridis
HKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 2690 - protein, 322 aa, Desulfovibrio desulfuricans G20
MRITVLDGYTLNPGDLSWAEIEKLGEVTVHDRTHGQDIVKRGGQAQILLTNKVRLTAETLAMLPQLRFISVLATGYDVVDIAAAAARGIPVSNAPGYGVEAVAQHTMALLLELCRKTARHDTLVKQGAWSQAPDWCFWEGTQQQLTGKTMGIVGFGNSGRRVAVLADAFGMDVIAYAPRPKEAPALRNFRFAPLEELTAQADVISLHCPLTADNRHLINAQRIASMKDGALLLNTARGPLVDETALAQALVSGKLGGAGLDVLETEPPLPDNPLFRAPNCLITPHIAWATQTARQSLMSITARNIEMFKHGTPQNVVNAHML

SEQ ID NO: 2691 - protein, 460 aa, Pseudomonas putida KT2440
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDSGGFMPNGFGTVLGGVLITIFSFFGAEIVTIAADETANPKDKIRRATNLVVYRIAIFYLASIFLVVSLVAWNDPGLKAVGSFQRVLEVLNVPGAKLLVDLVVLVAVTSCMNSGLYTASRMLYSLGARGQALSVTKRISGSGVPTVAVIFSTLAGFAGCFVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRAKMVAQTA

SEQ ID NO: 2692 - protein, 221 aa, Microcystis wesenbergii
HKTQREALEFLQDFKSHLEETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 2693 - protein, 548 aa, Magnaporthe grisea 70-15
MTLLEFSPWAPAILVPVALIVLYTFLAAPRLKRNGIPLKTPRDSLPFVGNGIVFLQPRQKLFAWFHQREREFGLETYQITVPTLPPGVVISDPVCLEYVFKNETLFNKGAFFKERSDDLFGHGIINVDGEPWRAQRKAGLNFLNTTNLRVLTDVALPRYLNENIGWLKNKADGETVADLQEVFHRITSQLMGKMAYNMEMHAGDDFSVAFDYASGATAERFQNPLWFITEFFTGSRLRRSLAIVKEHGRKIVANATCDRKAAEKLSATLPGVDADSEHDGLEEISGSLIQSLLDCIGDEKLVADAALNYLSAGEMLFSCSKTRTYPLTAIHQQRNSWIANQFAGRDTVAQALTWTSYLLMQHPEAIERIRAETAELISPMDGSAGNHTTLLKPPSAPYTMAVFYETMRFYPPIPFEIKQCVRETTLPDGTFLPASSVVVWCPWAMNRSKAIWGSDVDEFRPERWLSLDGKSFASRSAAEYPVFNGGARMCLGKKMADIIAVQVLPSIVTNFDFRPAYEKQQERVSKSSLTLPMQDGLPVFVKRRDVAR

SEQ ID NO: 2694 - protein, 473 aa, Salmonella enterica
MSKLIPVIMAGGIGSRLWPLSREEHPKQFLSVDGELSMLQNTIKRLTPLLAGEPLVICNDSHRFLVAEQLRAINKLANNIILEPVGRNTAPAIALAAFCSLQNVVDEDPLLLVLAADHVIRDEKVFLKAINHAEFFATQGKLVTFGIVPTQAETGYGYICRGEAIGEDAFSVAEFVEKPDFDTARHYVESEKYYWNSGMFLFRASSYLQELKDLSPDIYQACENAVGSINPDLDFIRIDKEAFAMCPSDSIDYAVMEHTRHAVVVPMNAGWSDVGSWSSLWDISKKDPQRNVLHGDIFAYNSKDNYIYSEKSFISTIGVNNLVIVQTADALLVSDKDSVQDVKKVVDYLKANNRNEHKKHLEVFRPWGKFSVIHSGDNYLVKRITVKPGAKFAAQMHLHRAEHWIVVSGTACITKGEEIFTISENESTFIPANTVHTLKNPATIPLELIEIQSGTYLAEDDIIRLEKHSGYLE

SEQ ID NO: 2695 - protein, 427 aa, Pseudomonas putida KT2440
MSRSEALFAQAQKHIPGGVNSPVRAFKSVGGTPLFFKHAEGAYVVDEDDKRYVDYVGSWGPMILGHGHPDVLDSVRRQLEHGLSYGAPTAMETEMADLVCSIVPSMEMVRMVSSGTEATMSAIRLARGYTGRDAIIKFEGCYHGHSDSLLVKAGSGLLTQGVPSSAGVPADFAKHTLTLPFNDIAAVEKTLAEVGQTVACIIVEPVAGNMNCVPPAPGFLEGLREQCDKHGVVLIFDEVMTGFRVSLGGAQGHYGIKPDLSTFGKIVGGGMPVGCFGGKREIMGCIAPLGPVYQAGTLSGNPLAMAAGLTTLKLISRPGFHAELTDYTSRMLDGLQQRADAAGVPFVTTQAGAMFGLYFSGADDIVTFEDVMASDAERFKRFFHLMLDGGVYLAPSAFEAGFTSIAHGDKELQITLDAAEKAFAALK

SEQ ID NO: 2696 - protein, 208 aa, Solanum chacoense
LLFSLSSCYGTFEHLQLVLTWPTSFCHKERCIRSSSNFTIHGLWPDNTSTRLNFCKIVKYNKIEDEHKIDALEYGWPNLTTTEAVSKEDQVFWGKQYTKHGSCCTDLYDKDAYFDLAMNLKDRFDLLKILAMHGITPGTSHHTSSNIQNAVKSVTQGVPHVTCFNNRFKGTSELLEIALCFDPQAQNVIHCPRPKTCNSKGTKGITFP

SEQ ID NO: 2697 - protein, 136 aa, Triticum aestivum
MAAEPEQAPAAQEAAVHIVYVDRPEDADPEEFHIRTLAPVLGSEEKARGAVLYHYKHAASGFSAKLTTEQVEDLKKQPGVLQVVPSQTVQLHGNEGGHPDNAHHGPYVTALSRLCSSNVGMVASHGCNPRIRDVST

SEQ ID NO: 2698 - protein, 147 aa, Triticum aestivum
  misc_feature (42)..(42): Xaa can be any naturally occurring amino acid
  unsure (1)..(147): unsure at all Xaa locations
EYKEVQREKSADPDIQLICDDSNIFKWTALIKGPSETPYEGXVFQLAFAIPEQYPLLPPQVRFLTKIFHPNVHFKTGEICLDILKNAWSPAWTLQSVCRAIIALMAHPEPDSPLNCDSGNLLRSGDIRGFQSMAKMYTKLAAMPKKS

SEQ ID NO: 2699 - protein, 458 aa, Bacillus cereus E33L
MSTKMTPPVEKNEFIDVVFEDLTHDGAGVAKVKGYPIFVKNGLPGEEAQIKIVKVKKNFAFGRLMKLHTESPYRKEAECPVYNQCGGCQLQHLTYEGQLQAKEKQVRDVMQRIGGLGDVPVHPVLGMKNPWVYRNKAQVPIGEREGGLVAGFYRQGTHDIINMETCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 2700 - protein, 206 aa, Zea mays
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASVRKLIGKTDPLQAEPGTLEEILLNNPEELVHGSESPETKA

SEQ ID NO: 2701 - protein, 340 aa, Glycine max
  misc_feature (323)..(323): Xaa can be any naturally occurring amino acid
  unsure (1)..(340): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLPKVINDRFYIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYXAPRVVDLIRQMGTAPSK

SEQ ID NO: 2702 - protein, 161 aa, Glycine max
MKDEDGTPQSAGKGQYKLWVLGAIILLALWSMFTASLTLKWSAGNLNRDFDSATLNDFDVLEVEEREKVVRRMWDVYTQSKSGRGSGLPRFWSDAFHAAYDHLVSDVQSVRDAAVSEIAKISLHSLPLHHLKSHSIVQNIMGSRKMKQAESIVNTTISSDQ

SEQ ID NO: 2703 - protein, 254 aa, Brassica napus
MARKFFVGGNWKCNGTAEEVKKIVNTLNEAQVPSQDVVEVVVSPPYVFLPLVKSTLRSDFHVAAQNCWVKKGGAFTGEVSAEMLVNLDIPWVILGHSERRALLNETNEFVGDKVAYALAQGLSVIACVGETLEQREAGSTMDVVAAQTKAIADRVSNWSKVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 2704 - protein, 389 aa, Thiobacillus denitrificans ATCC 25259
MTARRPRTATRADAIAPFHVMDILARAQALEAAGRDIIHLEIGEPDFATPGPIVEAGIAALRAGHTRYTGALGLPALRRAIAEFHRTYWGTPVEAERVVVTPGASGALLLVLGLLAGPGDEVLMADPGYPCNRNFAQFCDARAVEIPVDAASGFQLTREAIERHATPATRAVLIANPSNPTGTTIDPEALADIHAWCAARGIALIVDEIYLALTYDGDTHSAARWDDVFVINSFSKCFLMTGWRLGWLVAPAWALAALERLAQNLFLAPPTPAQHAALAGFEPATLAILETHKAELRARRDFLLPALRARGFAIPVIPHGAFYLYADCSALAADSQVLAGLLLEQAGVATTPGVDFGRHDPARYLRIAYTQPKPRLDEALARIDRFLRP

SEQ ID NO: 2705 - protein, 320 aa, Lycopersicon hirsutum
MGSKYSKATNSINDASNLSYGVPFENYRVPFVDLDEATNNFDDKFFIGEGGFGKVYRGVLRDGTKVALKRHNHDSRQSIKEFETEIEILSFCSHPHLVSLIGFCDERNEMILIYDYMENGNLKSHLYGSDLPTMSMSWEQRLEICIGAARGLHYLHTNGVIHRDVKSSNILLDENFVPKITDFGISKTMSELDQTHLSTAVKGNIGYIAPEYALWGQLTEKSDVYSFGVVLLEVLCARPALDLSEMMSLGDETQTMGQLEQIVDPTIAAKIRPESLRMFGETAIKCIAPSSKNRPSMGDVLWKLEYALCLQEPTIQDDPE

SEQ ID NO: 2706 - protein, 283 aa, Pyrococcus furiosus DSM 3638
MREITPKRIMEMKGKEKITMITAYDYPSALLADKAGFDIVFVGDSLGMVVYGEQNTLNVTMDQMIFHTRAVAKAVKRALVLADMPFGSYEVSVEEGVKNAIKLIQAGADAVKIEGGYDHRKLVKKLVRMGIPVMGHTGLTPQRYLRLGGYRIMGENEEEVEEILRDAKALEKAGAFAVVLEFVLADVAKLVTEEVSIPTIGIGSGPYVDGQVLVWHDVLGLYESSPPFAKRYANLREEILRAISEFRKEVKEGKFPGKEHYWEYQDKETFNRIKENVMRKLRL

SEQ ID NO: 2707 - protein, 323 aa, Lycopersicon hirsutum
MGTNYSKPTTSINDASNLRNRVPFESFRVPFVDLQEATNNFDDKFLIGVGIFGKVYRGVLRDGTKVALKRRKPESPQGFEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTMPEFDQTHLSTMVQGSIGYIDPEYFIRRQLTKKSDVYSFGVVLFEVLCARPAISRSHMISLAEWAVETQKMGQLEQIVDPTIVAKIRPESLRMFGETAVKCLASSSENRPSMGDVLWKLEYALHLQEPIIQDNPE

SEQ ID NO: 2708 - protein, 481 aa, Desulfovibrio desulfuricans G20
MKTVFSQSVPGRMACVPPEAEEHAADFIPKNLLRTRRPALPELSELDVVRHFTRLSRLNYSVDSNFYPLGSCTMKYNPKFTEPLAALPGFTELHPLMAQIKSAGLYTQGALEVMYETERLLCEINGMHAFTLHPMAGAHGELTGVMLIAAYHRDKGNKKTKIICPDSAHGTNPASAALGGYEVVNVESKDGIVDPEALEAVLDNDVAAVMMTCPNTLGLFEKHLPRIVEKLRSVDALLYYDGANLNAIMGKMRVGDVGFDVVHLNLHKTFGTPHGGGGPGSGPVGVSERLEPYLPVSRVDRLRDGRLFLNYDYPKSIGYMAPFYGNFGVYIKALAYIMRLGREGIPKAAELAVLNANYLRKKLEQYITIPYNRICMHEFVASACDKAECGVRALDIAKGLLDKGYHAPTIYFPLIVKECLMFEPTETESKETLDTFVDDLAAILKEGEQNPEALHQAPLTTPVRRLDETLAARSMVLTDDA

SEQ ID NO: 2709 - protein, 510 aa, Arabidopsis thaliana
MEMLNAIILILFPIIGFVLIFSFPTKTLKAKTASPSNPTSYQLIGSILSFNKNRHRLLQWYTDLLRLSPSQTITVDLLFGRRTIITANPENVEHILKTNFYNFPKGKPFTDLLGDLLGGGIFNSDGELWSSQRKLASHEFTMRSLREFTFEILREEVQNRLIPVLSSAVDCGETVDFQEVLKRFAFDVVCKVSLGWDPDCLDLTRPVPELVKAFDVAAEISARRATEPVYAVWKVKRFLNVGSEKRLREAIKTVHLSVSEIIRAKKKSLDIGGDVSDKQDLLSRFLAAGHGEEAVRDSVISFIMAGRDTTSAAMTWLFWLLSQNDDVETKILDELRNKGSLGLGFEDLREMSYTKACLCEAMRLYPPVAWDSKHAANDDILPDGTPLKKGDKVTYFPYGMGRMEKVWGKDWDEFKPNRWFEEEPSYGTKPVLKSVSSFKFPVFQAGPRVCIGKEMAFTQMKYVVGSVLSRFKIIPVCNNRPVFVPLLTAHMAGGLKVKIKRREQCDSMYI

SEQ ID NO: 2710 - protein, 312 aa, Leuconostoc mesenteroides subsp. mesenteroides ATCC 8293
MSEKRIHIVGDLHEVAIQKFTSAGYDVSHSPNYDEKKLLSLASDAAVIIMTDMAFDKNWFDALPNLKLIARRGVGYDNIPVESATKHGVWVTNTPGANAIAVAELAVTLILTVLRKVNQATNSVQKGEALTYPASLMGHNLSGKIIGLIGYGQIAQNLEKILHGFGAHVLVYSRTKRETLYGQFVSYDTLLAQSDIISLHIPATPETSGILNHEAFSKMKTNAILINTARAALVDEEALVEAINTGKIAGAGLDTTSYETIKTASPLLNHDQIVITPHIGANTVESEYLTAEKVVASVLDFFNNQKPIYRLN

SEQ ID NO: 2711 - protein, 394 aa, Triticum aestivum
  misc_feature (359)..(359): Xaa can be any naturally occurring amino acid
  unsure (1)..(394): unsure at all Xaa locations
MLPTRWELSHMVDLQAAALVISVVAAEVTSPVPSSRPQPTSHLRLASRRQFHSLAMGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGMXIALNDHFVKLVSWYDNEWGYSNRVVDLIRHMAKTQ

SEQ ID NO: 2712 - protein, 367 aa, Crocosphaera watsonii WH 8501
MGIDYPYVAEEAQPGTQVLLDDGLLELGVETVEGKAVTCKVIEGGILKSHKGVNFPSLNLRLPSMTEKDKKDLEFGISQGVDIISLSFVRQAADIQTLKAFLAERNVDIPVLAKIEKPQAIEHLEAIVDECNAIMVARGDLGVEMRPEKVPLLQKRIIRMSNQKGIPVITATQMLDSMIRNPRPTRAEASDVANAIIDGTDAVMLSGESAVGDFPVQAVNMLASIARDVEPEITFANYPPRNRDKAHALSEAINAVDQVLDLQCIVALTETGYSAKLAAAERPKVPVVALTPSIEVYHRLNLVWGVRPVLFEYDDLTLEDLVKQMDSLLLERNFVTKRDQVLILGGLPLRQARSTSFLDIHTIGEPN

SEQ ID NO: 2713 - protein, 805 aa, Arabidopsis thaliana
MGMVLFACLLLLIIFPTCGYAAINTSSPLSIRQTLSSPGGFYELGFFSPNNTQNQYVGIWFKKIVPRVVVWVANRDTPVTSSAANLTISSNGSLILLDGKQDVIWSTGKAFTSNKCHAELLDTGNFVVIDDVSGNKLWQSFEHLGNTMLPQSSLMYDTSNGKKRVLTTWKSNSDPSPGEFSLEITPQIPTQGLIRRGSVPYWRCGPWAKTRFSGISGIDASYVSPFSVVQDTAAGTGSFSYSTLRNYNLSYVTLTPEGKMKILWDDGNNWKLHLSLPENPCDLYGRCGPYGLCVRSDPPKCECLKGFVPKSDEEWGKGNWTSGCVRRTKLSCQAKSSMKTQGKDTDIFYRMTDVKTPDLHQFASFLNAEQCYQGCLGNCSCTAFAYISGIGCLVWNGELADTVQFLSSGEFLFIRLASSELAGSSRRKIIVGTTVSLSIFLILVFAAIMLWRYRAKQNDAWKNGFERQDVSGVNFFEMHTIRTATNNFSPSNKLGQGGFGPVYKGKLVDGKEIGVKRLASSSGQGTEEFMNEITLISKLQHRNLVRLLGYCIDGEEKLLIYEFMVNKSLDIFIFDPCLKFELDWPKRFNIIQGIARGLLYLHRDSRLRVIHRDLKVSNILLDDRMNPKISDFGLARMFQGTQYQDNTRRVVGTLGYMSPEYAWAGLFSEKSDIYSFGVLMLEIISGKRISRFIYGDESKGLLAYTWDSWCETGGSNLLDRDLTDTCQAFEVARCVQIGLLCVQHEAVDRPNTLQVLSMLTSATDLPVPKQPIFAVHTLNDMPMLQANSQDFLSVNEMTESMIQGR

SEQ ID NO: 2714 - protein, 483 aa, Bacillus cereus E33L
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFMQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 2715 - protein, 92 aa, Geobacter sulfurreducens PCA
MPTATARHILVSSEAECLQLKAEIEAGAEFADVARQHSLCPSRAQGGDLGTFTQGQMVKEFDDIVFSGEINKVLGPVRTQFGYHLIEITKRW

SEQ ID NO: 2716 - protein, 171 aa, Pringlea antiscorbutica
KLWPNAKYVSSIMTGSMLPYLKKLRHYAGGLPLVSADYGSTESWIGVNVDPHFPPEDVSFAVIPTFSYFEFIPLYRQQNQQDICSDGDFVEEKPVPLSQVKLGQEYELVLTTFTGLYRYRLGDVVEVTGFHKGTPKLSFIYRRKLILTINIDKNTEKDLQRVVDKASQLLS

SEQ ID NO: 2717 - protein, 558 aa, Lactobacillus plantarum WCFS1
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPWFKRSRQDRTNQYRDFYFWRSGNGKKAPNNWDAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADRHELDMVFEFQHLRLDNSQHGLGKWSTRKTPLVALKKVISDWQVGLEGRAWNSLFWNNHDTPRAVSRFGDDRPAYRVRSAKMLATCLHILQGTPYIYQGEELGMTDAHFTELTSYRDIESLNAYRDLVTERQLLSPADMMARLAARSRDNSRTPMQWDTEVNAGFSDAAPWLTVNPNYRQINAAAALADPDSVWYYYQHLIQLRHQYPLVTLGSFELLWADDPQVFLYARQWEGRTWLVCCNFTAETLSRPLDQYLTPTAKCLISNYGEQQPNKLRPYEAWVYQLA

SEQ ID NO: 2718 - protein, 262 aa, Chromobacterium violaceum ATCC 12472
MKITVNTLHKLAEEGRKITMLTCYDASFASLLDEAGVEILLVGDSLGPVMQGVDSTLPVSEEDMLYHIRCVARGAKNALILGDMTFGAYQESPQQAFAHAARLLQAGAHMVKLEGGAYMAETTRFLVERGIPVCSHIGLTPQYVNMFGGYRVQGRGEDAQRILNDAKVLAEAGASLVLMECVPAPLAKEITETVKAPTIGIGAGADTSGQVLVLHDMLGVYPGKKAKFVKNFMEEAGSIQGAVQAYIKAVKDKTFPAEEHTY

SEQ ID NO: 2719 - protein, 117 aa, Glycine max
  misc_feature (37)..(37): Xaa can be any naturally occurring amino acid
  misc_feature (80)..(80): Xaa can be any naturally occurring amino acid
  unsure (1)..(117): unsure at all Xaa locations
MASSMIFSPADTTVNRAGAGMAGPFTGLKYMAGFPTXRKTNNDLTWIARHGGKRPCMHVWPTIGKKKFETLSYLPDLDDXPLAKEGQYPLKKGWDPLLGITLEHRFAYPEHKKAPGY

SEQ ID NO: 2720 - protein, 540 aa, Prochlorococcus marinus subsp. pastoris str. CCMP1986
MSKFSSKNINKTKVPESPVVLAILDGWGHREENLDNAIKNANTPIMDSLWHAYPHTLINASGADVGLPNGQMGNSEVGHLTIGSGRIIQQELVRITNVVKNNQLTQVNELKEMANSIKKKKGTLHITGLCSDGGVHSHIDHLLGLIKWASEEHIEKVAIHIITDGRDTPAKSAYKYIRQIEDCIKKFKVGEIASICGRYWIMDRNLIWERTEKAFVNLTDPNGKKIDISPADYLNKSYNANITDEFLEPIRISKDFLKDEDSLICFNFRPDRARQIIKALSEKEFDNFKRKSIPDVDILTFTQYEANLPVKIAFPPESLNNFIGQIVSENGLKQYRTAETEKYPHVTYFFNGGVEVPSPGEQRHLIPSPRVATYDMAPEMSAEELTISCSNAIKTGQYSFVVINFANPDMVGHTGNMAAAIKAIETVDRCIGKIVNATGEMGGSILITADHGNAELMKGPDGEPWTAHTINKVPLIFIEGEKRKIPNMGNEIYLRENAGLADIAPTLLQLLNLPIPKEMTGKSLIKEIELKGFNKVVQHV

SEQ ID NO: 2721 - protein, 321 aa, Glycine max
MSATNVPKVLLQLQPPSKSNPLCVPVIGLGTAAVHNDGDTVKAAVIEAIKLGYRHFDTAAQYGSEQALGEAIAEALRVGLIASRDELFITSKLWCCDNHPHLVLPALQNSLRSLKLDYLDLYLIHWPITAKPGMWEMPYSEESLVPFDLKSVWAAMEECHKLGLTKSIGVSNFSCKKLENLLSFATIPPSVNQVEMNIAWQQKNLRAYCKAKGIIVTAYSPLGAKGSKWDINQILDNELTKQIAQAHGKTAAQVCLRWLFEQGVTFIPKSYNKERLKENLEIFDWSLTKDDHEKINQVKQERMFKYGTAAFPLPDLFDGET

SEQ ID NO: 2722 - protein, 443 aa, Desulfovibrio desulfuricans G20
MPYTPHTPEEIRQMLDVIGVKSIDDLFAEIPPEMQPRSFDIPEGMSEMEVCARIQRMAAKNRIDLVSYLGAGFYDHHIPKAVDNLVSRGEFYTAYTPYQPEASQGTLQAIFEYQTAVCRLMEMEVANASVYDGGSAIFEAMMMAARATRRSKLVIDEALSPIYRTMLASYTSNLNMELVTVAHNEGRSDKQALMDAVDDKCAAVVVQNPNFFGAVDDFTELFTHARSCNALGVISVYPVMQSVLKTPGEMGADIAVADGQSLGMPLSFGGPYLGIMTCTKKLARQIPGRIAGRTKDVDGKTGYVLTLQAREQHIRRAKATSNICSNQALCALRAIIHMCLTGPEGLVRTAELSMERAHYAADRLTALPGVSLLHDAPFCNEFALRLPVSAYDVVDRLVNHGVVPGFPLGGYYAGMDDVLLVACTEKHSFEQIGIMAELVGGML

SEQ ID NO: 2723 - protein, 474 aa, Anabaena azollae
MTTSQEVLKRIQDEKIPLIHLKSIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGLRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 2724 - protein, 211 aa, Cryptococcus neoformans var. neoformans JEC21
MEEEILMHLQQKWEAKLLETRVADFARAGSSSRSPSPTLESKPEASSPPAGPSNSQSADMFPFPRQGQVQGSSAAMPGAPGVGALGTNGFVNGGVQVPSGQQQGETRVKMDPDEVMRLRGGAAEDGHKPEPNAAGLLPGDDVIDSDLDDSDDEFRGDVDGGEDENDVDIVFCVYDKVQRVKNKWKTVFKDGMIHLNGKDYLFAKCNGEFEW

SEQ ID NO: 2725 - protein, 338 aa, Magnetospirillum magnetotacticum MS-1
MADKTIHVAGIGNAIVDVLVHADDLLLHRLGLTKGVMTLIDAEQAESIYAQLPPGIECSGGSAANTIAGIAALGGRAAYVGKVKSDQLGQVFRHDIRNMGVHFETEADDGGPSTARCFVLVTPDAQRTMLTYLGACVELGPDDVDIGLITGAEITYLEGYLYDPPEAKRAFLKAATVAHGAGRLVSLSLSDPFCVDRHRDAFLDLVAGHVDILFANESELCSLYKTESFDEAVRAVRGHCRVAAVTRGDKGSVVVTEDETQVVAADEIEQLVDTTGAGDLYAAGFLFGFTQGRDLATCAMLGGIAAGEVISHYGARPERSLKDLVRAKLGPHILENLR

SEQ ID NO: 2726 - protein, 245 aa, Triticum aestivum
  misc_feature (153)..(153): Xaa can be any naturally occurring amino acid
  misc_feature (177)..(177): Xaa can be any naturally occurring amino acid
  misc_feature (182)..(182): Xaa can be any naturally occurring amino acid
  misc_feature (189)..(189): Xaa can be any naturally occurring amino acid
  misc_feature (200)..(200): Xaa can be any naturally occurring amino acid
  misc_feature (209)..(209): Xaa can be any naturally occurring amino acid
  unsure (1)..(245): unsure at all Xaa locations
HAVAKEHFCASPGPSNHKLCYSVDSVVAAEIISTDLSCVVDTLSNEEDDAELDLDSPTEGFSSISEAIEDIRQGKLVIVVDDESRENEGDLILAASLVTPEAMAFIVRHSTGIVCVSMKENDLERLNLPLMVSTKENEEKLCTAFTITVDACXKEGTTTGVSCKDRGKTVMTLASPXSKPEXFNRPGHXFPSEVRDGGVXKRAGHLDHXVDPAGLLGFPPVDYLVKCGLGWSRAPTQVAVLLKNN

SEQ ID NO: 2727 - protein, 256 aa, Myxococcus xanthus DK 1622
MATARRRKIVAGNWKMNKSVPEALALVRDLRGQVASLGDTVEVVVAPPFVALQPLHVALEGAPLALAAQNCHWESSGAFTGEISAPMLAELGCAYVIVGHSERRQLFGDTDEQVNKRAKAVRAAGMTPIICVGETLAEREANQTLAVVERQVRGALEGFGAKEVAGFVLAYEPVWAIGTGRNATAAQAQEVHAAIRGLVERLYDGETAGRVRIQYGGSVKPDNAAELLGQPDVDGALVGGASLKAGDFAAIVKAAT

SEQ ID NO: 2728 - protein, 479 aa, Oryza sativa
MTTEVALLRGPTNLASPTSSTLRYLANGDSDVSLPRRSSREEESPAGLQEEEEEEEEERWSFLALLLELLRKSLLRCSTVQEGGGECGMEIGWPTDVQHVAHVTFDRFHGFLGLPVEFEPEVPRRAPSASASVFGVSTESMQCSYDSRGNSVPTILLMMQRRLYEQGGLRAEGIFRINAENSQEEFVRDQLNSGIVPDGIDIHCLSGLIKAWFRELPSGVLDSIPPEQVMQCQSEEDCARVAKCLPPAEAALLEWAVNLMADVVQEEQINKMNARNIAMVFAPNMTQMSDPLTALMYAVQVMNFLKMLIQKTLKGRQESNLEDTSLPHKDPSDESGHHKPCLTLESLLEEESRRPSFVEEEPILNSPAHGTGYNPIEVNPVQGKTAASIAQTSEVQTIIEGSSSCSRPSLTDPPATADPVCAEAANSLQRKGSRSLNSRRTRKGKGQSGTSATSSAEKSKGTSIVSRINSKIERIEAWR

SEQ ID NO: 2729 - protein, 161 aa, Musa x paradisiaca
SSMMVSSAATVSRASPAQSSMVAPFTGLKSTSAFPVTRKANADLSHLPGNGGRVQCMKVWPIEGKKKFETLSYLPTLVDEALVKQIEYLLRSRWIPCLEFSHEGFVWRENHRSPGYYDGRYWTMWKLPMFGCTDAVQVVKELEECKKEYPKAFIRIIGFDN

SEQ ID NO: 2730 - protein, 161 aa, Musa x paradisiaca
SSMMVSSAATFTRVSPAQSSMVAPFTGLKSASAFPVTRKPNADLSHLPSNGGRVQCMKVWPIEGLKKLETLSYLPTLKDEALLKQIEYLLRSKWIPCLEFSHEGFVGRENHRSPGYYDGRYWTMWKLPMFGCTDAVQVVKEVEECKKEYPKAFIRIIGFDN

SEQ ID NO: 2731 - protein, 110 aa, Glycine max
MAGKEEKEGKLQKGIAEFYDESSGLWENIWGDHMHHGFYDPDSTVSLSDHRLAQIRMIQESLRFASVSEERSKWPKSIVDVGCGIGGSSRYLAKKFGATSVGITLSPVQA

SEQ ID NO: 2732 - protein, 478 aa, Streptomyces avermitilis MA-4680
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 2733 - protein, 468 aa, Pseudomonas fluorescens PfO-1
MNSLNSKDLNGQLAQGFKPRHVTMLSIAGIIGAGLFVGSGHAIAAAGPAVLLAYLFSGLLVVLVMRMLGEMAVAHPDTGSFSTYADQAIGRWAGFTIGWLYWWFWVLVIPIEALAAGHVLNQWFPQVDAWLFALLSIILLVVTNLFSVSKYGEFEFWFAMAKVVAIIGFIGLGFAVLMGWIPGREASGLSRLMEEHGGFAPNGLSAVVGAFITIMFSFIGTEAVTIAAAESSNPAQNIAKATRSVIWRIGVFYLLSIFVVISVVPWNDPLLASVGSYQRALELMNIPNAKFLVDVVVLIAVASCMNSSIYISSRMLFSLGRRGDAPQPLKVTSAAGVPRAAVIASTVIGAGVTLFSYFMPGGLFQFLLASSGAIALLVYLVIAISQLRMRRMLRRQNVELTFRMWLFPWLTWLVIAFICAALAVMMVTPEHRLEVTSTIGLALTISFIGLVTTRQHGQMRAVVSAGKA

SEQ ID NO: 2734 - protein, 289 aa, Cucumis sativus
MGTPEFPNLGKHCNFAECKQIDFLPFTCDCCHQVFCLEHRSYNRHSCPKADRWDVTVVICPLCAKGVRLIPDQDPNITWEIHVNTECDPSNYEKVTKKKKCPVPGCRELLTFSNTIKCRDCSLDHCLKHRFGPDHKCPGPKKLEPTGFPFVGLLNRSRKEEKGPKKALPTTSSSKWTAFLNAASSVKASAEASMTKLSNEFSQTWISSGSSSNGGGGNGQVEQCPQCSAKFSSVSSLIDHVEKVHERGGNRTGPKKVVIDACPKCSRGFVDPVALVEHIERDHGGTSRA

SEQ ID NO: 2735 - protein, 310 aa, Arabidopsis thaliana
MDIDASCSLVLYGKSSVETDTATRLKNNNVLKLPDNSKVSIFLQSEIKNLVRDDDSSFNLSLFMNSISTHRFGRFLIWSPYLSSTHDVVSHNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQLHPDGNSFDFFKGLVRRKL

SEQ ID NO: 2736 - protein, 290 aa, Corynebacterium diphtheriae
MVTMKQHENIIPTITLNDGTEMPAIGFGTYKLREQDAYRAVRSAIEVGYRHIDTASLYKNEEEVGRAVADAITAGEVARDELFITTKVWNDMHGDQLTQRSFQESLHRLGLDYIDCCMVHWPWPQKGLYVESFAALAKIQGLGQLQSVAVANFYPEVLREIVAETGIAPVLNQVELHPGFSQAEQRAVDRELGVVTEAWSPLGRGDSLNAEAITLIAQCYEKTPAQVTLRWIHQLGCSVVPKSANPQRQRENLDIFDFELNTEDMNSITSLDEQGGRLFVDPHDFPGEVE

SEQ ID NO: 2737 - protein, 650 aa, Medicago truncatula
MATLAKLLSSICVCVIVMLTTKAVEATPTYTATHCTNTTTYAPNSTFQTNLDILLYYFSNNISQSNGYFLGITGFNSVNAVGGLFLCRGDVATTVCNQCLTTAIKEIRQHCPNQTEALIWYDECLVHYTNRYFAVDKIDPRVNLNDGNIVSSVDLGRFNQSLHGLLNDLATEASGSSESKKFAAGEVVVTESMTVYGLMQCTNDLTNSECGTCLKNAIGTIPNGKQGARALLPSCNVRYQLYPFFTSSSPSSSGGMKLGPGTIAVVVVVPIFFLIILFLGCYYFKRRSKKKILLPSIMENFGDEFPTLESLQFNLATLEAATNQFSLANKIGSGGFGEVYKGVLLDSRQIAVKKLSKTSGQGTIEFKNEIVLIAKLQHRNLVTLYGFCSEEQEKMLVYEYVLNKSLDYFLFDPHKERVLSWRERYNIIGGIARGIHYLHDQSRLKVIHRDLKPSNILLDKNMNPKISDFGMAKMIDIDEHQGNTKRIAGTYGYMSSEYAMHGHYSEKSDVFSFGVIIIEIISAKRNALSLHSLDFDDLLSYAWKNWRDEKSLEILDSNIEKSYSYIEVIRCIQIGLLCVQQNPDDRPTMERIVSYLSNVSVELPLPQEPGGFMGNRTNQIPRDNISDQRNNSNTTGSSVNDITMNNSFPR

SEQ ID NO: 2738 - protein, 266 aa, Rickettsia rickettsii
MNIGTFKLIVFDKLDSTNSEAMKMAQNAKVDSNYAVLAKSQTNGRGRSGKNWQSRSGNLHVSLLIKPDKELELVPQLSFVTALSVYDSITSLCHSYSSLCHSRFRGNDIRNENNIIQLKWPNDVLINSRKIAGILLESVKVENNYYLIIGIGINISYHPDNIDQPTTSLISENLPPIEPQALLEILIENFEEYYQIWHNNGFPFIRKKWLEHAYKLYENISVKYQNDIVTGLFKDIDNTGRIILQLPSKKIISFSNAELFFSKKYY

SEQ ID NO: 2739 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRFANACGAITTTKKGAIPALPTESEVQSLLKGN

SEQ ID NO: 2740 - protein, 503 aa, Yersinia pestis biovar Medievalis str. 91001
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 2741 - protein, 102 aa, Glycine max
  misc_feature (80)..(80): Xaa can be any naturally occurring amino acid
  unsure (1)..(102): unsure at all Xaa locations
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 2742 - protein, 337 aa, Oryza sativa (japonica cultivar-group)
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 2743 - protein, 686 aa, Myxococcus xanthus DK 1622
MRTHFVRHLLALSLVLATGAQAASQPWRTSPHPESSASGLTGACEDARDFLLGAGSADITGPAAEVGMMGYGMLEQQTTGIHQRLHSRAFVIASPCNGKRVAFVSADLGMVFQAVKQQVVERLRARYGDLYTDDNVLLSATHTHSGPGGYSHYTLYNLTTLGFSPQNFEAIVSGIVASIVRAHERLAEGTLRLSSGELFGASRNRSPNAYLLNPAEERARYAHDVDTRMTLLRLTRADGTDMGLINWFAVHATSMGNGNTLISGDNKGLASYLAEQAQGAGDTFVAAFANANEGDVTPNILGGTHGGGANDFEDTDLSGRKQYDFAAKLWAEAKTPLTGGVDYRHVYVKMDAVDVAPAFADGAPRTTCPAAIGVSMLAGAEDGPGVGVEGVTCAAGQNAWGQFSCSLATTPCQAEKPIVLEMGSMRPFPWTPEVLPLQLVTIGNLALVAVPFELTTMAGRRLRDTVETALAPAGVTDVVIAGLSNAYSGYVATREEYARQDYEGASTHFGPWTLAALQQNFHLLATSLRDGAGVPPGPTPRDLRKEQLSLQPGVVFDDKLLWVDFGEVVTDARPTYSRGDTASATFWGGHPKNDLRLEGTFLRVQRREPDGTWTDVATDADPATRYQWRRENCVPTLACSHVTVTWGIPDDTVPGTYRLVHEGNWKSGWDGNVRPYSGASRTFTVK

SEQ ID NO: 2744 - protein, 326 aa, Thermoanaerobacter tengcongensis MB4
MLRQKLVEILKKNREGFISGQKLSEIMKVSRTAIWKQIKELEKLGYKIQAHRKLGYRLISEPDLLIYEEIAPYLNTKFIGRNYIHKESLSSTNDMAKELAYKVPDGTVIVAEEQTKGRGRMGRSWFSEKSSCILTSVILKPQIRPEKTVALTQVAALTVVKAIEEVCSVKTKIKWPNDIILNSKKVCGILTEMSSEIDVVNYIVIGIGINVNCTEFPDDLKEKATSLQLELEKPVDRKKLLASLLNNLEIYYKEYEEKGFESLRPLILENSITIGKEVRVIYTDREIRGQAIAIDKEGKLVIKTEKGEEIALLSGEVSVRGLLDYI

SEQ ID NO: 2745 - protein, 181 aa, Brassica napus
MAYSMLSSAAVVTSPAQATMVAPFTGLKSSSAFPVTRKANNDITSIVSNGGRVSCMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 2746 - protein, 804 aa, Zea mays
  misc_feature (331)..(331): Xaa can be any naturally occurring amino acid
  misc_feature (355)..(355): Xaa can be any naturally occurring amino acid
  unsure (1)..(804): unsure at all Xaa locations
MEDVLTPPPQPELAGEKRKREESSLDASIEDAPSAPASTCSAEDAAGSDVARHPMWKTSLCSFFRRRGAGAEGCSHGDSCRYAHTEEELRPRPDGTWDPTSDRAKELRKVAAEAQEEAEEEVTVDEQSLDKCLVGLPRGWTADRLKSLLQDQAISTNAQLILVLGFIGQCLGISYATAKKKKGMTVGFVTFQSVEQLTNAVQVLKENPSDGKQIKIVDANRRSHQKAHAGAPVSNTGTATENGSSPTTPAEETSVPESVSSSKKGARDAVTPLAHMTYIDQLEHKKQSMAQILKKLTRNARKACPPTIPHPDWVFKSKEIEQTEQNTGAVXGGLPCKFEGILESPVVNGYRNKCXEGRCPAEAVVSQNAESQISEVMLIVQVCSTSVDEALMKEEFDKLSAALVQGAATCSPPLPLTTIVVQDHKGISNAAPTDCPLIPLLVPKGDKLDGTSEDKTRIHDHISNLKFSISPTAFFQVNTLAAERLYALAGDWANLNSDTLLFDVCCGTGTIGLTLAQRVGMVVGIEMNESAVSDAHRNALINGIKNCRFVCGKAEDVMGPLLTEYLGSPQQQAAASKSNSEIDDTSKTEDMIGCASYDGENIDSSKQRHDNAEGQQPMDTSVDHPTCASEVDGMDVVDCNHDENNVASGEQNCGEASLINGKPIETSSDNSLEQGKTCKDGSSSPNNNVLAANACQFKNVVAIVDPPRVGLHPTWWELSHRVTRYISCNPDSLVANGIELCTPTPEKQEKNKGNRGWRSMSSAGLARQRTKSMPNSEPFIPKRAMAVDLFPHTPHCEMVMLFER

SEQ ID NO: 2747 - protein, 334 aa, Geobacillus kaustophilus HTA426
MDRFKVVVTDYEFQTLAPEQEVLSSLNVEFVATQCRTEEEVISACRDADAIINQYAPISAEVIAQLEKCKIISRYGVGVNTVDVDAATEKGIIVANVTDYSIDEVSDHALALLLSLARKIVKLNHEVKSGTWNFNVGKPIYRLRGRTLGLVGLGRIPQALAKKAQAFGLRVIAYDPYVPAKVADELNVQLLGLNDVFRQSDYISVHAPLTKETKGMISDEQFNLAKKELIIVNTARGPVIDESALIRALQEGKISGAGLDVTECEPIQPDNPLLKMENVVITPHVAWYSEESEKELKRKTAQNVADVLSGYYPTYLVNHNVKEKMRLKEKGLYV

SEQ ID NO: 2748 - protein, 161 aa, Musa x paradisiaca
SSMMVSSAATVSRASPAQSSMVAPFTGLKSASAFPVTRKPNADLSHLPSNGGRVQCMKVWPIEGVRKFETLSYLPTMKDEALLKQIEYLLRSKWIPCLEFCPKGFVWRENHRSPGYYDGRYWTMWKLPMFGCTDAVQVAKEVEECKKEYPHAFIRIIGFDN

SEQ ID NO: 2749 - protein, 456 aa, Colwellia psychrerythraea 34H
MIKVGQTTEVENFLSNHPEVEAIDVLISDLVGFARGKRIEKSSLEKIYSSGLNMPATIFSMNVLGETIEECGLGQDIGEPDMVCKPIANTLHMASWHDRPIAQVLMSMFNHDGTPFFADPRNILSNVVRQLAEINLYPVVAVELEFYLLDKNKDNKGNLQAPISPKTGKRDEHTQVYSVDTLNDYSALLDDINRVCIEQNVPADTAVAECAPGQFEINLKHEADPVAACDNAILLKRIIKTVADKHNFDATFMAKPYSNEAGSGMHVHASLLDECGNNVFADEHNDYNETLEHAIGGMLELMPASMPLLCPNVNSYRRFMPGYYVAMAKNWGVDNRTVALRLPRGHKNATRIEHRVSGADANPYLVMAVILASIHHGITNKIKPINPTVGNAFDDDCEALPLKLDRALAELEKDQILTSYLGEEFTKNYHTVKQKELEQFDMHISELEVKWYLSNS

SEQ ID NO: 2750 - protein, 432 aa, Photobacterium profundum SS9
MSKSADLFAKAQKIIPGGVNSPVRAFAGVGGSPLFIERADGAYIFDADGKAYIDYVGSWGPMILGHNHVAVRDAVIKAAQQGLSFGAPTEMEITMAELVSKLVPSMEQIRMVSSGTEATMSAIRLARGFTNRDKIIKFEGCYHGHADCLLVKAGSGALTLGQPNSPGVPADFAKHTLTCTYNDLETVREAFAAHPEQIACIIVEPVAGNMNCIPPVPGFLEGLRTICDDFGALLILDEVMTGFRVSEGGAQGYYNIKPDLTTLGKIIGGGMPVGAFGGRKDIMQYIAPTGPVYQAGTLSGNPVAMAAGHACLSVLTEEGNEKRLANTTKILANGFKSLADKYNIPLAINQVGGMFGFFFTEQKTVTSYADVTKCDIERFKRFFNLMLKSGVYLAPSAYEACFTSLAHGDKEIEATLNAAERAFATLAKEANA

SEQ ID NO: 2751 - protein, 161 aa, Musa x paradisiaca
SSMMVSSAATVSRASPAQSSMVAPFTGLKSTSAFPVTRKANADLSHLPSNGGRVQCMKVWPIEGKKKFETLSYLPTLVNEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 2752 - protein, 273 aa, Mesorhizobium loti MAFF303099
MAFRLAPTSLSEGFRLEAHDSVGSTNTVALDHARAGDPGRLWVVSKKQESGRGRRGRAWVSPEGNLAATLLVITGGELRLAATLGFVAGLSLADALDAVVPKGRVAVGLDGASQGQNRFELKWPNDVLASGAKLAGILLESAILEGGRFAVAVGIGVNVVAHPKDLPYPATSLQALGATCDAETLFLALSDAWSENARLWDEGRGLSAVRRRWLARAAGLGGEVAVRIDGNVVRGVFETIDEDCRFVIRDDEGTVLTIAAGDVHFGAVASARV

SEQ ID NO: 2753 - protein, 581 aa, Leptospira interrogans serovar Lai str. 56601
MLEYSLDSLHSYIFDSIKARVNMTSKKSTSKKKSPNQLDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 2754 - protein, 278 aa, Actinidia deliciosa
MAAAAFVPIPTDTYKLGFIGAGKMAESIARGVVKSGVLPASRIRTAHLGSARREAFESFGVKVLDRNDQVVEDSDVIIFSVKPQIVKEVVLQLRPLLSEKQLLVSIVAGVKLKELEDWAGHSRFIRVMPNTPAAVGEAASVMSLGATATGEDGELITKLFGAIGKIWKADEKLFDAVTGLSGSGPAYIFLAIEALADGGVAAGLPRELALGLASQTVLGAASMVARGGKHPGQLKDDVASAGGTTIAGIHELEKGGFRGTLMNAVVSATKRSQEIFKR

SEQ ID NO: 2755 - protein, 451 aa, Mycobacterium sp. MCS
MARDAAEVEVMAKQLKEDGVRFSIAAYTDLHGNIKGKMVPIDHFVQMAGGSELFTGAALDGLPQDVSDEELSAHPDLDRGFVLPWRKDIALFLSDLYVGGEPFEASTRNILGRQMKAAEELGFVFNLGVETEFFVLEDGPVGPSALSERDTLEKPCYAVPMLLDNFGWLQELVDYMNELGWDVYSFDHEDAQGQFEIDFAYADGLSMADRVSFFRLMANEVARRHGAYVSFMPKPFADRTGSGAHFNMSLAGLDDGHNVFESADDPRAAGLSDIGYHFAAGIVRHAAAICAVIAPTVNSYKRLVRQGSMSGSTWAPIFASCGNNNRTNMLRIPLGGGRVECRAVDSAANPHLAAALLLAAGLEGVREQLELEHFHTDNLYEVDAGEYEKRGLSLLPRTLEEAVDAFEADPFTKQVCGEKLWQSFIDYKRSEWTSYATAVTDWERDRYLKFF

SEQ ID NO: 2756 - protein, 290 aa, Lactobacillus reuteri
IKKVAWILVRYFDCYWTIIGSGIFFKQGSVLDSAGTSTLAIAAWVFGGIITLTGGLTVAEIGAQMPYTGGLYVYIENLYGRLLGFLAGWMQVIVYGPAIIASVAGFMSILMANFFGLGTQWRIPLAVITVIAIGVMNLFENKVGAIFSIITTAGKMIPIAAIIIFGLFWGHQDAFGQTVTEIHQSTGGFGVAVLATLFGYDGWILIANLGGEMKNPQKLLPRAIILGITAVLIIYTLITVGILKFLPVNTIHRLGENATAYLAVKAFGAIGGKLLSAGIIISMMGTLTGK

SEQ ID NO: 2757 - protein, 434 aa, Chromobacterium violaceum ATCC 12472
MKQPHRQRKTVPSGGRPETETAAAMQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 2758 - protein, 591 aa, Emericella nidulans
MSYAHVKPPSEIHRAWWKESSVYQIWPASFKDSNDDGIGDIPGIISKLDYIRDLGVDIVWLCPSYKSPQVDMGYDIADYYSIADEYGTVADVEKLIKGCHDRGMKLLMDLVVNHTSDKHEWFKKSRSSKDNEFRDWYVWKPPRYDENGNRQPPNNWVSHFQGSAWEFDEATGEYYLHLYAVEQPDLNWENPAVRKAVHDIVRFWLDKGADGFRMDVINFISKDQAFPDAPEQDKDAVWQWGDKYYANGPRLHEYLQGIGKILKEYDTFSVGEMPFVKDTNEVLKAVRYDRNEINMIFNFEHVDIDHGPWGNKFKPGGWKLTDLKAFFERWQVFMYDNGGWNALYWENHDQPRSIDRYVNPPQALRPAAGKMLATILALHAGSPFIYQGQEIGMGNVPIEWGMEEYKDIDCLNHWKGLLETRPTDTEVQKIARQEYRKKSRDNARTPVQWSSEPNAGFTGPNVKPWMSVNPEYTRVNAADQVKDPNSLYHYWASVLHLRKTYLDIFVYGNYELVDRDSQEVYAYTRACHTSKALVLANWTDRGLTWNAAAHKADQFEQVLLDTYESANAAQGRFSGGQWTLRPYEAVVILLK

SEQ ID NO: 2759 - protein, 139 aa, Francisella tularensis subsp. novicida
DEDVFKKLNKIIDTTITPVVCIGESLDDRQSGKLKQVLATQLSLILENLSVEQLAKVVIAYEPVWAIGTGVVASLDQIQETHQFIRSLLAKVDERLAKNIKIVYGGSLKAENAKDILSLPDVDGGLIGGASLKAAEFNE

SEQ ID NO: 2760 - protein, 219 aa, Desulfovibrio desulfuricans G20
MSAKESLLTGTFEERVEAALDALRRGHGVLVTDDEDRENEGDLIFAAETLSDSQMAMLIRECSGIVCLCLTDEKVRALGLPMMVENNSSQYQTAFTVSIEASCGVSTGVSAADRVCTIQAAIADDACPSDLCRPGHVFPLRARPGGVLERRGHTEATVDLMRLAGLKPCGVLCEVTNPDGTMARLPQIVDFGRKHDMVVLTVDDLVRYREMKENKSAAA

SEQ ID NO: 2761 - protein, 250 aa, delta proteobacterium MLMS-1
MRTPLLAGNWKMHLDQAAAAELAAAVANVAAACPEREVMIAPPFTALAAAGQAAGQQVILAAQNVCWEAQGAFTGEIAPPMLRELGCGMALVGHSERRQLFHEDNAMINRRLGGALAHGLVPVLCIGETLAEREADRTMEVLASQLREGLAGISLDDPRRLVVAYEPVWAIGTGKTAGPEQAQQVHRFVRGLLAELYQKNIADGVRILYGGSVNAANVDSIMAQPDVDGALVGGASLDIASFERIIRFQV

SEQ ID NO: 2762 - protein, 270 aa, Dechloromonas aromatica RCB
MKIVFLGGGNMANALIGGMVKQGFSAADIHVIDPGAEALAKLASAYGVNCHASADAAPASPDVLILAVKPQQMKDAVAPLVGKLGKALIISIAAGLDMTALSRWLGGHRQIVRCMPNTPALIGAGITGLCALPEVSTDQRAVADRVLRAVGTTVWIDDEAKIDGVTAISGSGPAYVFLFIEALQQAAADLGFTPEQGRQLAIETVQGAAALAAQSTEPASILRERVTSKGGTTAAALNVMAERGVKEGIVAGCMAAAARGQELGKILGAD

SEQ ID NO: 2763 - protein, 129 aa, Oryza sativa
MSSWAGPDEIFLSTSLAGFLDKKLIVLLRDGRKLLGTLCSFDQFANVVLQGACERVIVGELYCDVPLGLYVIRGENVVLIGELDREKDELPAHMTCVSEAEIRKAEKAEREARDLKGSMRKRMEFLDFD

SEQ ID NO: 2764 - protein, 470 aa, Glycine max
MAVSAITGARLTLGIGLAIPLSSPTRSRTVAMAVSVDPKTDNKLTLTKSEEAFAAAKELMPGGVNSPVRAFKSVGGQPIVIDSVKGSRMWDIDGNEYIDYVGSWGPAIIGHADDQVLSALVETMKKGTSFGAPCLLENTLAELVINAVPSIEMVRFVNSGTEACMGALRLARAYTGREKIIKFEGCYHGHADPFLVKAGSGVATLGLPDSPGVPKAATFETLTAPYNDTAAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTDKFARFFWGMLAEGVYLAPSQFEAGFTSLAHTSDDIKKTIAAAEKVFREI

SEQ ID NO: 2765 - protein, 627 aa, Robiginitalea biformata HTCC2501
MSRKFVFDFDSTLTRVEALDVLAEITLEGREDRDAIIREIQQITNLGIDGDISFTESLERRIRLLGAHRKDLEPLIGMLREKISKSIATNREFFEKFADDIYVISCGFKEFIDPIVREYNIPEERVFANTFEFDEQGRITGFDTANVLASHNGKIECLRALDLEGEVQVIGDGYSDYVMREAGIAHKFFAYTENVHREKAARNADHIAPNLDEFLFVNDLPRNLSYPKNRIKILLLENVHPAAFKNLSEDGFSVELVKHSLPEEELIEKIKGVHVLGIRSKTRVTKKVLDAADKLLIVGAFCIGTTQIELEYARQKGVVVFNAPYSNTRSVVELAIGEIIVLMRSIFPRSTEIHNGEWHKTAANAREIRGKNLGIVGYGNIGKQLSVLAEAMGMRVYYYDVNEQLALGNAVKCDTLEDLLGVSDVVTLHIDDNPANRNFIGERELAQMRTGAYLINLSRGFVVDIPALVGALKSGKLAGAAIDVYPEEPASNGPFETELRNLDNVILTPHIGGSTEEAQRDIADFVPNKIMDYINSGSTVDAVNFPNIRLPKQQNAHRFLHIHKNVPGIMAHINKVLASYDMNIIGQYLSTDPEVGYVITDLDKEYNKAVIKELKAIEHTIKFRVLY

SEQ ID NO: 2766 - protein, 188 aa, Bacillus cereus
SDGGRDVGPQTAKGYIDAANEVIKETGVGQFATVSGRYYSMDRDKRWDRVEKCYSAMVNGEGSTYKSAEECVEDSYANGIYDEFVLPSVIVNEDNTPVATINDDDAVIFYNFRPDRAIQIARVFTNEDFREFDRGEKVPHIPEFVCMTHFSETVNGYVAFKPMNLDNTLGEVVAQAGLKQLRIAATIG

SEQ ID NO: 2767 - protein, 445 aa, Desulfovibrio vulgaris subsp. vulgaris str. Hildenborough
MVKTVNWRDLLEPQTKIRDPLYGYIWVTDDELQIIDTPIFQRLRRVNQLALTKYVYPTAEHSRFVHSLGAMHCATQIFTGILNNTHSYHGIRAIDSANMLRRLRYAALLHDIGHIAFSHAAEKLILNPLQHEHLGQFIIANYSPISSILGEHIKPVISILADSVTQDNRLLHQIISGHLDADRADYLMRDSHACGVKYGEYDFERYMQAFGAINESNELKLFVHERDIFVIESFLVARHHYNMQVPYHRTRMGYDIILGRFLKEFLPKCDDAKLGLTVEEGAYTKVDLQKFEFFDDYSVFNHIKHEARTGNLWANMLLRQGHLCPVYDTTDSVDRGGKVFKKIIRRLKAKNFVEDDDFFQCRKEITASKLISTDEKENSLADTSRETIYVRTKSGKLVDIVKHSNIVRALRPVTIYRIYTSQKRKSEAEAVIADVCRKTQVDRRG

SEQ ID NO: 2768 - protein, 579 aa, Schizosaccharomyces pombe 972h-
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPFVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 2769 - protein, 157 aa, Musa acuminata
VSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 2770 - protein, 319 aa, Ashbya gossypii ATCC 10895
MGKAAKKKYSGISTGKEVPSEQHMNTVFKFNTDLGQHILKNPLVAQGIVDKAQIKPSDIVLEVGPGTGNLTVRILEQARKVVAVEFDPRMAAELTKRVHGTPAEKKLEIMLGDFMKTELPYFDICISNTPYQISSPLVFKLINQPRPPRVSILMFQREFAMRLLARPGDSLYCRLSANVQMWANVTHVMKVGRNNFRPPPQVESSVVRIEIKTPRPPVDFNEWDGLLRIVFVRKNRTISAGFKSTAVLEIMEKNYKAYLATTNDAMVDDAKGSLAEQVKQKIETVLAETGLSDKRAGKCDQTDFLKLLYAFHQVGLHFS

SEQ ID NO: 2771 - protein, 302 aa, Gibberella zeae PH-1
MVLYNGFDSITDVPDLLGKVILVTGGTSGLGRSAITTLAAHNPSHIYFTGRSSSAAESLIKDISPIPSTFLECDLTSIANMHAAAKKFRHDRLDLFIANAGVMAVDGLTKDRLELQFGVNHVGNATLFMALLPIMLKTAEEPNSDVRFVSLTSLGYRGHPKNGIEFDTLQSKQEDMSFGTWGRYGQSKLANIVFAKEIQRRHPKITSVVVHPGVIATGLVTELSFWKRMFVYVTNPRMMTVEQGGLNTVWAATSGDVKKGDEKVAFYEPVGKGNAGDEMCFSQELGKKLWEWTEEKINSTKM

SEQ ID NO: 2772 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDK

SEQ ID NO: 2773 - protein, 370 aa, Methanocaldococcus jannaschii DSM 2661
MLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 2774 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 2775 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 2776 - protein, 331 aa, Aspergillus nidulans FGSC A4
MQSVLQPIIGPKKTAEDLSGRVAIITGGAFGIGYEISRTFVQNGARVIMVNRKEDQGQEAIDKIKEEAGSDAKIEWVPCDMGNLAQIREVASRFVEKEERLDLLILSAGINVHQYGETHDKIERHFQVNWLGQFYLTNLLWPLLRKTAKLPDTPAPRVVFESSEQHRAAPSGVKFGSLEEINNPDLGPLERYGRTKLAIILGVKYGLLEKVIKPNGDNIYALSVHPGAVNTAMQQQWKDAYPGLFGKLLTTVMLAAGRNVEQGSYSALYAAISPEVEEKGWNGYYLKDVGQPGKESSLASDSVLGAALWDLSHRMIRDILGNDAVADWASA

SEQ ID NO: 2777 - protein, 396 aa, Mesorhizobium loti MAFF303099
MAETSVRNFNINFGPQHPAAHGVLRLVLELDGEVVDRVDPHIGLLHRGTEKLIEAKTYLQAVPYLDRLDYCAPMNQEHAFALAAERLLGIEVPKRGQLIRVLYCEIGRIMSHILNVTTQAMDVGALTPPLWGFVEREKLMVFYERASGSRMHAAYFRPGGVHQDLPRQLVEDIGKWIDPFLKSIDDLDRLLTGNRIFKQRNVDIGIVSLADAWAWGFSGVMVRGSGAAWDLRKSQPYECYSEMDFDIPIGKNGDCYDRYLVRMEEMRQSARIMRQCVDLLLGKESTGPVSNLDGKVVPPKRAAMKRSMEALIHHFKLYTEGYRVPAGEVYAAVEAPKGEFGVYLVSDGTNKPYRCKLRAPGFAHLQAMDFLCRGHLLADVTAVLGSLDIVFGEVDR

SEQ ID NO: 2778 - protein, 754 aa, Streptococcus pyogenes MGAS10394
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSISSLGINGEGVGLNYHCGLFKQVFKHNEQEAEPNYWIEDQSWLVPTNISYDVPFKNFTLKSRLDRIDVLGYKRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWMTKVVHNIAKAGFFSSDRTIEQYNEDIWHSR

SEQ ID NO: 2779 - protein, 1034 aa, Flaveria anomala
MERARRLAMLGRLVSQTKHNPSISSPALCSPSRYVSSLSPYVCGGTNVRSDRNLNGFGSQVRTISVEALKPSDTFPRRHNSATPEEQTKMAEFVGFSNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEACKHKMNLRIVDKNTITVAFDETTTIEDVDTLFKVFALGKPVPFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEESQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 2780 - protein, 429 aa, Arabidopsis thaliana
MEEDNQEIQRDNVGSSSFFKTCFNALNALSGIGILSVPYSLARGGWLSLSLLLLLAVTAFYTSLLITKCMNADRNIKTYPDIGERAFGRPGRIIVSVFMHLELYLVTTGFLILEGDNLHNLFPGFTIEMIGLRLNGKQAFMATVAFVIMPTLWWDNLSVLSYVSMSGVLATTVTLGSISWIGAFDGIGFHQKGKLINWSGIPTALSLYAFCYGAHPVLPTLYSSMKSKHQFNNVLLICFILCTIGYTSMAVLGYLMYGSQTLSQITLNLPIHKTSSKVAIYTTLVNPVAKYALMITPTVNTIKDWFPSRYSKKAYLHLLISTFFIISSVVIAETLPFFGYMMSLVGALLSVTVSILLPCLCYLKIFGNYKKIGCETIMLFGMVVMSVFVGVIGTYIAISSSIEVLETFEWLVFYFHQNLSYFSLALHFT

SEQ ID NO: 2781 - protein, 173 aa, Triticum aestivum
  misc_feature (89)..(89): Xaa can be any naturally occurring amino acid
  misc_feature (96)..(96): Xaa can be any naturally occurring amino acid
  unsure (1)..(173): unsure at all Xaa locations
GNVLPGIKVDKGTIELAGTNGETTTQGFDDLGKRCAKYYEAGARFAKWRAVLKIGATEPSQLSIDQNAQGLARYAIICQENGWVPIVGXEILVDGXPHDIDRCAYSPKIVLAACYKASNDQHSSSKGSPEANMVTLGSDPRSGPEVMLIHVAPPKDVLLPSRNVSPGGKTRGT

SEQ ID NO: 2782 - protein, 250 aa, Yersinia pestis biovar Medievalis str. 91001
MATPPLCSHDQESRMSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 2783 - protein, 139 aa, Francisella tularensis subsp. mediasiatica
DEDVFKKLNKIIDTTITPVVCIGESLDDRQSGKLKQVLATQLSLILENLSVEQLAKVVIAYEPVWAIGTGVVASLEQIQETHQFIRSLLAKVDEKLAKNIKIVYGGSLKAENAKDILSLPNVDGGLIGGASLKAVEFNE

SEQ ID NO: 2784 - protein, 296 aa, Oryza sativa
  misc_feature (248)..(248): Xaa can be any naturally occurring amino acid
  unsure (1)..(296): unsure at all Xaa locations
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQEATELGKKARELKKAAEALHQEEKSGKKGRKWRKNVKALGKELVLLEDDMKALEEMYPQGEQXLGTAAFAFFCFYLLIAVIAGEMMLGLKLVFITIHPMKWGGTLMNSFLF

SEQ ID NO: 2785 - protein, 498 aa, Yersinia pestis biovar Medievalis str. 91001
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 2786 - protein, 519 aa, Haloarcula marismortui ATCC 43049
MDAGLIILDGWGLNPDDDVRDAVAAADTPNFDRYRDAGAASTLTTHGRRVGLPEGQMGNSEVGHLNIGAGRVVKQDSARVSDSIARSRGEAPPDDDAQDPPFFENETILSAFEHAEAHGGRVHFMGLVSDGGVHSYQDHLHALIELAGERGTDAVSHAFTDGRDTSPTGGEDYLADLEAHVEEHGTGHVATVCGRYYAMDRDQNWERTRRAYDAIVHREGDHHADEAVTAATESYARDTTDEFIEPTTVGDHAGLEAGDAVVFFNFRSDRARQLTRMLGDIRPEDWGSDTEPPDTRLVTMTQYDETFDLPVAFPPNQPADVLGEVLSEAGKTQIRLAETEKYPHVTYFLNGGREVAFDGESREIVDSPDVATYDLQPEMSAPELADTAIEFIETEDPSAMVLNFANPDMVGHTGDFDAAVTAVEAVDEQLGRLVETIGAAGGHALICADHGNADDMGTEDDPHTAHTTNPVPFIYLSPDGTAGGRTARDGGTLADLAPTMLTLMGIDRPDAMTGTPLVE

SEQ ID NO: 2787 - protein, 321 aa, Yersinia pestis biovar Medievalis str. 91001
MSESKMRLVVTDQAFGNTVYEQAAANAVGADFAAYQCRTEDETRDAVQGADVVLNNFAPMTERVMAAMPPGAVIVRYGVGVDNIDLSAARKRGMRICNVPDYGIEEVADHAAAMTLALARKLGRYEAGIRSGRWEIDQMVDGVRSLRDTTVGLIGLGRIARAYATRMAVFGCRIIGFDPYVTETEARSAGIEPLPQDKVIASAHILSLHVPLTPETRDLIDTTAIARMPEGAILINCARGGLVNEAALIEALTRGHLSGAGLDVFEQEPLPADSALRKAPHLLLSPHAAFFSDASVKKLQQLASEEALRGLRGEPLRCPLT

SEQ ID NO: 2788 - protein, 329 aa, Lactobacillus plantarum WCFS1
MANQVAVLRLLIQAAPAYCSGDWLAQRLAISRTAIWKLVQGLQAAGHTIESRHGRGYRYVANNQLSAPVIEYALTALPPFDLTVLPTVDSTNAYLRRLVTQTPLALPKIVVADTQTAGYGRSGRAFYSPAQTGIYMSIGLPLSDQKALDAGLLTTSTAVVVAQTLQQLFAVDVSLKWVNDVLVNHHKVVGILSEGITSLETGQISAVIIGIGINLTTTAFPALLAHKAGAVVANPNGVTRNQVICELLRRFFNSYGTYRSGTFMDAYRKLSMVIDQQVELKSGTQKYRGVVTDIDAHGALVVKLETGQSRHFSSGEITKVNLLSGGYHG

SEQ ID NO: 2789 - protein, 567 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMKFTNSTLDQGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 2790 - protein, 185 aa, Gossypium barbadense
TPQCTIQGSLTKPADATILRWFDSVWKKRFGESADVDNLYTVDVQRVLQMEDLNEDGVWVTSSDYKNANPDPLRNSAEEIVNEINTNNREDVHRFCNVYVDLDFQVSEAKMIWVDCLGFDLRIYSPQKGVFDVRIPFPREVTDEKGAKSSFNGMSQLAWEVEKNFHAPDFEKVKPLKKIVYSGGR

SEQ ID NO: 2791 - protein, 599 aa, Ashbya gossypii ATCC 10895
MPSAGELEQQPLRGSPSSNVQYISIPIERQSSVTAEAGGHAAAGTPGAHRGSFLDQPLGSFRGVNSLGRFASSFHRSNSFKAIELNAGKERAFLKDGYDELYDPDTLGPSLDGRRLSIAINAPGTVSVRPPASDFYGSVGGGGWRDSTAVVDEDEQSTRLMRVLSNQSLTFVDVNNAAGPDADSIMLKRVETKTGKVVTVLAGQSTAPQTIFNSVNVLIGIGLLALPLGLRYAGWALGIPMLLVFAAGTFCSAELLSRCIDADPSMISYGDLGYAAFGSKGRALISVLFTLDLLGCGVSLIILFGDSLNALFPQYSVTQFKILSFFAVTPQVFLPLSVLSNFSLLGITATLGTVLTILYCGLTKTQSPGSLLDPAPTRVWPASFLEFCLSIGILSACWGGHAVFPNLKSDMRHPSKFKDCLRTTYAITSLTDIGTATVGFLMFGVAVKDEVTRSVMLSDGYPPFVYVLISALMAIIPLAKTPLNARPIISILDVMMGIRNAETELEGHKLFVARALKLTNRLLINVMFVIIAILFPEFDKLIAFLGAGLCFMICLILPCLFYLRICKDRVTPRERMACYATIAVSAVLSVLGVGAAILS

SEQ ID NO: 2792 - protein, 965 aa, Thermus thermophilus
MDPLWYKDAVIYQLHVRSFFDANNDGYGDFEGLRRKLPYLEELGVNILWLMPFFQSPLRDDGYDISDYYQILPVHGTLEDFKRFLDEAHGRGMKVIIELVLNHTSIDHPWFQEARKPGSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVFLPLLWSPQRREGPGLFARTHGQPGYFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGAVEEDLARLAYDVERAVHLALEALEAELWAFAEEVADYLHAAFLQAYRSALPEEALEEAGWTRHMAEVAAEHLHREERPARKRIHERWQAKAGKA

SEQ ID NO: 2793 - protein, 1012 aa, Glycine max
MRVLFLFLFFQFLHFHFPKTLSAPISEYRALLSLRSAITDATPPLLTSWNSSTPYCSWLGVTCDNRRHVTSLDLTGLDLSGPLSADVAHLPFLSNLSLASNKFSGPIPPSLSALSGLRFLNLSNNVFNETFPSELSRLQNLEVLDLYNNNMTGVLPLAVAQMQNLRHLHLGGNFFSGQIPPEYGRWQRLQYLAVSGNELEGTIPPEIGNLSSLRELYIGYYNTYTGGIPPEIGNLSELVRLDAAYCGLSGEIPAALGKLQKLDTLFLQVNALSGSLTPELGNLKSLKSMDLSNNMLSGEIPARFGELKNITLLNLFRNKLHGAIPEFIGELPALEVVQLWENNFTGSIPEGLGKNGRLNLVDLSSNKLTGTLPTYLCSGNTLQTLITLGNFLFGPIPESLGSCESLTRIRMGENFLNGSIPRGLFGLPKLTQVELQDNYLSGEFPEVGSVAVNLGQITLSNNQLSGVLPPSIGNFSSVQKLILDGNMFTGRIPPQIGRLQQLSKIDFSGNKFSGPIVPEISQCKLLTFLDLSRNELSGDIPNEITGMRILNYLNLSRNHLVGGIPSSISSMQSLTSVDFSYNNLSGLVPGTGQFSYFNYTSFLGNPDLCGPYLGACKDGVANGAHQPHVKGLSSSFKLLLVVGLLLCSIAFAVAAIFKARSLKKASGARAWKLTAFQRLDFTVDDVLHCLKEDNIIGKGGAGIVYKGAMPNGDHVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNHEAHVADFGLAKFLQDSGTSECMSAIAGSYGYIAPEYAYTLKVDEKSDVYSFGVVLLELITGRKPVGEFGDGVDIVQWVRKMTDSNKEGVLKVLDPRLPSVPLHEVMHVFYVAMLCVEEQAVERPTMREVVQILTELPKPPDSKEGNLTITESSLSSSNALESPSSASKEDQNPPQSPPPDLLSI

SEQ ID NO: 2794 - protein, 413 aa, Synechococcus sp. WH 5701
MTSLLLDIVVIFTMSAVAVVLCHRFSIPSSIGLLLAGVLAGPDLFRLVQNVHEIELLAEIGVVLLLFVIGLEISLADVARLSRHFLIGGSLQFFGTAALVGAICMGLGLSPGQGVYVGFVVALSSTAIVLRMLQERAELETPHGRTTLAILIYQDVGVVPVMLIAPLLAGVGSASGGGTIAALLGRIALVALVAWLAWRWIVPWLLERITRTRSSEAFLLGVFSLCVGIAMMTQSLGLSLALGAFLAGFILSESEYSHQAVAVMLPFRDVLMSLFFVSIGMLLDIQFMLAHPLSLLLLTLGVVLVKPLVAAGSALVVGLPLGGSVLTGLALAQVGEFSLVATKAGVSTGLLGPDIFQTVLDVAVLSMMLTPALVACGPGLAAWVATTPPCGGWSAAAWCRSAPAAPMASAVTS

SEQ ID NO: 2795 - protein, 473 aa, Magnetococcus sp. MC-1
MANKEAVNKVLGMIDANNVRFVDFRFTDFKGKWQHITAPARMLTEDVFETGLGFDGSSITGWCEINNSDMAYVPDPESAVMDPFSEDATLILACNIIDPFTGEDYSRDPRSVAKRAEAYLAYTGIADTAYVGPEAEFFVFDSVRYNVGMNNVSYHIDSEEGAWNTGTEYEDGNTGHRPGIKGGYFPVPPVDSLQEMRNEMSNLMEEMGLTIEFHHHEVATAGQCEIDMRFGTMLHTADNIQKYKYVVHNVAHQYGKTATFMPKPMAGDNGSGMHCHMSIWKDGKPLFAGNQYADLSEMALHFIGGIKKHAKALNAFTNPSTNSYKRLIPGFEAPVLLAHSSRNRSASIRIPASNSPAGKRCEIRFPDPSANPYLAFAALLMAGMDGVENKIDPGPSMDKNLYDLPPEELKDIPTVCGSLREALEELSKDREFLLKGDVFSNDLIDAYIKMKMDEVYAVEHCPHPIEFQNYYSV

SEQ ID NO: 2796 - protein, 273 aa, Leptospira interrogans serovar Lai str. 56601
MILLGLEVRFLEKEIDMKYTIGIAGCGNMGGAIYFSLKERYPTQVLGYDPYIISNQKIELISSWDEFVSKSDLILVCVKPGKVIELLRQIKVPKKIISVAAGIHIDTILKNLPTGSNVVRVMPNLPLLVSEGAIGFFGDEELYETVSEIFQPLGHSVKLGSETLMDAVTGLSGSGPAYVFKFIQALAEGGVLSGLGYQEALDLSIQTVIGSAQLLRKEREKDPTTHPEVWKNKVTSPGGTTIAGLVELEKNGFSNAVLEAVKAAANRSKELGV

SEQ ID NO: 2797 - protein, 1034 aa, Flaveria trinervia
MERARRLAMLGRLVSQTKHNPSISSSALCSPSRYVSSLSPYVCSGTNVRSDRNLNGFGSQVRTISVEALKPSDTFPRRHNSATPEEQTKMAEFVGFSNLDSLIDATVPKAIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIQAYHMARGDHHRKVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGTVDFNNNVIKGAPHPPQLLMADKWTKPYSREYAAYPAPWLRAAKFWPTTCRVDNVYGDRNLICTLQPPQEYEEKAEATA

SEQ ID NO: 2798 - protein, 161 aa, Musa acuminata
SSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 2799 - protein, 1035 aa, Solanum tuberosum
MERARKLANRAILKRLVSQSKQSRSNEIPSSSLYRPSRYVSSLSPYTFQARNNAKSFNTQQARSISVEALKPSDTFPRRHNSATPEEQTKMAEFCGFQSLDALIDATVPQSIRSESMKLPKFDSGLTESQMIEHMQNLASKNKVFKSYIGMGYYNTYVPPVILRNLLENPAWYTQYTPYQAEISQGRLESLLNYQTMITDLTGLPMSNASLLDEGTAAAEAMAMCNNILKGKKKTFLIASNCHPQTIDICKTRADGFDLKVVTVDLKDIDYKSGDVCGVLVQYPGTEGEILDYGEFIKNAHAHGVKVVMASDLLALTMLKPPGELGADIVVGSAQRFGVPMGYGGPHAAFLATSQEYKRMMPGRIIGLSVDSTGKPALRMAMQTREQHIRRDKATSNICTAQALLANMAAMYAVYHGPEGLKTIGQRVHGLAGTFSAGLKKLGTVEVQDLPFFDTVKVKCSDAKAIADVANKNDINLRIVDNNTITVSFDETTTLEDVDDLFKVFALGKPVPFTAQSIAQEVENLIPSGLTRETPFLTHQIFNSYHTEHELLRYLHKLQSKDLSLCHSMIPLGSCTMKLNATTEMMPVTWPSFANIHPFAPTEQAAGYQEMFDDLGALLCTITGFDSFSLQPNAGAAGEYAGLMVIRAYHMSRGDHHRNVCIIPVSAHGTNPASAAMCGMKIVAVGTDAKGNINIEELRKAAEANKDNLAALMVTYPSTHGVYEEGIDEICKIIHDNGGQVYMDGANMNAQVGLTSPGFIGADVCHLNLHKTFCIPHGGGGPGMGPIGVKKHLAPYLPSHPVVPTGGIPSPDKSEPLGAISAAPWGSALILPISYTYIAMMGSKGLTDASKIAILSANYMAKRLEKHYPVLFRGVNGTCAHEFIIDLRGFKNTAGIEPEDVAKRLIDYGFHGPTMSWPVPGTLMIEPTESESKAELDRFCDALISIREEIAQIEKGNVDINNNVLKGAPHPPSMLMADAWTKPYSREYAAYPAPWLRSAKFWPTTGRVDNVYGDRNLICTLLPVSEMAEEKAATA

SEQ ID NO: 2800 - protein, 471 aa, Thermosynechococcus elongatus BP-1
MATPQEILNLIDSKYELIDLKFTDMPGTWQHLTVHKSQISESSFTEGVPFDGSSIRGWKAINESDMVMVPDPNTAWEDPFMKEPTLSLICTIKDPRTGELYDRCPRSIATRAIEYLKATGIGDTAYFGPEAEFFVFDDVRYDQNQKSGYYYIDSIEGVWNSGREEEGGNLGYKIRGKEGYFPVAPTDTLQDLRTEMLLTMAKCGVPIEKHHHEVATAGQCELGFRFGTLVQAADWLMTYKYCVKNVARKHGKVATFMPKPVFNDNGSGMHTHQSIWKDGQPLFWGDGYANLSQIALWYIGGILKHAPALLAFTNPTTNSYKRLVPGFEAPVNLAYSQGNRSASVRIPLTGPNPKAKRLEFRCPDATSNPYLAFAAMLCAGIDGIKNQIDPGSPLDVDIYDLSPEELAKIPSTPGSLMAALENLQKDHSFLTAGGVFSEDFILNWIQYKLDTEVIPMSLRPHPYEFALYFDA

SEQ ID NO: 2801 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTLKDEALLKQIEYLLRSKWIPCLEFCPKGFVWRENHRSPGYYDGRYWTMWNLPMFGCTDAVQVAKEVEECKKEYPHAFIRIIGFDNNRQVQCVSFIAYKPTGY

SEQ ID NO: 2802 - protein, 337 aa, Zymomonas mobilis
MKAAVITKDHTIEVKDTKLRPLKYGEALLEMEYCGVCHTDLHVKNGDFGDETGRITGHEGIGIVKQVGEGVTSLKAGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 2803 - protein, 180 aa, Musa acuminata
MASSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDNNRQVQCISFIAFKPPGY

SEQ ID NO: 2804 - protein, 415 aa, Hordeum vulgare
MASAPASASAALSTAAPADNGAAKPTEQRPVQVAKRLEKFKTTIFTQMSMLAVKHGAINLGQGFPNFDGPDFVKDAAIEAIKAGKNQYARGYGVPELNSAVAERFLKDSGLHIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFIMVDHTPFGFDNDVEFCEYLIREVGVVAIPPSVFYLNPEDGKNLVRFTFCKDDDTLRAAVDRMKAKLRKK

SEQ ID NO: 2805 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 2806 - protein, 139 aa, Francisella tularensis subsp. novicida
DEDVFKKLNKVIDTTITPIVCIGESLDDRQSGKLKEVLATQLSLILENLTVEQLAKVVIAYEPVWAIGTGVVASLEQIQETHQFIRSLLAKVDERLAKSIKIVYGGSLKAENAKDILSLPDVDGGLIGGASLKATEFNE

SEQ ID NO: 2807 - protein, 152 aa, Arabidopsis thaliana
MEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 2808 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 2809 - protein, 1072 aa, Frankia sp. CcI3
MPDVTQYDDTPYADGPATAADGPATTATTATISPASSHARSGAPRQGSAAAVGRNGARRLPAAAIPRFADRHIGPDPSSQREMLDALRVESLAALTDAAVPASIRDHDLDLPAALSEPAVLAALRAFGSRNRPVSSMIGLGFHPAVMPGVIQRNVLENPAWYTAYTPYQPEISQGRLEALLNFQTMITDLTGLAVAGASLLDEPTAAAEAMQIAFRTAKGSRATFLIDADTLPQTVSVVATRAEALGINVVVADLAAGLTAVGPAQLDAAFGLLLSYPGPAGVLRDVRAVIASARERGIVVTIAADPLALTLLRAPGDLGADIAVGSTQRFGLPLSFGGPHAGYLAVRKGLERSLPGRLVGVSVDADGAPAYRLTLQTREQHIRREKATSNICTAQVLPAVLASMYAVYHGPEGLAGIARRIHGHAVRLAEGLRAAGVTVVHDAFFDTVLAAVPGRATQVVADALARGVNLRLVDDDHVGISCNETTGQAELEAVRSAFGVGPEATAGITWTGTGTGTEIRTGAWTGSVAAANDHLVARADQADQADQADQAADEPVALPAELVRTDPYLQHPVFHDHRSETAMLRYLRRLSDLDLALDRGMIPLGSCTMKLNATTEMAAVTWPEFADIHPFAPLDQAAGYLAMIQDLERWLAQITGYAGVSLQPNAGSQGELAGLLAIRAYHRDHAVPGSVVRNICLIPSSAHGTNAASAAMAGMRVVVVSCDDDGNVDLNDLARKARANADALAALMVTYPSTHGVYEEGIGQACAIVHEAGGLVYVDGANLNALVGLARPGQFGADVSHLNLHKTFCIPHGGGGPGVGPVAVVEKLLPYLPNHPLRPEAGPATGVGPISGSPWGSAGILMIPWAYIRMMGADGLRRATSVAVLNANYIAHRLHPYYPVLYAGRDGLVAHECILDLRPLTKLTGVTVDDVAKRLIDYGFHAPTMSFPVAGTLMVEPTESEDLGEIDRFCDAMISIRAEADKVGDGIWPRTDNPLHNAPHTAQMVTANEWSHAYPRSVAAYPVASLRAAKYWPPVRRIDGAYGDRNLVCTCPPVGSFAAEPVDEQILAGAR

SEQ ID NO: 2810 - protein, 347 aa, Lactobacillus plantarum WCFS1
MKSTIFEKAGLVSVQEVDKPTLQSDDDVIVRIVRTCVCGSDLWSYAHGDDKAAHSINEGHEAIGIVEAIGSAITTVKPGDFVITPFTHGCGECAACLAGFDGTCDRHPGHTNWSNGFQAEYIRFTYGNWALVKIPGQPSDYTEGMLKSLLTLADVMPTGYHAARCANVQKGDKVVVIGDGAVGQCAVIAAKLRGAAQIVLMSRHEDRQQMALASGATAVVAERGDEGIAKVREILGGGADAALECVGTEAAIDQALGVLHNGGRVGYVGVPHYNNRPLGSTFAQNIAVAGGSASVTTYDKQFLLKAVLDGNINPGRVFTQTYPLADINQAYQDMQNRKTIKAMITID

SEQ ID NO: 2811 - protein, 427 aa, Dechloromonas aromatica RCB
MTSRNQQLFERAQRHIPGGVNSPVRAFRSVGGTPCFFQKGVGAKVQDADGKWYTDYVGSWGPMILGHAHPDVIAAVQAAVVDGLSFGAPTEKEVDIADLLCELVPSMDMVRLVSSGTEATMSAIRLARGHTGRDVLIKFEGCYHGHSDGLLVKAGSGLLTFGNPSSSGVPAGTAETTMVLTYNDPQELADAFAKHGDKIAAVIVEPVVGNMNLIAPTQAFLNAMRDLCTKNGSVLIFDEVMTGFRVGLKSAQGLFGITPDLSTFGKVVGGGMPLGAFGGKREIMEKIAPLGPVYQAGTLSGNPIATAAGLATLKLIQAPGFYEALTAKTKALCDGLVAAAKKHGVAFSAQNIGGMFGLYFAEQCPGTYDEVLACDKEAFNRFFHAMLDAGHYFAPSAFEAGFVSAAHSDADIAGTIAAADAYFASLK

SEQ ID NO: 2812 - protein, 283 aa, Methanococcoides burtonii DSM 6242
MQGNDLSMEEIEDLGYYDFMSYLGVPYFHVGGLTSTKRLAELCQINKASKVLMVGCSTGFSACFVAERFGCSVVGVDIAEISIRKAKGRAKSLGLGDGVEFHIGDAYDLPFEPGTYDVVITEFVAQFLDMDKAFREFVRVLKPGGMVGINEMYRDADIPPAIEEDIQEAERIFGELTQLPFSISSPEEWEQRLERAGLSEVHVYRHHLSVSLKELKLVIRAMGGLGKFTQLSLGLMSGMARYALSSKKIRNRFKQISRGKRILLNKRSTSKYVGYVLGVGKKV

SEQ ID NO: 2813 - protein, 971 aa, Myxococcus xanthus DK 1622
MSLNWKYQEPFAGRHNGPDDTELKQLLSALGVDSLDAFIDQAVPPAIRAKEPLKLATARGEHELLAALESIAAKNQVFRSFIGMGYHDTHTPNVILRNVFQNPGWYTQYTPYQAEIAQGRLEALLNFQTLVMDLTGLEVANASLLDEGTAAAEAMALALAVHQKGEESGAAFFVSDGCHPQTVEVVRTRAQPLGVEVVVGDHRTVDLSSKKFVGALVQYPTTDGAVHDYRAFGEQVHAAGGLFVVAADLLSLTLLTPPGEFGADVAVGSAQRFGVPMGYGGPHAGYFATKNAYTRVMPGRIIGVSEDAQGRRALRMALQTREQHIRREKATSNICTAQVLLAVIASMYAVYHGPSGLKAIAERVHGLTVLLARGLAKLGLKLKNDQYFDTLRVELSAAHVRAVLGAAEAARMNFRRIDEKTLGVSLDETTRPADVEDILAAFATGTGKSSAPVLADLVGDGVESAVSQALRRSSAYLTHPVFNSYHSETEMLRYIRRLEAKDLSLTHSMIPLGSCTMKLNATAEMIPVTWPQFGRLHPFAPTSQAAGYKVIFEQLEQMLTQVTGFAGCSLQPNAGSQGEYAGLLVIRAYHQSRGQGHRDVCLIPSSAHGTNPASAVMAGYKVVVTKCDENGNIDLDDLRAKAEAHKDALAALMVTYPSTHGVFEEEIREICAIVHERGGQVYMDGANLNAQVGLTSPGLVGADVCHINLHKTFCIPHGGGGPGMGPICVASHLVKFLPGHPVIQTGGSEAIGAISAAPWGSASILLISWMYIAMMGGEGLTQATKLAILNANYVAERLNAHYPVLYRGKRGKVAHECIVDLRPLKKTAGVEVEDVAKRLMDYGFHAPTVSFPVAGTLMIEPTESESKAELDRFCDAMIAIRQEIRDIEEGRMPKDNNVLKHAPHTARVVAAPEWNRPYSREQAVFPTPWVRDNKFWPSVGRLNSVLGDRKLVCSCPPIEDYMTPEPKAATA

SEQ ID NO: 2814 - protein, 257 aa, Neisseria gonorrhoeae FA 1090
MYRQIGMWDQKWVIGNWKMNGRLQNNNALMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEERETGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 2815 - protein, 254 aa, Leptospira interrogans serovar Lai str. 56601
MAMQNVLLQPEKGIFLDSVTSTNTVIKGKEFPHGTWIVAEEQTAGRGRKDRTWEVFGEESLIFSGKIGLENFDAGPGLSLFIGTAVCKTILSVYPELTREIKIKWPNDLYRGNKKVAGILIESEIEGSFMTLIIGVGLNLYGKNESIPNHLTDAGFLNTNPNRAGKKNEILEKLVPFLNESILLWKDIEGRKKELILLNELLLWKGQSVRYKENGQLQTGILEGLSENGSLILKTPSGTRLDFIDSPEDFHSLN

SEQ ID NO: 2816 - protein, 703 aa, Glycine max
MDGYEATRIVFSRIQNLDPENASKIMGVLLLQDHGEKEMIRLAFGPEALVHSVILKARKELGLPSNSPPTPSTPPSPSPFLSRQNSTSSRLSGINIPPALTIPNPSSWPTMSDDLMSPNHLVVGSSTSSSSLPYYANGGSDPIDDFQLQDQLSFLNDGSPTSTAFAHKTNPDLFYPTNNSDLSSSPTTAVDPTLFPSYGWGGSIHRRSCSVNDACLGSEDPSSGLGWKPCLYFARGYCKNGTSCRFLHGGIGDADGGGAAAMVGSPGKIEMMEQCHELLRSKSVQQQRLAAASQLMASSTFPYSPKSMNFLLQQQQNDTQRAAAAALMMSEDLHKFGRSRLERNDFSLNSPGMVNPASRQIYLTFPADSTFREEDVSNYFSIYGPVQDVRIPYQQKRMFGFVTFVYPETVKLILSKGNPHFVCDARVLVKPYKEKGKVPDKYRKLQQQQVDRGDFSPCGTPTGLDARDQFDLQLGGRMFYNTQDMLWRRKLEEQADLQQALELQSRRLMGLQLLDIKKHHQRALCTGSPIPSPTHSPNMFNQNLVPSFHITSEAPKESGSTSAPASTASVSAGQQPVNISVGKEVVVNGENGYKEGNGKQSSSHDDCDLQECLEHNLPDSPFASPTKGDGDFLVAFSNGPNEANDADASAASANSKFGTSTLLPAASALDMGTFKSFNCQIPRFSSGHGTIGMFAGTGGPIGI

SEQ ID NO: 2817 - protein, 477 aa, Pyrococcus furiosus DSM 3638
MRRVKLPSHKTKIVATIGPATNSRKMIKQLIKAGMNVARINFSHGSFEEHARVIEIIREEAQKLDRRVAILADLPGLKIRVGEIKGGYVELKRGEKVILTTKDVEGDETTIPVDYKGFPNLVSKGDIIYLNDGYIVLKVENVRENEVEAVVLSGGKLFSRKGVNIPKAYLPVEAITPKDFEIMKFAIEHGVDAIGLSFVGSVYDVLKAKSFLEKNNAEDVFVIAKIERPDAVRNFDEILNAADGIMIARGDLGVEMPIEQLPILQKKLIRKANMEGKPVITATQMLVSMTTEKVPTRAEVTDVANAILDGTDAVMLSEETAIGKFPIETVEMMGKIAKVTEEYRESFGLSRIREFMEIKKGTIKEAITRSIIDAICTIDIKFILTPTRTGRTARLISRFKPKQWILAFSTNERVCNNLMFSYGVYPFCLEEGFDENDIVRLIKGLGLVESDDMVLMTEGKPIEKTVGTNSIKIFQIA

SEQ ID NO: 2818 - protein, 399 aa, Trichodesmium erythraeum IMS101
MKTDMRLGVKTNTEYSNRTFVYEVEGLRQSQTAGELNNPIRRSGTVYITVPYSRMNQEMRRITGMGGKILSIKTLNEHSEANSQKTKTKQKTKPMTEAKPRRSEKKSVPVNTYRPKNPFIGKCLSTAELVNEGGEGTVRHLVFDLSGSDLHYLEGQSIGIIPPGKDAKGKAHKLRLYSIASTRHGDHLNDQTVSLCVRRLEYNHPETGERIYGVCSSYLCGMEEGADVAITGPVGKEMLLPDDEDATIIMIATGTGIAPYRAFLWRMFKEREQNPDYQFKGLAWLFFGCPYTPNILYKEELEELQREFPDNFRLTYAISREQKNKDGGKMYIQHRIQENAEELWQLIQKPNAHTYICGLKGMEDGIDEGMSAVTGQFDIDWGDYQKKLKKEGRWHVETY

SEQ ID NO: 2819 - protein, 181 aa, Musa acuminata
MASSVMVSSAAAVVSRASPAQSSMVAPFTGLKSTSAFPVTRKANADLSHLPSNGGRVQCMKVWPIEGKKKFETLSYLPTLVDEVLLKQIEYLLRSKWIPCLEFSHEGFVWRENHRSPGYYDGRYWTMWKLPMFGCTDATQVAKELEECKKEYPRAFVGIIGFDNNRQVQCISFIAHKPDGH

SEQ ID NO: 2820 - protein, 4499 aa, Chlamydomonas reinhardtii
MSIFWEVPNAQGEAPCPRSGHSFTVLGERFVLFGGCGRKDGKAAAFNDLYELDTSDPDEYKWKELVVANAPPPRARHAAIALDDKRLLVFGGLNKRIRYNDVWLFNYDDKSWTCMEVEGAAPEPRAHFTATRFGSRVFIFGGYGGSGQVYNEMWVLHFGEDGFRWQNITESIEGTGPAPRFDHSAFIYPVTPNSDTYDKLLIMGGRDLSQMYQDSHMLDLNKMAWENETQPPTLPYEICNNVCDGIESVPYHKVFSFGGRKGMMQYLNTVEVMDCGTQMWSTPPVDHGVAPVGREDTAWVFDVKTCSLLIFGGWANRWLGDLHKLNVSPIIGPPYACTAIQPEMGPVFGSTELVIRGLRFRDGKVQVKFGLSEKNEVVVEGTYVDQETIRVQTPNYEQFGALTVDVRVSINGEGWTVNKIKYAYFANTAARNCIAYGPGLLAETISGVEVPFIIQAKDTLNDKRTSGGDVFKVTVVSADGKNEGVSRVRDLQNGQYEVQYAAPTAGPYLIHVAFNELGTSDFVPIRGSPFTVKCTDSWTKHRVMGAAPAKRKGATICTMGNELVLYGGDKSGVTVLNTEGAEWRWSPATVSGSTPPDRTAHSTVVLSDGELVVFGGINLADQNDLNDIYYLRKQGEGWVWSCPSESRPYIRHPKGAAAVSAEPSAEPAAEPAAEPAAEPDADAPAAEPAAEGEEGAVPAEGEEGAEGATGSRPVSAKPAPAAAAPAAEALPELPVSARNSHVAVAIDKDLYVMMGDHDGDLMTELAMVDTSDRTCAHWLEPILKGDVPVPRKACAAAATGNTIVLFGGQTQNADGEATVTGDLVIMEVTGPNSIQCAVNPAAPGASGSPAARYGAVMQEFSNGKLFLHGGMDAASKPLNDGWLFDVPSKTWQCVYVGSSDVVLPTGQLATLSGNRIVLVSAAVGSPKLDSVQSLDFQELRDQAGVHAKMRASTETLLKGLEDWVDTQAHGMELARSPEKLSKDFENGLRKVMDALFQVKSQRSQTDLLIDQLHEAFAQLAEEKVPGINKMEKRLEAAAHKWDEIKKAQPQVKTDVEPIQAAKGEDIKKEIETFAAKVRNYRADFRRRGFFKYATGFDGAYPLLDAAAHELAELKKECDRLSELASVFEFPQAIEPVTVAIKETVEDLVMVKDVWDTAVLCELQFQDWRQTLWSDIRTDIMEEGAKQFVKEVKSLHKKVRDEDVFRGVDQVVKNFLVSVPLVADLRSPAMRDRHWEQLMATTKMTFNVKDPNFKLDDLLALELHKFEEEVGEIVDRAQKEEKMEIAIRKLNDTWTRVEFQFHRHKDYDVHTVKMAEEDFEALEDNQVQVQGMIANRYMATFKDEILGWQKKLNDVADVNQIMAEIQRTWAYLESLFIHSEEVKKELPQATERFAAIDTEVKKVLREFQQLKNCVSCCNREGLYANLETQERELEICKKALNDYMESKRRAFPRFYFVSSADLLDILSNGNNPMRVQIHMNKCFQAIDNVRLDSEEVVPGRRPKALGMESCVGIEYVPFSSLPLENKVEQYMNDIIAKMRNDVRMVLKASVEDYPSKPRDKWLFDWPSQIILVVNQIYWCLEVEQAFTEMARGDKGAMSKYNEFQVKQLTKLIEVTRTDLSKPDRQKIMNMITIDAHSRDMVLAGADQPDSFQWVSQLRSYWDRDISDCRIRICDASFPYGYEYLGNGPRLVITPLTDRIYITATQACWLSLGTAPAGPAGTGKTETTKDLSAQLGKSVYVFNCSPEMDYRTMGDIFKGLAASGSWGCFDEFNRLVPEVLSVCSVQYKCVTDSQKKKTMLPGRGLEYIKDGVKHPAVEHWSFIAADGVEMPLEEGTSAFITMNPGYIGRAELPESLKALFRPITVMVPDRQLIMENMLMAEGFVEAKMLAKKFASLYYLLEDLLSPQKHYDWGLRAIKSVLVVAGSLLRAEAGQVEADVLFRALRDFNIPKILAQDMVIFMGLLNDLFPGIDPPRKRDMEFEDVIVSTIKDLGLTPEDDFVLRVVQFSELLAIRHCVFLMGPTGTGRTECYRVLAKAITKGCNNPVNDYLKMTNKKKVVIRDINPKSISTYELYGQVNQATREWKDGLLSYYMRDVANMPGDDPKWLLLDGDLDANWIESMNSVMDDNRLLTLPSNERIRVLPHMKLIFEIRDLKFATPATATRAGILYISEGQQWHNMAMSWINRVVKPYAERAKWKDPQLPCTWLREMFDKYIPPTLLEMKKSYSHITPLAQMNFISTLVNIMEGVLKPENLSNKADQAMFEMYFVFAMIWAFGGGLVEKDGIPYRRNFDKWFKQTWTTVKIPGKGTVYDYFVNPKTQKFQPWAELVTDIDYDGSRPMSTVFVPTAETSSLRFFLDMMVDLRKPIMFVGGAGVGKTQLVKGKLGSLNEEQISLSISFNYFTDVVSFQKVLESPLEKQPAGINYGPPGTKQLIYFVDDLNMPKLDLYETAMPISLIRQHLGWGHWFDRAKLTPKNINNTQYVACMNPTAGSFIINPRLQRLFMTLAVDFPGQDSLMKIYGTFLQGHLKKFSESIQDMGTKILQAALALHDRVSQTFRKTAINFHYEFTVRHLANVFQGLLMSTPEAFNSPTKWGKLWLHESERVYADRLVSLYDLDAYNKAATAIAKKYFSVADIDDYYKKKDPKPLIFCHFARGLADKAYDEVADYTSLYKTLTEALNEYNETNAAMDLVLFEDAMKHVCRISRIVSNPSGHALLVGVGGSGKQSLARLAAHICGYATQMIVISGSYSMNNFKEDIQKMYKRTGVKGEGVMFLFTDSQIVDERMLVYINDLLSSGEIPDLFPQEDRDEIVNALRSETKSLGLLDTAENCWATFIQKVKTNLHMVFTASPVGENFRVRSQRFLATVTSTVIDWFQPWPESSLFSVAKRFLDEVDLGEDAVANAVVEFMPYSFQLVNKVSIKFREQERRYNYTTPKTFLELIKLYKNVLAAKRKANQDNTERLENGLHKLHKVQADVDILVEEAKVKAVEVEHKVASANIFAEQVGVEKEKVNAENAAAQVEAEKCAVIAKEVSEKQASCEKDLAAAEPLVAEAMAALETVTKKDLGEAKSLKKPPPGVDDITAVVIILLENNPKDKSWQAAQKLMNNVDKFLERVKSFKSVIDAGQVARKTVDACRPYLALEWFNREAIGKKSAAAAGLCEWAVNIIKYYDVVQEVEPKRQELAAANAKLEEANVTLAAVEEKVALLNAKVQELEQQYKEANDDKEAAIRESERCQRKLELANRLINALASEGERWALTVEQLRKSYEVLTGDMLLAAAFVSYAGPFTAKFRAHVIDDWILFLRERHMPMTEGITDPLKVLVDDALVAGWIREGLPSDPTSVQNGTILTNSERWSLMMDPQLQGILWIKERESKNNLQVTRMGASNMLQVMERAIEAGHSVLVENMGETIDAVLNPIITRSTFKKGRSLYVKLGDKECEYNKNFRLFLHTKLSNPHYPPEIQAETTLINFTVTEAGLEDQLLALVVNKERPDLEETKTQLIIQNTEFTIKLKELEDGLLLKLSTAEGDITEDVALIESLEDAKRVSTEISEKVKESRETEAAINENRNKYRTVAARGAMLFFLLNSLNKIHAFYQFSLNAFVTVFSRGLDLAPGGRKKGKGLKKTPSLRDQPMDHQSLMEKARRSSGVGDRRPSQEGLPGPEASQASLAESQGGRGSQVGDAEDEDDESFAMAPEALEQRLVNLLETCTFTVYNYTRRGLFDRDKLIVLSLLTFTILLRSQAVDASEYEALCRGMRNPTPPPITDDLSRWMAESQWAALDVLTTLPCFAHLAKDMEKNSDDWFNWCNNEAAERAPMPGEWGKLTEFRQLLIIRALRPDRITNALQNFCEHMMGSDYVNQDAFSPAAMMDESSSATPIFFILFPGYSPSKEIEVYANKCGYSVANGRLCLISMGQGQEAPAEAVLDKYTREGGWVFLDNVHLMQGWIPKLERKLEIAAESAHPDFRCFFSAEPINGAPHANIIPESILQTCIKISNEPPSDMKSNMRRAFAAFTPEQCDRPSTPAKRVAFRAILFGLCFYHSLLLGRKKFGVGIGTGSGSGLGFCRGYSFNIGDLTTCGDVLYNYLEAYEQIPWRDLQYMFGEVFYGGHITDSMDRRCCTTYLEVLIRNEILPKGNPDEVEAWEAPTLELAPGFFAPKPVDYPTLKEYIETSLPAESPVVYGMHPNAELSLLTSLGETLFKTVVEVAGGGGGGGGGGGGGENAVRQALETFKERLPEPFNMVEVELRVKEKTPFVVVALQEATRMNALLSEMKRSMEELQLGLDGALNMSDNMEKLAKGIASNTVPELWMSCMSTRVQEVYTLTAWYQDVVKRHDQLSAWTAGDIITPHSVWLPGLFNPKAFLTAVMQTFARANKLPLDVMKFMTEVTRMTSPEQVTEAAPLGVYVHGLVLEGARWDREDGCLRDSKPNELHPAMPVLQVKPVTADQFNLEGYYECPVYTNMQRANVYSPVVSTFTLRTQDMPAKWVLASVALLLQDDLAG

SEQ ID NO: 2821 - protein, 465 aa, Haemophilus influenzae R2846
MGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 2822 - protein, 297 aa, Magnaporthe grisea 70-15
MGLELVRTLAKTGMRVFFTARDPAKGAKVREMLRAEDASFKLELVVVELKSLKSVEAGARHILDRADRLDLLMNNAGIAATPHGFTQDGYEQQFGVNYLAHFYLFQMLKPLLLKTAAEHGVQVRVVSTSSTAHTASTVLPAGDYGTADPNGRGYEPGVSYAHSSTARIWFCNEAERRYGPRGLHAISTHPGGFASGLMDSADEQARAALARAIEMPHIRRIWKSVEQGAATNALAGVGREYDGHGGFYMEDCGVARPVPDHLDWAGHGYKSWAFDEAGEKRLWLDSLEMLGLQDDQE

SEQ ID NO: 2823 - protein, 545 aa, Alkalilimnicola ehrlichei MLHE-1
MRRLAFPDLPMDTLRKVALPAHALAPAGTPPHPQGHQETNGGPRGPRLAPPDAPDQTGRCPEDLEPMNTLHSPADDQPPVHRHAIILAGGSGTRLWPLSRSTMPKQLLALDGDESLLQQTARRLLPLVSADRVTTVTHQDHRFEVMGQLHAVAPALADQVLAEPAGRNTLPAIAWAVAAIVRHDPEAVVGVFSSDHVINRVEDFHRAWRAAEPAAEAGHLVLFGIRPTEPATGYGYIQAARPLMEGVEEVSRFVEKPDRATAERFLEEGGYYWNGGMFVFRADRFMDLLARHQPALAEAVTAMAAAGAPPTAEAYAELPNTSIDYGLVEHADRVAVVPAELGWNDLGSWEALYQQRSKDPDGNVCQGTVLAEDSRNNLLWSDDSGLIAAYGVEDLALVQTRDATLVCPRSRLAELKQMVARVREEHRELTETHLTVARPWGSYTTLEEGHRYKIKRIVVKPGGQLSLQMHYHRSEHWVVIAGTARIVNGEETIYLEENQSTYIPKTRPHRLENPGRIPLQIIEIQTGPYLQEDDIVRFEDTYGRR

SEQ ID NO: 2824 - protein, 124 aa, Zea mays
  misc_feature (82)..(82): Xaa can be any naturally occurring amino acid
  misc_feature (90)..(90): Xaa can be any naturally occurring amino acid
  misc_feature (109)..(109): Xaa can be any naturally occurring amino acid
  unsure (1)..(124): unsure at all Xaa locations
FPSCLCEKGLFPHDVRSTHVSRRLKAIANRIIGEGACRSCSEYCHMCHKHRRDQKELKCHCMRETHQRNMHVLGMSTDRVVXGFSKEFLXSFLSFIRHADRHSRLTATXVYNKYIVDRYHVHMN

SEQ ID NO: 2825 - protein, 406 aa, Xanthomonas oryzae pv. oryzae KACC10331
MCPRSWWFIIETMDSRLPYAGGYSRRSQDIAPFHVMSLLARANALEQAGHDVIHLEIGEPDFTTAAPIVAAGQAALAAGHTRYTAARGLPALREAIAGFYAQRYACNVDPERILITPGGSGALLLASSLLVDPGKHWLLADPGYPCNRHFLRLVEGAAQLVPVGADTDYQLTPALVETCWNSDSVGALVASPANPTGSVLSRSQLAALSQTLHARGGHLVVDEIYHGLTYGLDAHSVLEVDDSAFLLSSFSKYFGMTGWRLGWLIAPPDAVPELEKLAQNLYISASTIAQHAALACFTPESIAIFEARRAEFQQRRDYLLPALRALGFDIAVEPQGAFYLYANISGFSNDAQAFCAHFLETEHVAFTPGIDFGHSRANQHVRIAYTQSLPRLQQAVTRIARGLSRL

SEQ ID NO: 2826 - protein, 954 aa, Thermosynechococcus elongatus BP-1
MMVSSPPQLEINLETDAEFVARHIGITPSDLPKMLSLLGYGSLKELINAVIPPEIRLQRPLALSEGLSETAALQKLRTLAQQNQVWRSYIGMGYYNCITPSVIQRNILENPGWYTQYTPYQAEIAQGRLEALLNFQTLVSDLTGLAIANASLLDEATAAAEAMTLSFNACRQRGANRFLVAQDCHPQTLAVLRTRALPLGIQIVPIDPIAGELPWENAFGLLLQYPASDGAVRSPQALIAAAHERGLLVTVATDLLALTLLRPPGELGADIAVGSSQRFGVPLGYGGPHAAFFATREDFKRQLPGRLVGVSHDALGQRALRLALQTREQHIRREKATSNICTAQVLLAVVASMYAVYHGPDGLRQIAERIHQRTVRLAAGLEAAGYQLYYSEFFDTLRIGLGNLPVPVLKERAAAARINLRYFDDGSAGISLDETTTEKDVADLLALFGARPAEVEGGDRLPAALKRQSPYLQHPVFQDYHSEHALLRYIHRLQAKDLSLTTSMIPLGSCTMKLNATAEMLPISWPEFNQLHPFAPQEQAQGYQALFRELAAMLAEITGFDAISLQPNAGSQGEYAGLLVIRQYHHSRGESQRNVCLIPTSAHGTNPASAVMAGMQVVAVNCDAQGNIDVADLAAKAETYGDRLAALMITYPSTHGVFETGICQICDIIHRYGGQVYMDGANMNAQVGLCRPGDFGADVCHLNLHKTFCIPHGGGGPGVGPIGVKAHLAPFLPTTQVIPQGSETGPVTAAPWGSASILPISWMYITLMGGVGLTRATAIAILNANYIAKRLEPYYPVLYKGAHGLVAHECILDLRPLKKSAGIEVEDIAKRLMDYGFHAPTVSWPVPGTLMIEPTESETKAELDRFCEAMIAIRSEIAEIEAGVSDRQQNPLKNAPHPALMLATEPWPYPYSREVAAYPAPWLREYKFWPAVARIDNAYGDRHLVCTCSMPLTN

SEQ ID NO: 2827 - protein, 698 aa, Oryza sativa
  misc_feature (21)..(21): Xaa can be any naturally occurring amino acid
  unsure (1)..(698): unsure at all Xaa locations
MCRGSVLLLRVHAALLLLAAXLPALIAGQPWEICGENGNYTANSTYQANLKQLAAVLHKNVSSGTWLVACLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGGKRRNGAGKVLAIVMPIVAAILAVTVIGFCFWRRRRPEKTPPPGPLRSASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 2828 - protein, 306 aa, Medicago truncatula
MESNGRYVAQRYAVVTGANKGIGLEIVKQLAFLGVTVVLTARNDTRGRDAITKLHQTGLSNVMFHQLDVLDALSIESLAKFIQHKFGRLDILINNAGASCVEVDKEGLKALNVDPATWLAGKVSNTLLQGVLTQTYKKAEECLNTNYYGVKRVTMALLPLLQLSPAKARIVNLSSLRGELKRIPNERLRNELGDVDELSEGKIDAMVKKFLHDFKANDHEANGWGMMLPAYSISKASLNAYTRVLAKKNPHMLINCVHPGFVSTDFNWHKGTMTVDEGARGPVMLSLLPADGPTGCYFDCTEIAEF

SEQ ID NO: 2829 - protein, 1067 aa, Oryza sativa
MLRRCNQHRLSTLSPSSRKILISRPSAAFTALPRTPIASNNLQNSVRTLATGLSQTSKHVPTTSIFAPLDTFTRRHVGPQPASVQKMLEYLGYESMDAFLKDCVPQDIRLEENAIRDEGAGGIWALSEGELLRRAKEIGKKNKVTRSFIGLGYHQAVLPQVILRNMLENHGWFSQYSPYQAEISQGRLGSLINFQTLTTALTGLDIANASLLDEGTAAAEGMIMAFGHLREKRKTFFVDRSVLPQTVAVVKTRVAPFGINVVVGNVKKLLSEEHGDKAQHKDLIGVLLQYPDVRGEVADWKAVADRTHKLGGLVSCATDFLALTMLKPPGEWGADIAFGNAARFGVPLGYGGPHAAFFACSDALKRRMPGRLIGLSKDKEGRPAYRLALQTREQHIRRDKATSNICTAQALLANTSAMYAVYHGPEGLRAIAEKVHGLARIVKAAVEKLGHKVVNETFFDNLTIRRSGTAATLVHESAVAAGINLRRVDDQHVAVSFDESHSLEDIVDLLNVFVSNQKGPRRINQIQPYTTESLVEFADSLNVPAPRATRSSLGELSSGENIPAIDSPAIPSDLARTSPFLTQPVWNSHHSETDIIRYMHYLQDKDLSLVHAPIPLGSCTMKLNSTTSMTPFTWDEFSRIHPFAPEDQALGYKEMMDELAQDLSLLTGLPGCSLQPNSGAQGEYAGLSVIRAYHLSRGEGHRNICLVPASAHGTNPASAIMAGMKVVPVKVLATGYLDMEDLKAKATQHSKDLAAFMVTYPSTFGVFESGVEDACSIIHENGGQVYLDGANFNAMVGLTSPGKVGADVCHLNLHKTFAIPHGGGGPGMGPICVGEHLIPFLPGHPVVPTGGSDAIGPISASPYGSASILSISWAYIKMLGATGLKFATQVALLNANYAMARLQDHYRVKFVNNKGRCAHEFIIDLAEFEDTAGLKVMDIAKRLQDYGIHPPTCSWPLSTAMLIEPTESEGLRDVDRFCDAMIKIRQEIEDIAQGKQPRGNNLIVNAPHPQQVVTADTWDRPYTREEAAYPDARLRRAKFWPPTSRVDDAYGDKNLFCECGSVDEYAS

SEQ ID NO: 2830 - protein, 139 aa, Francisella tularensis subsp. holarctica
DEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNE

SEQ ID NO: 2831 - protein, 909 aa, Oryza sativa (indica cultivar-group)
MTTNTKRAYKLRILANSFPVFLTSIFCIFFREEFVAHSSNVNCLKIGRKTSRVLVTGGDDHKVNLWAIGKPNSILSLSGHTSAVESVNFDSTEVFVAAGAASGTIKLWDLEEAKIVRTLTGHRSNCMSVDFHPFGEFFASGSLDTNLKIWDIRRKGCIHTYKGHTRGVNAIRFTPDGRWVVSGGEDNVVKLWDLTAGKLLHDFKCHEGQIQCIDFHPHEFLLATGSSDKTVKFWDLETFELIGSTGPETTGVRSMTFNPDGRSLLCGLHESLKVFSWEPIRCHDTVDVGWSRLSDLNVHEGKLLGCSFNQSCVGIWVVDLTRLEPYATGTSTKLNGHSELKSSSSSTMPLQNDSGSRANIGRLSVLQNSENNIKSSTGRLSVSQNSDSALKETKSTTSSGLVPVTPQRAGNGSSTKTVGNSTFASSGTNLKRGSLKSNNSSSLQNFSKIDVVPVIIPRTSSGPELATDSRSDAADVGPVLSKSGRRIEIANDSRKESSDVAAAVVPRTNSRTEMASDSAPVVGPRANLRMEVSADSAPIVPKSGRRLESSVESRKESTDVASAAAPKTSSRMEVAPDSAPLLSKAGRRVESATDSRKESADVAPVVPRTTSRMEMAPDSRREISAGRMSPFRVQSRYSELRKLNNAKADADKVDAGSKNSEADDFTCQIYLPRRNGVVQSGISEETREDAKPGVIDRMGFPSSAEPNTHRNVSRMRKPRDNCYIEVSRAALAYTWKRGSSQAAETPTISSDEDVLSVLMEQHELFLSSTRSRLTKLQIVHQMWQRNDIRGIIAAMEKMSDHAVSADVASVLMEKSETITLDLCTVILPVLTDLLESKTDRHLGVSLELLVKLVRTFGSVIHSTVSAGPSSVGVDLQAEQRRERCNLCFIELEKVKNKLPFLSSAYELSG

SEQ ID NO: 2832 - protein, 139 aa, Francisella tularensis subsp. mediasiatica
DEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNE

SEQ ID NO: 2833 - protein, 543 aa, Lactobacillus plantarum WCFS1
MSINSETLVNHMNHEIAAIQPSDILAFNAEIANIPGIVRLTLGEPDFNTPEHVKQAAIESIEADESHYAPSNGTLALRTAAAEFLAAKYDVHYDPASEVIITAGATGGIYTALTSILNPGDEVLIPTPIFPLYIAIVKLSGATPVFMDTSDNGFVLSPDQLQTTLAAHPKTKAVVLNFPSNPTGVTYRHDDLKALAAVLADQPIFVLSDEIYSELTYGEPHESIANYLPTQTILLNGVSKSHAMTGWRIGIMCAPKAITAQLGKIHQFTVTSTTTNAQAAAAGLKQLTSRTAGVDTIDIPAAKAAGLVVTNVPAYSPNSVAEMSVAQTMRLIRNLEMFDQRISQQNFQWAGLQAREIRSLTVGIIGAGRIGGTAARLFHGLGAKVIAYDVVRHPELEDVLTYVDTKEDLLRQADVVDLHVDLNETSAGLIDAAALKLMKTDAYLINASRGPVIVTDDLVAALKAGEIAGCALDTVEGENALFNQNHQGEVLQDTNVAQLMQMPNVIITPHVGFYTNLAVKNMVDISLDDVLAILNGETTAHAF

SEQ ID NO: 2834 - protein, 389 aa, Nostoc punctiforme PCC 73102
MKAVCWNGANDVRVQSVPDPTILNPRDAIIKITSTAICGSDLHIYGGYIPTVQQGDIIGHEFMGEVVEVGRGVNNLKIGDRVVVPSTIGCGNCHYCQHDMWSLCDNSNPKGWIEEKLFGNITSAIYGYSHMLGGYAGAQAEYIRVPFADVGVVKVPPDLPDEMLLFISDAIPTGYMGAELCDIQPGDTVAVWGCGAVGQFAMISAYMMGAEKVIAIDRFPERLEMAKKFAKAEVINYEEVNAGEALKEMTGGRGPDACIDAVGLEAHGVGLEDFYDQTKQKLRLETDRPHVLREMMVACRKGGTLSIMGVYGGFVDKIPFGAAFNKGLTFRMGQMHGQKYMHLLLQMILDGKLDPSFVVTHQLPLEQAPHAYHIFQQKKDNCIKVVLKP

SEQ ID NO: 2835 - protein, 213 aa, Candidatus Blochmannia floridanus
MRQNVLFEFGTPIVRVLNALDALSNGRGILVVDDENRENEGDMIFAAENMTVKQMALAIRYGSGIVCLCLTEEKCRQLKLPMMVKNNSNHYKTAFTVTIEASKGITTGVSAKDRLTTIKTSIEDYAKPSDLNRPGHVFPLRAHNGGVLSRSGHTEAAVDLTTLAGLKPFGVICEVTNEDGSMARTTEIIKFSKQYDMPVLTISDVIAYRMSNL

SEQ ID NO: 2836 - protein, 99 aa, Zea mays
MAWRASLSRSVKEIRVLFCQSSPASAAAREFVKKNYGDIKARNPALPFLVRECSGVQPQLWARYDMGVERCVNLDGLTEAQIDKKLEELAKAGESLKTK

SEQ ID NO: 2837 - protein, 148 aa, Azoarcus sp. EbN1
MSKLHVIRTLLLDVKKIVTRLKAEGHTLTDTHRKVHRPWGWYDSIDAGDRFQVKRIVVKPGASLSLQRHHHRAEHWVVVSGTAEITNGDKVLLLSENESTYIPLGHVHRLSNPGKMPLEIIEVQSGSYLGEDDIVRFEDTYGRAPAGG

SEQ ID NO: 2838 - protein, 181 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 2839 - protein, 247 aa, Ashbya gossypii ATCC 10895
MPKLVLVRHGQSEWNEENLFTGWVDVKLSAVGEQEAARAGELLKEHNVNPDILFTSKLTRAIQTANIALTKADRIWIPVERSWRLNERHYGDLQGKDKAATLAAFGEEKFNTYRRSFDVPPPPIADDSEFSQSNDERYRDVDPNVLPKTESLALVIDRLLPYWQDTISKELLSGKTVMITAHGNSLRGLVKHLEGISDADIAKLNIPTGIPLVFELDENLKPTKPSYYLDPEAAAAGAAAVANQGKK

SEQ ID NO: 2840 - protein, 184 aa, Zea mays
  misc_feature (147)..(147): Xaa can be any naturally occurring amino acid
  misc_feature (175)..(175): Xaa can be any naturally occurring amino acid
  unsure (1)..(184): unsure at all Xaa locations
MASSSASLLKASPVKSDWVKGQSLLIRQPSSVAAIRSNAAPSALTVRAASYADELVKTAKTIASPGRGILAMDESNATCGKRLASIGLENTEANRQAYRTLLVSAPGLGQYISGAILFEETLYQSTVDGKKMVDVLVDQNIVPGIKXDKGLVPLVGSNDESWCQGLHGLASRTAXYYPTGARFG

SEQ ID NO: 2841 - protein, 339 aa, Campylobacter jejuni RM1221
MKFVSVEQAIKDLQAGKMLVMVDAEDRENEGDLIFPAQFSTQEKVNFMIKEARGVVCVALDETLAKKFELPLMVPKNTSNHETAFTITVDAKDATTGVSAYERNMTIQIFADDNAKASDFVRPGHINPLIAKKGGVLERTGHTEGTVDLCKLAGLKGACVICEIVKDNGDMARREDLEIFCQKHDLNMIAVSDLIEYRLKHESLIKLEEKSQSVLAGFKAEKFIFSDHNQTQHIAFCFKDIKKCENVKFHISGSDFELLTSDKFSKLLEQIKFLSENGGVIVFMQGEKSSTTQYKNYGIGAQILRYFGIEEIKLLSQSCDKDYIGLEGFGLNLKACNFN

SEQ ID NO: 2842 - protein, 345 aa, Zea mays
  misc_feature (224)..(224): Xaa can be any naturally occurring amino acid
  unsure (1)..(345): unsure at all Xaa locations
MSKSGALDLASGLGGKINKVEVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGISGTCDFVKADFMKMPFDDNTFDAVYAIEATCHAPDPVGCYKEIYRVLKPGQCFAVYEWCITDHYDPNNATPQRIKXDEFELGNGLPDIRSTRQPLKAVKDAGFEVVCYKDLAEDSPLPWYLPLDPSRFSLSSFRLTSVGRMITRTMVKALEYVGLAPQGSERVSNFLEKAAEGLVEGGKKEIFTPMYFFLVRKPLLE

SEQ ID NO: 2843 - protein, 473 aa, Gloeobacter violaceus PCC 7421
MQPLDRRTKVVATIGPASSSPEVLRQLVKAGINVARLNFSHGSYEDHARMVKLLREVSEELDTPITLLQDLQGPKIRVGQMPEGGLALGEGDELTLLPVAEFAGEPGTVSIDYPYLVEEATPGTQVLLDDGLLEFAVVEVKGNAVRCRVVRGGVLKSRKGVNLPSLDLRLPSMTEKDKQDLEFGLEQGVDWVSLSFVRRGEDIRVLKGLLAEHGAADVPVIAKIEKPQAIANLEEILDEVQGIMVARGDLGVEMSPEKVPLLQKRIIRLCNRRGIPVITATQMLDSMIRNPRPTRAEASDVANAILDGSDAVMLSGESAVGDFPVQSVEMLVRIAKEVEREFTFDNNPPAKSDEIHALCESLGTIDKILALHCIATFTTTGFSASIAAAERPKAPVVAFTPDLKVYHRLNLVWGVKPLLLEHPAAELEKLIEQMESCLVERNLAAPGDRMLVLGGSPVQRAGGTNFLKIHTLH

SEQ ID NO: 2844 - protein, 448 aa, Thermoplasma acidophilum
MAAMPEDLVSKTLKRIEEDKVEFLQMQFTDIIGNVKSLTVPKNRFENALTEGVVFDGSSVAGYAQIEESDMRAIPNLESYTLLPDEFGKNKIARFVCSVYSPDGTRFPGDPRYVLERILDQVHKEGNEFFVGPEFEFFLFKRDEHGNPTTEPSDYGGYFDNTPLDSASDIRQQIMKELYDLGYQPEAAHHEVAYGQQEVDLRYAPALKMADRIVMLKSIIKNIAERNGLYASFMPKPINGVNGSGMHIHQSIMSADEKTNRFYDKNAKYGLSDYAMHYLGGILKYINEASAVLASTVNSYKRLIPGYEAPVYISWANKNRSALVRIPAGEGVRKRMELRCPDPAGNPYLQFAVVLGMGLEGIKNRIEPPEPVEKDIFHMTPEERQAEGIMSMPESLGEALHHLRSSKLMRNVLGDHVYENFITVKQREWDQFRSYVGEWEIKRYLPTL

SEQ ID NO: 2845 - protein, 464 aa, Fusobacterium nucleatum subsp. nucleatum ATCC 25586
MMRSSTLKLRNKMLKVSDIIQIKIDKIVFGGEGLGYYNGFAVFVPMSIPEDELEIEIISIKKTYARGLIKNIIKASPERIDNHKFTFEDFYGCDFAMLKYESQLKYKRFMVEEVIRKIAGLSDIEISDVLASEDIYNYRNKIIEPFSVYANKIITGFFKRKSHEVFEVDENILNSKLGNKIIKELKEILNKNKISVYDENTHKGILRNIMIRTNSNNEAMVVLIINSNKITENIKKLLFKLRENIEEIKSIYISLNSKKTNTVIGEKNILIYGEKSIKENINRIEFHISPTSFFQINVKQAKRLYDIAISFFDNIDNKYIVDAYSGTGTIGMIIAKKAKKVYAIEIVKSASEDGEKTAKENGIENIEFINGAVEKELVKLVNNNQKIDTIIFDPPRKGLETSIIDKVAELNLKEVVYISCNPSTFARDVKLFSEKGYVLKKLQAVDMFPQTSHIECVGLIERKI

SEQ ID NO: 2846 - protein, 343 aa, Gloeobacter violaceus PCC 7421
MSAVKIAINGFGRIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFKVVSWYDNEWGYSCRVNDLIVAMAHKEKPADS

SEQ ID NO: 2847 - protein, 161 aa, Musa acuminata
SSMMVSSAATVSRASPAQSSMVAPFTGLKSTSAFRVTRKANADLSHLPSNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 2848 - protein, 399 aa, Arabidopsis thaliana
MSGTFHLTSDYVPGYTLSDSRCFFNSAVSRRTLAILPCSSCLDHKNGRLKSVPNRSSFVCRASSGGYRRNPDFSRLNKHGYRGNNRQSGGREDFDIENSDMLSSRNGPLFNLSSSPKFQATSSPGPREKEIVELFRKVQAQLRARAAAKKEEKKIEEASKGQGKESETVDSLLKLLRKHSGEQSKRQVSKFSSQGEVQGDTVDKQDRTGNLVTSGNKDNNASSFTRPTSSFRRKSPVPRSQSPPAYSSEATFDQSSSYSVTWTQKKDTVELHDEPEHEPAYEHEHEPENESEPGPVTTMLEPDSELKPESSSFYQEEEDDDVTFDVLSQDDGILDVLSDDDESLDDADEDSDEAEEEAVKDLSELKLVELRGIAKSRGLKGLSKMKKAELVELLGSDSS

SEQ ID NO: 2849 - protein, 255 aa, Solanum chacoense
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 2850 - protein, 494 aa, Corynebacterium diphtheriae
MTHTTQTLDDRIHELLQRIPTELFIAGQFQPAHNGATLSVTNPSDGSELATVASASEKEARAALDAAEKAQPTWAATPARERSEILRRAYDLVIEHKDDLAMIQSLELGRALPDSEAEVTYAAEFFRWFAEEAVRIRGDYRHNPTGNARIITHQQPVGPCLAITPWNFPLAMGARKLAPALAAGCTMILKPASKTPLTMLYLAQLLAEAGVPHGVVSVLPTANASVVSDLLHDARIRKLTFTGSTAVGQKLAAMAAEHSAAVSLELGGNAPYIVLDDADIDTAAQAVAVAKMRGAGQVCIAANRFLVHSSIAEEFTQRVVNIMRGFTQGPATAPGVDFGALSGDDQVSTVTTLVDDALSRGATKLLGDLPKGLPEHGSYYPATVLVDVPEDADIHCEEIFGPVVVISTFDDDDEAVARANDTKFGLAAYVFGSDLQRVLNVAERVDAGMIAVNKGALSDPAAPFGGVKESGLGREGGFEGIGEFLETKLISLPL

SEQ ID NO: 2851 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 2852 - protein, 454 aa, Pseudomonas fluorescens PfO-1
MTQTNGPKRHLPVFQALLITLGMVITTDILKTAPTVALNVGPEHFYWVWVLGGLASMAGALCFAEMATAFPHPGGDYHFLRTAYGERMGFLFAWSRFSVMHTGWIALSAFMFADYFNAVVPLGHYGSGLFAGAIIAALVLLNLTGKHIGFMTQTVLVGLLALGFLSIASAGVWLAWQGFEPTLPSDPVVPEHTGAAGFSAAMIFVFLAFGGWSDAATLSAEVRDGRRGIFIAMLGALTVLMAIYLALNWAFVQGLGFEGLAASNAPAVELLNRAFGAPGVLLILLMVGIAAIATINSTLLVGARTTYAAARDVAQLRRFGEWDERDGVPRKALLAEGAVALLLVLFGSFTQSGFNTMVEYLTPVYWLFLSLSSLALIILRRRFPEVPRPVRVPLYPVLPLVFFGLCVYMLYSSVTVVGFGAFLGIGVLLVGAFLLAGLSCLVSTPRQALQRSVD

SEQ ID NO: 2853 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTHQRNPQEALDQSLQRLGLDYVGLYLVHWPVPLRTENIKDGNLFQFAEKPDGSKDVDLEWNFIKTWELMQKLLESGKTKAIGVSNFSVNNLKDLLAAPTTKVTPAVNQVEFHPLLPQEELIQYCSEKGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 2854 - protein, 354 aa, Oryza sativa (japonica cultivar-group)
MGGGGVGGGAGAAGVGVGGRMPTWRERENNKRRERRRRAIAAKIFAGLRAHGGYKLPKHCDNNEVLKALCNEAGWVVEPDGTTYRKGYKPPERMEVIGCSVSPSPCSSYQPSPRASYNASPTSSSFPSGASSPFLPHPNNMANGVDGNPILPWLKTLSNSPSSKKHPQLPPLLIHGGSISAPVTPPLSSPTARTPRMKTDWDESNVQPTWTGSNSPCVVNSTPPSPGRTMLPDPAWLAGIQISSTSPSSPTFSLVSSNPFSVFKDAILVGNNSSRMCTPGQSGTCSPAIPGMAPHPDIHMMDAVSDEFAFGSSTNGGHQAAGLVRAWEGERIHEDSGSDDLELTLGSSRTRAAA

SEQ ID NO: 2855 - protein, 389 aa, Nostoc punctiforme PCC 73102
MKAVCWHGANDVRVETVPDPKILNPRDAIVKITSTAICGSDLHIYDGYIPTMQKGDILGHEFMGEVVELGSAVKNVNVGDRVVVPFTISCGSCFFCNRDLWSLCDNSNPNAWLVKKQMGHSPAGLFGYSHLFGGYAGGQAEYARVPFADVGLFKIPDGLTDEQVLFLTDIFPTGYMAAENCNIKPGDIVAVWGCGPVGQFAIKSAYMLGAERVIAFDRIPERLQMAKEYGKAEVLNYEEVNIGEALKEMTGGRGPDACIDAVGMEAHGTDFMAFYDQVKQAVRLETDRPTALRQVIVSAAKGGHVSLVGVYGGFLDKIPMGAAMNKGLTFKMGQTNVHKYLKPLLEHIQNGEIDPTFIITHTLPLEQAPHGYEIFKHKKDNCIKVVLKP

SEQ ID NO: 2856 - protein, 747 aa, Medicago truncatula
MAQRPIITVLGLVCFWSWMQSTYGEYLIGVGSYDMTGPAADVNMMGYANIEQNTAGIHFRLRARTFIVAENLQGPRFVFVNLDAGMASQLLTIKLLERLKSRFGNLYTEENVAISGIHTHAGPGGYLQYVVYSVTSLGFVTQSFDAIANAVEQSIIQAHNNLKPGSIFINTGDVKEASINRSPSAYLLNPAEERSRYPSNVDTQMTLLKFVDSASGKSKGSFSWFATHGTSMSNNNKLISGDNKGVAARLFEDWFTSQNKSSSPNSNSTELDIGELVQIAQLIKATGGKDCNEKSSQASKVRKNDGSLFVGAFCQSNVGDVSPNVLGAFCIDSGKPCDFNHSSCNGNDLLCVGRGPGYPNEILSTKIIGERQFRSAVELFGSASEELTGKIDYRHVYLNFTNIEVELDNKKVVKTCPAALGPGFAAGTTDGPGVFGFQQGDPEISPFWKNVRDFLKEPSQYQVDCQNPKPVLLSSGEMFDPYPWAPAILPIQILRLGKLIILSVPGEFTTMAGRRLREAVKETLISNSNGEFNNETHVVIAGLTNTYSQYIATFEEYHQQRYEAASTLYGPHTLSAYIQEFNKLAQAMAKGDKIYGNGTSPPDLLSVQKSFLLDPFGDTTPDGIKLGDIKEDIAFPGSGYFTKGDKPSATFWSANPRYDLLTEGTYAVVERLQGERWISVQDDDDLSLFFRWKVDNTSFHGFAAIEWEIPTDAISGVYRLKHFGASKKTIVSPINYFTGASSAFAVQ

SEQ ID NO: 2857 - protein, 443 aa, Lactobacillus plantarum WCFS1
MQETKQATTLNRSLGFWSALSLVVGTVIGSGIFFKQSSVLDSAGSPSAALLAWLLGGLITLTAGLTIAQVGAQMPHTGGLYVYMEQIYGKLWGFLSGWMQIAVYGPAIIASISAYLGILLVGFFNLQAGWQAPLSIGVIVLIGILNMFENRWGAAFQIATTLGKLLPIAAIIIFGLFYGNQNALGQSLHTITQSTGSFGVAVLATLFAYDGWILVANLGGEIKNPQKLLPQAIILGISMVLIAYTLVSYGILHFVPAATIHKLGQQTTLYFAQAAFGTIGGRLLNIGIIISMVGCLNGKIMTFPRIVYAMAAQNQLPFAKQLSYLHKKSHEPIAATIAILVYASIMILFFNPDRLSDLCIFTVYCFYVATFVGVFILRKRRPASERPFSTPGFPITPLIAILGALFVIISEIGSDLSGVLISLVIVAVGFPIYYWKQQQNQNA

SEQ ID NO: 2858 - protein, 599 aa, Debaryomyces hansenii CBS767
MQFPEEDTAIDETTSLVRSRRPTHSILDAPLGSFKGPNSLHNFASSFTRAQSFAASKIDNDIRKKRSFFYNDDNDQHDSVVEDELFDPELMVPSARGERLSVVLHDVIHKNLILSGTDLNMSPNNDVFYQDDIINALNLSKSRKNSTYTGGAMPIHISKRKSFPSPSFSSIRSSISMATTASRFNLTKIEDKEGNIVTVLEGQSTAPQTIFNSINVLIGVGLLALPVGILKAGWVIGVPLLACCGLTTYWSATLLSKAMDTDKTIMTYADLGYAAYGSMAKLFISLVFSMDLLGAGVSLIVLFSDSLYALLGDEVVWTKTKFKLISFFVLTPFTFLPLPILSIFSLFGIISTISITLLVLVCGFLKPDSPGSLISIMPTNMWPQSIPDLLLAIGILMAPFGGHAIFPNLKSDMRHPHKFTGTLSTTYSITLVTDLSMGILGFLMFGAYCNNEITNNLLLTSGYPVWCYPLLSGLICLIPLAKTPLNAKPIISTLDILFSFDKLSGNSFRRFINSFGKLVIRIGVNAVFVGLAILFPEFDRVIGILGSSICFLVCIILPCLFYLKLCNNSVQAFEKAIVSIVIFISIILAFVGTWAVLNF

SEQ ID NO: 2859 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYHNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 2860 - protein, 225 aa, Zea mays
MEVLCIGTADTKFEELLFLAAQLRSALAASGSDSKVQVSIVDVSTTEKTTANDFKDIIFIPRNTILSCHLGVDQHNLPDNRGEAIALMSKALQSFLKKRYDSGMLVGAVGLGGSGGTALIAPALRLLPLGVPKLIVSTVASGHTTPYVETSDLVLFPSVVDICGINSVSRVILSNAAAAFAGMVHGILSASNESDETSTKPTVGITMFGVTTPCVNAVKDRLNKE

SEQ ID NO: 2861 - protein, 107 aa, Dechloromonas aromatica RCB
MKQVRAQQLAEWLADEARPKPVLLDVREPWELELCQLEGSQHIPMHLVPTRCDEIDSTQDVVVICHHGGRSMQVAMFLERKGFGAVYNLMGGVEAWAGEVDPTMRRY

SEQ ID NO: 2862 - protein, 149 aa, Zea mays
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKTQTP

SEQ ID NO: 2863 - protein, 135 aa, Arabidopsis thaliana
  misc_feature (79)..(79): Xaa can be any naturally occurring amino acid
  misc_feature (90)..(90): Xaa can be any naturally occurring amino acid
  misc_feature (92)..(92): Xaa can be any naturally occurring amino acid
  misc_feature (102)..(103): Xaa can be any naturally occurring amino acid
  misc_feature (109)..(109): Xaa can be any naturally occurring amino acid
  misc_feature (112)..(112): Xaa can be any naturally occurring amino acid
  misc_feature (115)..(116): Xaa can be any naturally occurring amino acid
  misc_feature (119)..(119): Xaa can be any naturally occurring amino acid
  misc_feature (121)..(122): Xaa can be any naturally occurring amino acid
  misc_feature (128)..(133): Xaa can be any naturally occurring amino acid
  unsure (1)..(135): unsure at all Xaa locations
MASSMLSSTAVVTSPAQATMVAPFTGLKSSASFPVTRKANNDITSITSNGGRVSCMKVWPPIGKKKFETLSYLPDLSDXVNLVKEVDLPXSXTKWVPCVEFXXGHGFFXPLXTGXXPGXLXXGRVLGXXXXXXFF

SEQ ID NO: 2864 - protein, 596 aa, Saccharophagus degradans 2-40
MGKRFKISEQPMISLQKELRFLVETHLRFIYDEQSYPDLDHAQLARKLIKIVELDEQCLKPAVHESLWDEQDVLVITYGDSIKKEGEPPLDTLNNFFNKHLADTVNGVHILPFFPYSSDDGFSVIDYTQVNDGLGDWGDIEEIASNFDLMADLVVNHCSSRSRWFDNFKQCKEPGKNYFFECDPSADTSDVVRPRTSPLLREVETLEGKKYVWCTFSHDQVDLNFANPDVLCEMIQIIKLYLDRGVKIFRMDAVAFVWKELGTPCIHHPKTHELVRLMRTLIEHHSPRAIIITETNVPNHENLSYFGNANEAHAVYNFSLPPLLLNALITGSSAHLKAWQMSMPPAQEGTFYFNFIASHDGIGLRPAEGLLQDQEIDTLINTMQSFGARISWRAAQGGLNKAYEINVTLFDALQGTTKGPDKWQIQRFLCAHGIMLALEGIPAIYIHSLVATNNYQEGVELTASNRTINRYKWDADELETQLATEHTHHAKVFEQLKRLISIRRGQQAFHPNATQFTLHLGDQLFGFWRQSIRRDQSIFCIYNVTDDTVTIPLSSINLISLNKWVDLVSGQEYTDLHLDLVLEPYQFVWLTNKIAC

SEQ ID NO: 2865 - protein, 816 aa, Pseudomonas syringae pv. tomato str. DC3000
MSQEPLVRDADVAAFRAAVLAKLTYSVGKDPDHAFEHDWFEAVALAARDHMVEHWMDHTRQIYRKVQKRVYYLSLEFLIGRLLYDSLSNLGLLEVAREALTELGVDIERIRLLEPDAALGNGGLGRLAACFMESMSTLGIAGHGYGIRYEHGLFRQGIVDGWQQEQTENWLDFGNPWEFERPEVVYSIGFSGSVDTVVTEAGESRQVWRPGETVRAIAYDTPVVGWRGKSVNTLRLWRARAVEDLHLERFNAGDHFGAVAEVVRAESISRVLYPNDATEAGQELRLRQEYFFVSASLQDLLRRHLNQHATLTDLADHAAIQMNDTHPSIAVAELMRQLIDNHNIAWDTAWKITVGTLGYTNHTLLPEALETWSVGLMERMLPRHMQIIYLINAQHIDTLRAKGVDDVNVLRAVSLIEEDNGRRVRMGNLAFLGSHSVNGVSALHTQLMRKTVFAELHKIYPDRINNKTNGITFRRWLFQANPKLTEMLVESLGEDVLDNAETRLKELEPFAEKSSFRKQMADQRLHSKRALAAIIHERLGIAVNPAAMFDVQVKRIHEYKRQLLNLFHTVALYQAIRAEPGTDWVPRVKIFAGKAAASYHSAKLIIKLTNDIARTVNNDPTVRGLLKVVFMPNYNVSLAESIIPAADLSEQISTAGLEASGTSNMKFGLNGALTIGTLDGANVEMSEQVGLEHMFIFGMTSQQVEARKQAGEFSAHADVEASGRLNDVLQAIRGGVFSPDDPNRYVGLIDQLLAYDRFLVCADFDSYWAAQAKVEERWHDSKEWWRSAVLNTARMGWFSSDRTIREYAGDIWKALD

SEQ ID NO: 2866 - protein, 327 aa, Mycobacterium avium subsp. paratuberculosis K-10
MTSKPRALVTAPLRGPGLDKLRVLAEVVYDPWIEQRPLRIYSAEQLAERIAAEEAEIVVVVESDSVRGPVFELGVRAIAATRGDPNNVDIDGATAAGIPVLNTPGRNADAVAEMTVALLLAATRHLLPADADVRGGNIFRDGSIPYQRFRGGEIAGLTAGLVGLGAVGRATRWRLSGLGLRVIAHDPYHPEARHGLDELLAESDVVSLHAPVTDETTGMIGAEQFAAMRDGVVFLNTARAQLHDTDALVEALRAGKVAAAGLDHFVGEWLPTDHPLVGMPNVVLTPHIGGATWNTEARQAQLVADDLEALLAGATPAHIVNPEVLAR

SEQ ID NO: 2867 - protein, 537 aa, Streptococcus pyogenes M1 GAS
MNNHWWHKATIYQIYPRSFKDTSGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDYYIWRDEPNNLMSIFSGSAWELDEASGQYYLHLFSKKQPDLNWENAQLRQKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSEAKETWLPVNPNYQDINVADALADPDSIFYTYQKLIALRKEQDWLVEADYHLLPTADKVFAYQRQLGEETYVIVVNVSDEEQVFATDLAGAQVIIANTDVDTVLETKHLQPWDAFCLKLKA

SEQ ID NO: 2868 - protein, 298 aa, Gibberella zeae PH-1
METNGEIEKPPSERTSPVIQPWDKEDRDIENKEIVLITGANTGIGLETVKALFRSSKAYHVILGSRKASNGEAAVAQLESEFPDTKSSVDVMQIDLGYDHQISLVFETIKSKFGRVDVLVNNAGANFDSFEENDGADPTGARVLFNKTYANNVSGTQVFTATFVPLLLESSSPRIIFLTSGLSTLHGAHKSLLSKITESIPKGWPKAGVPTAIAYRCSKTALNMVMLSWYQLLKDDGVRVWSVSPGFLATGLGGNPELLKSAGAGDPATGGELVLKVIEGEKEEDVGKVVCQHGVQEW

SEQ ID NO: 2869 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 2870 - protein, 139 aa, Brassica napus
MFALTSKFAVGWIVNPAYMGPPGRGFLAAVESTGPIGRRLAGLNVKTVETNKRVFRGLFLTALGAFLGLSGVILLGETFYQKSSDGRLFVAIWKEGGVLPGLKVDRGPVRLAGTNGETTIQGFDGLGGRCRKYYKAGAR

SEQ ID NO: 2871 - protein, 250 aa, Medicago truncatula
MASSSYALRTIPSSFVKPTAFATTPRSFLTPSSAFTPFTSSKNLKMNAAFSKSCFSSVPMKSFTCKSQVNEYADTEKVQEMHVYELNERDRGSPAYLRLSNKSVNSLGDLVPFSNKLYTGDLQKRIGITTGICILIEHKAEKKGDRYEAIYSFHFGDYGHLAVQGPYLTYPEDTYLAVTGGSGIFEGVKGQVKLHQIVFPFKIFYTFYLRGIKDLPQELLGKHVEPSPAVEASPAAKALEPHAVIAGFTY

SEQ ID NO: 2872 - protein, 489 aa, Arabidopsis thaliana
  misc_feature (419)..(419): Xaa can be any naturally occurring amino acid
  unsure (1)..(489): unsure at all Xaa locations
MTETGLILMWFPLIRLGLFVLRWVRKRVSVWICVSKRGERGDDGPPGDLGWPVIGNMWSFRRAFGRSDPESFIQSYITRYGRTGIYEGHMFGYPCVRVTTPETCRRVRRDDDAFHIGWPRGTMRLIGRKSFVGIAFEEHKRLRRLSSAPVNGPEARAVYIQFIEETVKTDREGWSKMGEIEFLSHLRNVTFEVMMYMFLSSENEHVMDSLGRECTNRNDGVRAMGMNGPGFAYDRALKAREGGVAAFQSIVTNRRDQRKQNVSSNKGDMRDNGIDVKGEDGRILNDEEMIDLLLMYLNAGHESSGHLTMCATTLMQEHPMILQKAKEEQERIVKKRAPAQKLTLKQTREMVYLSQVIDQTLRVITFFLTAFRDAKSDVQMDGYIIPKGWKVLTWFRNVHLDPEIYPDPKKLDPSRWEGXTPNVGTFLPFGLGSHLCPGNDLAKLDISILLHHFLLKYRVERRNPGCPVMFLPHNRPKDNCLARITRTMP

SEQ ID NO: 2873 - protein, 223 aa, Zea mays
  misc_feature (167)..(167): Xaa can be any naturally occurring amino acid
  unsure (1)..(223): unsure at all Xaa locations
MLKRLLTKTKSKKKKEAASSAIPTLDRLHETLEMLEKKERFLQKKCSAEIEKAKDYTKAKNKNAAIQCLKKKKLYETQIEQLSNFQLRVHDQIIMLESAKATTDTVDALRSGSSAVKAMQQSVNVDDIEKAIEEANEQTESMREMQQALATPIGASADFDEDELEAXLEELEEEEEEEEGEIEDELPEPPARRSVEPSAKAAASSRQGSDVSELTRLQAEMAL

SEQ ID NO: 2874 - protein, 161 aa, Musa acuminata
SSMMVSSAATVSRASPAQSSMVAPFTGLKSTSAFPVTRKANADLSHLPSNGGRVQCMEVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 2875 - protein, 452 aa, Sulfitobacter sp. EE-36
MSDWLEELPPAAREYLEGKRLDEVECIIPDLPGIARGKAVPATKFARQEYFHLPDSIFYQTITGEWGDAAGADGFIEKDMILRPDISTATAAPWTGDWTLQVIHDAFDRDGNPVEYSPRNVLKRVVDLYRAQGWEPVVAPEMEFFLVARNLDPAHEIKPMMGRSGRPAAARQAYSMTAVDEFGPVIDDIYDFAEAQGFEIDGITQEGGAGQLEINLIHGDPVRLADEVFYFKRLIREAALRHDCYATFMAKPIANEPGSAMHIHHSVLDATTGKNIFSGPQGGETDAFYHFIAGMQNHMPDALAVIAPYVNSYRRYVKDHAAPINLEWGRDNRTTGIRVPLSGPASRRVENRLAGMDCNPYLGIAASLACGYLGLIEQKKPKAEFKGDAYDGDGDIPQVLGSALDLFEEATTLHEVLGPEFARVYAIVKRAEYEEFLHVISPWEREHLLMNV

SEQ ID NO: 2876 - protein, 497 aa, Mesorhizobium sp. BNC1
MNAATAKIDLSAKLDLLHDKSLLRELAYVDGRWVTGHEPVNFEVRDPATGAVLAYVASLNAAQVDSAIDAAARAFLSWKRLLPQERAATLRAWYELIVAAKEDLALLMTLEQGKPLAESRGEIDYAASFVEWYAEEAKRLNVESVTSHLPGAEMMVRREPLGVVGVVTPWNFPSAMLTRKAAAALAAGCTIVAHPSSETPLSALALAELGERAGLPAGVLNVVTGDAATIVGRMCGDSRIRAMSFTGSTEIGRLIAAQCAPTMKRLVMELGGHAPLIVFEDAPLDKAVDIAIGAKFATSGQDCLAANRIYVQRGIYGAFCEAFAARIATLKVSDGLDETGDIGPLMHERAIAKVEEQVTDALGRGARCLIGGERHPAGRLFYQPTLLADVPDAALIMREETFGPVAAAVPFDTEDEVVRRANNTEYGLVAYVVTENGARQLRMGRALDYGMVAINRVKITGAPIPFGGVKQSGIGREGARHGLEAFTDLKYLCLDAA

SEQ ID NO: 2877 - protein, 264 aa, Escherichia coli O157:H7 EDL933
MKPTTIASLQKCKQEKKRFATITAYDYSFAKLFAEEGLNVMLVGDSLGMTVQGHESTLPVTVEDIAYHTTAVRRGAPNCLLLADLPFMAYATPEQAFENAATVMRAGANMVKIEGGEWLVETVKMLTERAVPVCGHLGLTPQSVNIFGGYKVQGRGDEASDRLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 2878 - protein, 265 aa, Thermosynechococcus elongatus BP-1
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 2879 - protein, 585 aa, Candida glabrata CBS 138
MNLLVKGSLVNIGLRSGILRRSIKRCFKMEALNNQNIEDSKKRQALQKNNQPLKKRPKLKRYKAKKVDPTSPLGVLQFEIDELLRENNLEKSQVENDVTAILNDTSFVTGPIASKYHREVSDVKVLKLGSNGDGLAIIPNPVETDKKQVAIVPFGLPGDLVRIKVFKTHPLYVESDLLDVIEKSPIRKDELIKDKYFGKYSGSQFEFLDYSEQLKIKKSTIANAYKHFAPLLLAESLVPEISDTVASPLQYGYRTKITPHFDMPHKVKQLEVRPPLGFGQKGRPKWRKETLEVGGTGPILDIEECALATDILNKGLSNERARFEKEFKNYKKGATILLRENTIILDPSKPTEEQLEEGSRDENGDISFIEVTDETTGVKLAKTCVTNTRQIVTEYVDGYTFKFSAGEFFQNNNSILPLVTKYVRDNLQLGNGDKPRYLVDAYCGSGLFSICSSKGVDKVIGVEISADSVSFAERNAKNNGVENCKFIVGKAEKLFESIDTPADSTSVILDPPRKGCDELFLKQLAAYNPARIVYISCNVHSQARDVQYFLKDTPEGKNYRVESIRGFDFFPQTHHVESVCVLSRV

SEQ ID NO: 2880 - protein, 219 aa, Haemophilus influenzae 86-028NP
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 2881 - protein, 410 aa, Haemophilus influenzae 86-028NP
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKARGIPVFNAPFSNTRSVAELVLGEILLLMRNVPQANAEVHRGVWNKSATGSYEVRGKKLGIIGYGHIGSQLSIIAESLGMDVYFYDIENKLPLGNAKQVRSLEELLSSCDVVSLHVPELPSTKNLMNATRIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 2882 - protein, 445 aa, Lactobacillus johnsonii NCC 533
MSKTITAEDIKKSVKDNDVRFLRLAFTDINGTSKAVEVPTSQLDKVLTNDIRFDGSSIDGFVRLEESDMVLYPDFSTWAVLPWGDEKGGKIGRLVCSVHKTNGEPFEGDPRNNLKRVLKEMKEKGFTDFDIGFEAEFHLFKLGEDGNWTTEVPDHASYFDMTSDDAGARCRRDIVETLESIGFEVEAAHHEVGDGQQEIDFRFDDALTTADRVQTFKMVVREVARKHGLYATFMAKPVEGQAGNGMHTNMSLFKDGKNVFYDKDGEFHLSDTALYFLNGILEHARAITAIGNPTVNSYKRLIPGFEAPVYISWASKNRSPLVRIPDAEEINTRLEMRSADPTANPYLLLAACLTAGLNGIKEAKKPMAPITSNVFEMSEEERAKRGIKPLPSTLHNAVKAFKADPLIQEALGEHLTQSFIDSKNLEWSKYTQSVSDWERDRYMGY

SEQ ID NO: 2883 - protein, 401 aa, Glycine max
MEGKLSRAAKKITSSSIQELSQLAQRCNAINLAEGFPDFPSPPHLKNAAVSAINSDFNQYRHVQGVCDLLAKMVKQMHGLDIDPVTDVAICCGQSEAFAAAIFATIDPGDEVILFDPSYETYEGCVAMAGGVPIHVPLDPPQWTLDPSKLLRSFTEKTKAIVLNSPHNPTGKVFTKEELEIIAGECCSRNCLAITDEVYEHITYDNLKHISLASFPGMLERTVITSSLSKSFSVTGWRVGWAIAPAFLASAIRNIHGRVTDSAPAPFQEAALTALRSPPEYFESLRRDYQSKRDYIIKLLDGVGFKIVFIPQGSFFLFAELPDNWLLSDVEFVKKLIIEAGVVAVPGQGFFHTNLSSNEVSSLNYQKRYVRFAFCKSDTTLTTVAERLGKLLDAAGHLALH

SEQ ID NO: 2884 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 2885 - protein, 76 aa, Zea mays
TRPGIYGYPRDKKSKNGKLRLLYECAPMSFIVEQAGGKGSDGHQRILDITPTEIHQRVPLYIGSVEEVDKVEKFLA

SEQ ID NO: 2886 - protein, 402 aa, Clostridium tetani E88
MVKMFKFNSIEEAIADIKEGKMVIVVDDEDRENEGDLLMAAEKVTPENINFMIKYGRGLVCMPIIGERLKELNLNQMVDINTDTNGTAFTVSIDFIDTTTGISAYERAHTISKVLDSSVKGEDFKRPGHVFPLEAKEGGVLKRAGHTEASVDLARLAGFYPAGVICEIVGEDGKMARLPQLMEYSKEHNLKIINIADLIAYRRKKETLVKRVVEAKMPTRWGEFKIIGYENKINGEHHVALVMGDIENGEDVLVRMHSECLTGDALGSVRCDCGYQYEAAMKAISEERRGVLVYMRQEGRGIGLINKLKAYNLQDKGMDTVEANIALGFPPDLRDYGIGAQILNDLGIKKINLMTNNPKKITSLSGYGIKIVKRVPLEIHENEESEFYLKTKKEKMGHLLHF

SEQ ID NO: 2887 - protein, 272 aa, Robiginitalea biformata HTCC2501
MSVSKKEYKRVTVRSLVEMKQQGEKISMLTAYDYSMARIVDAARVDVILVGDSASNVMAGHETTLPITLDQMIYHASSVIRAVDRALVVVDIPFGSYQSDPKEALRSAIRIMKESGAHAVKVEGGEEVKESVKRILNAGIPVMGHLGLTPQSIYKFGTYTVRAKEEAEARKLVEDAKLLERLGCFAVVLEKIPAELTKKVSEKLTIPTIGIGGGVHADGQVLVIHDLLGMTHEFNPRFLRRYMNLYEDMGKAIGQYVSDVKSKNFPNTDEQY

SEQ ID NO: 2888 - protein, 294 aa, Glycine max
MASATIRNAVVTGANKGIGFGICKQLVSNGITVVLTARDEKRGLEAVEKLKEFGVSDQVVFHQLDVTDPKSIESLANFIKTQFGKLDILVNNAGIHGAYVDRDALAAAGEKVANVDWRKISTENFEAAEAGIRTNYYGVKLMCEALIPLLELSGTPRIVNVSSSMGKLEKIPNAWARGALSDAESLTEEKVDEVLNQFLKDFKEGSLETKGWPHAFSAYIVSKAALTAYTRILAKKYPSFCINAVCPGFVKTDLNYNTGYLSVDEGAESVVRLALLPNGGPSGLFFSRSEVAPF

SEQ ID NO: 2889 - protein, 284 aa, Corynebacterium urealyticum
MSAYGHGRHEHGQNFLTNHKIINSIIDLVKQTSGPIIEIGPGSGALTHPMAHLGRAITAVEVDAKLAAKITQETSSAAVEVVHDDFLNFRLPATPCVIVGNIPFHLTTAILRKLLHAPAWTDAVLLMQWEVARRRAGVGASTMMTAQWSPWFTFHLGSRVPRSAFRPQPNVDGGILVIRRVGDPKIPIEQRKAFQAMVHTVFTARGRGIGEILRRAGLFSSRSETQSWLRSRGIDPATLPPRLHTNDWIDLFQVTGSSLPHHRPISPSGSSQRPPQRKNRSRRR

SEQ ID NO: 2890 - protein, 154 aa, Glycine max
  misc_feature (27)..(27): Xaa can be any naturally occurring amino acid
  unsure (1)..(154): unsure at all Xaa locations
GVFVFTLDPMYGEFVLTQENSPEPKSXGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 2891 - protein, 251 aa, Pseudomonas syringae pv. tomato str. DC3000
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 2892 - protein, 546 aa, Methylococcus capsulatus str. Bath
MLKKHPTFPGISGPVVTVVMDGFGYSPKTTGNAIAQAYTPTLDRLLATCPHTLLKAHGKAVGMPSDDDMGNSEVGHNALGSGQIYHQGAALVAEAIASGALFEGTAWREIMDNARQHGSTLHFIGLLSDGNVHSHIDHLKAMIVRAKAEGQRRVRIHILLDGRDVPETSALEYVGPFEAFLAELRDETFDARIASGGGRMNITMDRYEADWGMVERGWHTHVLGEARHFESATQAIETLRAEHTGIIDQDLPPFVVAHDGEPVGQIFDKDSVIFFNFRGDRAIEISRAFEEEEFAPFDRVRHPGVTYAGMLQYDGDLGIPRRYLVAPPAIHGTVGEYLAAEGITQLAISETQKYGHVTYFWNGNRSGKFNESLETYVEIPSDRVPFEQRPWMKSAEITDELIRQIKTGRHRTVRVNYANGDMVGHTGHYQATIIAVEAVDLALSRLLPVIDALGGVALITADHGNADEMYELDKKTGEPQRTPSGAPKAKTSHTLNSVPFIYYDRLNRAVIQNPGDAGLSAVAATTVNLLGYEAPDLWDRGLLAFG

SEQ ID NO: 2893 - protein, 598 aa, Oryza sativa
MAGGGGKKEKGEGLGRALIRQRNKAAAAVKERGDALAHARRRAQPLESVIEVSDIDAVLERAAEADRLHSALADSVSSSDLVIDLDATGETDEERRRMQKEQEALHAGSLRVPRRPPWNSRMTVEELDENERRAFLVWRRNLARLEENDKLVLTPFEKNIDIWRQLWRVLERSDLLVMVVDARDPLFYRCPDLEVYAKEIDEHKRTMILVNKADLLPMNIRKKWADYFKAHDILYVFWSAKAATATLEGKILSGYSEQDSASLDLDTKIYGRDELLKKLQTEAEFIVAQRRAAAIKEDSRATSSDSVSSVAKHVVVGFVGYPNVGKSSTINALVGEKKTGVTHTPGKTKHFQTLIISEELTLCDCPGLVFPSFSSSRHEMVSCGVLPIDRMTKHREAIQVVADRVPRSVLEQIYKITLPKPKPYESQSRPPTAAELLRAYCASRGHVSHAGLPDETRAARQILKDYIDGKIPHFELPPGMVDTENEHEETSGLEGPTTSAYNESGGSDSDERDDTVDPAQPDMRHVLSDLESFDLATEGSKPAGKKKKEASHKQHKKPQRKKDRSWRVGNDGGDGTAVLRVYQKPAVNLSAVSASDKT

SEQ ID NO: 2894 - protein, 341 aa, Shigella flexneri 2a str. 301
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 2895 - protein, 486 aa, Saccharomyces cerevisiae
MGTGKKEKSRRIREGDTKDGNLRVKGENFYRDSKRVKFLNMYTSGKEIRNKKGNLIRAASFQDSTIPDARVQPDRRWFGNTRVISQDALQHFRSALGETQKDTYQVLLRRNKLPMSLLEEKDADESPKARILDTESYADAFGPKAQRKRPRLAASNLEDLVKATNEDITKYEEKQVLDATLGLMGNQEDKENGWTSAAKEAIFSKGQSKRIWNELYKVIDSSDVVIHVLDARDPLGTRCKSVEEYMKKETPHKHLIYVLNKCDLVPTWVAAAWVKHLSKERPTLAFHASITNSFGKGSLIQLLRQFSQLHTDRKQISVGFIGYPNTGKSSIINTLRKKKVCQVAPIPGETKVWQYITLMKRIFLIDCPGIVPPSSKDSEEDILFRGVVRVEHVTHPEQYIPGVLKRCQVKHLERTYEISGWKDATEFIEILARKQGRLLKGGEPDESGVSKQILNDFNRGKIPWFVLPPEKEGEEKPKKKEVEKTA

SEQ ID NO: 2896 - protein, 650 aa, Synechococcus sp. WH 5701
MYEQISHSLLNSILDELRPEIKRQNLRYFYTRLGANFYAIHSLFSTLYGDREDFQPQMVRLVETMAEGYIYRSEESERIDMSREQDHNWFLSQKWVGMALYTNGFANDLGDLAGKISYFQELGVNMVHIMPILKCPAGQSDGGYAISNFREIDSRVGDLNDIQRISEQFRKCGILLVLDIVLNHTSDEHEWALKAKDGDPRYQNYYLTFEDRSVPDVFEQGMPMVFPVTDPGNFTWNEEMKRWVMTVFHDYQWDLNYSNPEVFIEILSIVLFWANQGVDVLRLDAVAFLWKKLGSTCQNERKAHLILQLLKDCCQVTAPGVLFIAEAIVAPSEVAKYFGEDAIVAKECEIAYNATLMALLWDGIATRNTKLLREGIKSLPTKLDRATWLTYVRCHDDIGFGFDDKDIAAAGYEPHSHRMFLIDYFTGKFSDTSRGLEFMRNDSTGDARICGSLASLAGLESALEKGDQGLIDMAISKILLLNGVILSFGGIPLIYNGDALGQLNDYSYIDDPSKSNDSRWVHRPKIDWEKAALRHQRGTVECRIFTAMKRMISIRKEISAFADFNNRELMHSDNQHLLCYLRYNHLRSSEKVFVIANFDDHPQQLELESYSRYGINPRANYTDLYSGIKPSQYDGCIALQGGQFYWLSES

SEQ ID NO: 2897 - protein, 334 aa, Phaeodactylum tricornutum
MPVSLGINGFGRIGRLVMRAALEHPDATVVAVNDPFLTPEYAAYQFKYDSVHGTYSEDVSFEEGYLVVGDKKIRFFSERNPEEIGWGSVGAEIVCESTGVFTTIDKAQAHINGGAEKVVISAPSADAPMYVMGVNHTTYSGATVFSNASCTTNCLAPLAKVLHEEFGIVEGLMTTIHAGTATQLVVDGPAKRGKDWRAGRSSLANLIPASTGAAKAVGKVIPELNGKLTGMAVRVPTADVSMVDLTIRTEKAVSAAELKAALKKASEGPMKGILGYTEDAVVSQDFVHDPRSSIVDASAGIALNDNFHKVIAWYDNEWGYSNRLVDLAIYTSGK

SEQ ID NO: 2898 - protein, 168 aa, Prunus pseudocerasus
YFQFVQQWPPTNCRVRIKRPCSNPRPLQYFTIHGLWPSNYSNPTKPSNCNGSQFDTRKVSPKMRIKLKKSWPDVESGNDTRFWKDEWNKHGTCSEERLNQMQYFERSHDMWLSYNITEILKNASIVPHPTQTWTYSDIVSPIKTATGRTPTLRCKQDKKTQLLHEVVF

SEQ ID NO: 2899 - protein, 376 aa, Odontella sinensis
MKLSIAALLVGSAAAYAPSSFSGTSLKASSNGASMSMSTGMGVNGFGRIGRLVTRIMMEDEDCSLNAINAGSATPDYMAYQYKYDTIHGIAKGSVEIDGDFLVLNGKKIQTSRCRDPKEVGWGALGADYVCESTGVFLTKEKAQAIIDGGAKKVIYSAPAKDDSQTIVMGVNQAEYDGSEDFISCASCTTNGLAPMVKAIHDEFVIEEALMTTVHAMTATQAVVDSSSRKDWRGGRAASGNIIPSSTGAAKAVTKVIPSLQGKLTGMAFRVPTIDVSVVDLTCRLEKATTYEEICAYVKSKAEGDMKGFLGYSDEPLVSTDYEGNTISSIFDADAGIMLNPNFVKLVAWYDNEWGYSCRVVDLMKHVAAVDAKVEA

SEQ ID NO: 2900 - protein, 339 aa, Odontella sinensis
MTVSLGINGFGRIGRLVMRAALENPDTTVVAVNDPFMNIDYAAYQIKHDSVHGMYPGSVEVDGDSLVFDGTTKVKFFAERDPASIPWGASGAEYVCESTGVFTTIEKASLHLKGGAKKVIISAPSANAPMFVMGVNHKSYDGSADVVSNASCTTNCLAPLAKVLHENFGIEEGLMTTIHAATATQLVVDGPSKGGKDWRGGRSAMANMIPASTGAAKAVGKVLPELNGKLTGMAVRVPTPDVSMVDLTVRTTKACTGAEIDAALKAASESEDLKGILGYTDLPVVSQDFVHDKRSSIVDSTACIHLSDTFHKVISWYDNEWGYSNRLVDLCLFMKTVDN

SEQ ID NO: 2901 - protein, 354 aa, Bacillus halodurans C-125
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 2902 - protein, 466 aa, Sinorhizobium meliloti
MDTRPEPFEPPAPVPRTGIPSRLEIIRTVLRNPLELWGEPSYTLPWIETKFINQRTLIVNDPGLIRYILVENAANYEMSNVRRLILRPILRDGLLTAEGEVWKRSRKAMAPVFTPRHAQGFAGQMLRVCEAFVDRYAGASSEPFVTNVAVDMTELTFEILAETLFSGEIAVEKQGFAANVEELLHRMGRVDPMDLLVAPSWVPRLTRIGGRKVLDRFRGVVSETMSLRRRRTTEAPGDVPNDFLTLLLQLEGPDGLSTSEIEDNILTFIGAGHETTARALAWCFYCVANTPAYRETMEQEIDSVLASGADPVDWLGRMPHVLAAFEEALRLYPPAPSINRAAIEEDAWTSPEGERVPIRKGISVLVMPWTLHRHALYWQKPRAFMPERFLPENRDKINRFQYLPFGAGPRVCIGATFALQEAVIALAVLMHRFRFDLTDETHPWPVQRLTTQPRGGLPMKVSARVK

SEQ ID NO: 2903 - protein, 468 aa, Yersinia aldovae
MLLPVIMAGGTGSRLWPLSRTLYPKQFLALTSELTMLQETLTRLDGISHQPALIICNEEHRFIIAEQLRQLHIEHSGIVLEPAGRSTAPAIALAALLARSRGEDPLLLVLAADHVIQDRTTFIDSIISALPLAEAGKLVTFGIVPDAPESGYGYICRGMSVGDNAYKVDAFVEKPDQSTAEKFIASGGYYWNSGMFIFKASRYLQELELYRPEIFASCKKAIDGCRNDLDFIRLNEEPFLNCPEDSIDYAVMEKTSDAVVVPMDAKWSDVGSWSALWALNEKDGNGNVIRGDVLIENTNDSYIYSKNKLVATVGVNDLIIVETKDAILVAHKDKVQDVKSIVAQLKKNSRTEHLQHREVYRPWGSHDSIAEGERYHVKHLIVRPGQRTAMQIHHHRAEHWVVVSGTAKVYRGDEIFLVTENESTYIPVGLAHAIENPGKFDLEIIEVRSGSYLQEDDIVRIDHKNAGY

SEQ ID NO: 2904 - protein, 615 aa, Odontella sinensis
MISGTARALASSASNASKRAFHASARSDARKFFVGGNWKCNGSVQQVNDLVSMLNQSTLSTDTEVVVCPSQVYVQGVSEKLRKDIGVGAQDCWVQGNGAFTGETSADMLADMGVGWVVIGHSERRGKGEADEEVARKAKYALDKGLKVIACCGEPLESREAGTTNDFVFPQIKAYADVFSKEDWANVVIAYEPIWAIGTGLTATPEQAQDTHADIRQYLGEVAGADVAESTRILYGGSATGATAPGLSAKPDIDGFLVGGASLKPEFADIVNCQGGETSLKPVNIGINGFGRIGRLVMRAAQNDPMVNIVSVNDPFIPVNYMEYMLQYDTVHGEYPGTVKQTGDDTLSIDGKDVKVFGEMDPSKIQWGSVGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDKDIVSSDFISDRHSSIFDEKAGIALTDDFVKLVSWYDNECGYSNRVLDLIKHMDVSK

SEQ ID NO: 2905 - protein, 112 aa, Populus deltoides x Populus maximowiczii
TFVGKKWFVTYHAYAMGRMESIWGKNCRDFVPERWLENGIYRQESPFKFPVFHAGPRMCLGKDMAYIQMKSIAASVIERFEIDVQNKEKCPDHLLSLTLRMKGGLQVKVKER

SEQ ID NO: 2906 - protein, 266 aa, Clostridium sticklandii
MDKKIGFIGCGNMAQAMISALVKSKLIESNQIIVSNRSKNILEKMNKEYGITIAANNIEVAEKCDIVFLAVKQNLYEMVMKEIKDSVTKDKIFVSIAPGKTMEFLEAHLGAYAKILRTMPNTPSMVSEGMTAICPNSNIASEELELLVKLIESFGAVEIIEEKLFDAVVAVSGSSPAYVFMFIEAMADAAVIQGMPRAQAYRFAAQAVLGSAKMVLESKSHPGELKDMVCSPGGTTIEAVAVLEERGMRSAVIEAMRKCAQKSKEM

SEQ ID NO: 2907 - protein, 379 aa, Phaeodactylum tricornutum
MKFSAATFAALVGSAAAYSSSSFTGSALKSSASNDASMSMATGMGVNGFGRIGRLVTRIMMEDDECDLVGINAGSATPDYMAYQYKYDTIHGKAKQTVEIDGDFLVLDGKKIITSRCRDPKEVGWGALGADYVCESTGVFLTKESAQSIIDGGAKKVIYSAPAKDDSLTIVMGVNQEAYDGSEDFISCASCTTNGLAPMVKAIHDEFVIEEALMTTVHAMTATQAVVDSSSRKDWRGGRAASGNIIPSSTGAAKAVTKVIPSLVGKITGMAFRVPTIDVSVVDLTAKLEKSTTYEEICAVIKAKSEGEMKGFLGYSDEPLVSTDFEGDLRSSIFDADAGIMLNPNFVKLIAWYDNEYGYSGRVVDLMKHVAAVDAKIKA

SEQ ID NO: 2908 - protein, 474 aa, Magnetococcus sp. MC-1
MLIPTILAGGGGTRLWPLSRDLYPKQFHSGLGDDRPLLLQTAARVQGLPHLSDPVVICNEQHRFMVEEMLREEGNPCQAIFLEPVGRNTAPAAAIAALYARTQQADALVLLMPSDHHIVDSAGFRACVEQGMPHAANRKLVTFGIVPHSPNTGYGYIRRGEPLAEGVFQILNFTEKPNASTAQAYLEQGDYSWNSGIFLFHAGFFLETLARLAPAMYDTCLAAFEAAQPDHAFTRLGKAFLAVPADSIDYAVMEKSNDGVVIPMGVGWNDMGAWDALWEVGNKDPQHNLSVGDTLSVDTHNSLIWSSSRLVATVGVENLAIVETADAILVARKDRVQEVKKIVDQLKQSKRCEFSHHNMVYRPWGTFTQVDAGPRFQVKRIMVKPGAKLSLQMHHHRSEHWVVVKGTALVTRGDTEILLKENESTYIPLGVKHSLANPGKIPLEIIEVQSGPYLGEDDIIRFEDIYARLEDHPR

SEQ ID NO: 2909 - protein, 406 aa, Methanothermobacter thermautotrophicus str. Delta H
MKFIRDSVHGNLKLSEFEVRIVDTPQFQRLRRIKQLGFTSLIYPGANHSRFEHSIGAMYLASRLAEHLGLGHEKKRVLRLCALLHDVGHGPFSHVSEGVLEMSHESLTRELIRKSILGDIISEEFDLRQVMRILRGEGVLGQAISGELDVDRMDYLLRDSHYTGVAYGIIDVERLIYNMKMENDLVLDRKGVQAAESALLARYFMYPSVYQHHTTRIVNSMFRRCLRSLISGGVLDASRIYRYDDMDLIVMCRNQEGLAGDMMRRLDNRDLLKTVDSVKLNELEDPDRVFRITEAEIQRAEEEIAEDMGLDPDYVVVNLPEYPAFDEMRTQVSVGDSIVNLSHISSLVGALKEARFNHADICVYVPGEFAGSFRDFSLHDYMDLPERRPSHPRQLRLTVPDYLRFR

SEQ ID NO: 2910 - protein, 215 aa, Lycopersicon esculentum
HEAARKLRENQSTTSVQTEDLVEDPAQESADYHRNLGLQMVSGLSNELENVRKASLIDGENLSAAVMKLNHSLMKTKEFLDTDMRSLEDESKFRDTLTNFIQHAEQDITCILEEEKKIMSLVKSTGDYFHGNSGKDEGLRLFSVVSDFLIMLDKACTVVRNSTKLPVKIPKKGTLTSPSQESCPESLQDIRKQLFPAIQERQMHYSSSDDESSSP

SEQ ID NO: 2911 - protein, 177 aa, Plantago major
MASSMLSTSSTAVAGRAQATMVAPYAGLKSTSVFPATRKTGNAKLARNAGKVRCMQVWPPLGKKKYETLSYLPDLTVEQLAKEIDYLLRSKWIPCLEFELEHGFVYRENNRSPGYYDGRYWTMWKLPMFGCTDASQVIAELEECKKEYPNAWVRIIGFDNVRQVQCISFIAAKPPGL

SEQ ID NO: 2912 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 2913 - protein, 70 aa, Brassica napus
MQASRARLFKEYKEVQREKSADPDIQLICDDSNIFKWTALIKGPSETPYEGGVFQLAFAIPEQYPLLPPQ

SEQ ID NO: 2914 - protein, 434 aa, Rhodococcus sp. RHA1
MTVAAELDKALRPLVRGELPVHLTAWDGSTAGPATAPKVVLRSPDAVRRLLWSPGELGAAQAYVTGEIDVEGDLGEALAHVWAVARERGLSGVRPSPWTVAKVLRVAAKLGVTGGPLPTPATQANIRGPLHSLMRDRAAISHHYDLSNDFYALILDPQMAYSCAYFTRNAPGTPQDSDYGLEDAQRDKLDLVCRKIGLEPDMRLLDVGCGWGSLSLHAAAEYGAQVVGVTISREQKAFIDKRIAERGLQDRVEIRLQDYREVPDGPFDAVASLEMGEHVGEKNYARYAQALYDNAKPGARVLIQQMSRTGRHPGGGPFIESFIAPDMTMRPVGESVAYLERAGLEVRDVHGLREHYVWTVDAWLEKFESRWDDAVEMVGLEMARVWRLYLVGGGMSFEQGRMGVDQILAVKPTAAGQSMMPAVRVDSAGSGVLR

SEQ ID NO: 2915 - protein, 348 aa, Clostridium perfringens str. 13
MLCALIMAGGKGTRFWPLSTEEKPKQFLNLIGDKTMIQMTIDRVKPIIPIERIFVCTGEKYIDLVKEQLPELPENNIIVEPEGRNTAPCIALSALVIKRYYKDATMVVLPSDHLISNEDRFRNILLDGEEYLKENGKSILTLGMTPNRAETGYGYIKFTEDKSLVNNSEVIKVEKFVEKPNKERAEEYLKDGSYLWNGGMFLWTIDNIINRIKEHIPNTYESLKEIEEVKEEKLQELINNNYKKTDSISVDYAILENADEIRVIPSDIGWDDIGTWRSVERYREKDINNNIIDENVRVIESKSNMAINKEKRVVMIGIEDIMTVETEDTIFIVKKDYMDNLRDYKEVL

SEQ ID NO: 2916 - protein, 100 aa, Oryza sativa (japonica cultivar-group)
MAAAAGPSLSITVEKNPPEARLLQLGIKSWPKWGCPPGKFPLKFDARLTCYLLKGRVRASVKGTGRCVEFGAGDLVVFPKGLSCTWDVVVGIDKHYNFDS

SEQ ID NO: 2917 - protein, 490 aa, Rhodococcus sp. RHA1
MTATVSEYLGTPGREAPASARRAKIVCTLGPATATGDRIRELVDCGMDIARLNFSHGEHSDHEENYLRVRDASELAGRAVGILADLQGPKIRLGRFAEGSTVWSDGDLVRITVDECEGTHDRVSTTYKQLAEDAEPGDRLLVDDGKIGLVVTDVDGNDVVCRVTEGGPVSNNKGVSLPGMNVSVPALSGKDIADLEFALRLGVDLIALSFVRSAADIELVHAVMDRVGRRVPVIAKLEKPEAIDNLEAIVLAFDAVMVARGDLGVELPLEQVPLAQKRAIQIARENAKPVIVATQMLESMIENSRPTRAEASDVANAVLDGADAVMLSGETSVGKHVMETVRTMGRIISAVEEKSTHVPPLAHVPRTKGGVLSYAARDIGERLGAAALVAFTQSGDTVRRLARLHTPLPLLAFTPLPAVRAQLALTWGTETFLVDPVESTDQMIHQVDHALLGLGRYQRGDLVVIVAGSPPGTVGSTNLIHVHRIGEEDH

SEQ ID NO: 2918 - protein, 98 aa, Solanum tuberosum
MARSFSNSKILSAFVSDSVSALLSRRGYAAASQGAVSGVAKGGVPRSNVIMQKSGEESVKTSWVPDPVTGYYRPEGQANEIDAAELRKMLLKHRSGSN

SEQ ID NO: 2919 - protein, 299 aa, Triticum aestivum
  misc_feature (222)..(222): Xaa can be any naturally occurring amino acid
  misc_feature (295)..(295): Xaa can be any naturally occurring amino acid
  unsure (1)..(299): unsure at all Xaa locations
AYLGDTIEQVCTKKQAGTGPEFPGYRRPTRPVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDVEAVKKLFEDNKGEIAAVFLEPVVGNAGFIPPQPAFLNALREVTQPDGALLVFDEVMTGFRLXYGGAPEYFGITPDVTTLGEIIGGGPPVGAYGGPKDIMEMVAPAGPMSQAGTPNGNPLTLTAGIPPLKRPMEPXPMIL

SEQ ID NO: 2920 - protein, 167 aa, Triticum aestivum
  misc_feature (166)..(166): Xaa can be any naturally occurring amino acid
  unsure (1)..(167): unsure at all Xaa locations
TIEQVCTKKQAGTGPEFPGYRRPTRPLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYXY

SEQ ID NO: 2921 - protein, 738 aa, Zea mays
  misc_feature (12)..(12): Xaa can be any naturally occurring amino acid
  unsure (1)..(738): unsure at all Xaa locations
MGTSVQVTPLSXGAYGEGPLCYLLAVDGFRFLLDCGWTDLCDTSQLQPLAKVAPTVDAVLLSHPDMMHLGALPYAMKHLGLSAPVYATEPVFRLGLLTMYDHFLSRWQVSDFDLFTLDDVDAAFQNVVRLKYSQNYLLNDKGEGVVIAPHVAGHLLGGTVWKITKDGEDVVYAVDFNHRKERHLNGTVLGSFVRPAVLITDAYNALNNQGYRKKQDQDFIDSLIKVLATGGSVLLPVDTAGRVLELLLLLDMYWDERRLQYPIYFLTNVSTSTVDYVKSFLEWMGDQIAKSFESSRANAFLLKKVTLIINKEELEKLGDAPKVVLASMASLEVGFSHDIFVEMANEARNLVLFTEKGQFGTLARMLQVDPPPKALKVTMSKRIPLVGNELKAYEEEQERIKKEKSLKASLVKEEELKASHGSNTKASEPMVIDASSSRKSVNASHFGGNNDILIDGFVPPLTSVAPMFPFFENTAEWDDFGEVINPDDYMMKQEEMDNTLMLGPGDGLDGRIDDGSARLLLDSTPSKVISNEMTVQVKCSLVYMDFEGRSDGRSVKSIIAHVAPLKLILVHGSAEATEHLKMHCAKNLDLHVYAPQIEETIDVTSDLCAYKVQLSEKLMSNIISKKLGEHEIAWVDAEVGKEDEKLILLPPSSTPPPHKPVLVGDLKLSDFKQFLENKGWQVEFAGGALRCGEYIMVRKVGDSILKGSTGSQQIVIEGPLCEDYYKIRELLYSQFYLL

SEQ ID NO: 2922 - protein, 143 aa, Triticum aestivum
  misc_feature (58)..(58): Xaa can be any naturally occurring amino acid
  misc_feature (72)..(72): Xaa can be any naturally occurring amino acid
  misc_feature (82)..(82): Xaa can be any naturally occurring amino acid
  misc_feature (124)..(124): Xaa can be any naturally occurring amino acid
  misc_feature (142)..(142): Xaa can be any naturally occurring amino acid
  unsure (1)..(143): unsure at all Xaa locations
MAPTVMASSATSVAPFQGLKSTAGLPVSRRSSSAGLSSVSNGGRIRCMQVWPIEGIKXFETLSYLPPLSTEXLLKQVDYLIXRSKWVPCLQFNKVGSFSRGAKQFPPGNTMGQYWAMWELPMFXGCTDATQVLNEWRRSKKXT

SEQ ID NO: 2923 - protein, 377 aa, Physcomitrella patens
MADGEEVQPLVCDNGTGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALTKILTERGYSFTTTAEREIVRDMKEKLAYVAIDFEQELDTARSSSSLEKSYELPDGQVITIGAERFRCPEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 2924 - protein, 290 aa, Myxococcus xanthus DK 1622
MTRSVGIVIHKVVPSFRLAVARFQYNMASKMYSHQGYKFINCGYADMEGDHKAVDFNRPENVYVLWESLYQRVVGQAELSGREVLEVGCGRGGGSEYLMTRLKPRSLTAVDLSDVAIARCKENYRLDGLSFQVGNACALPFEDRRFDVVVNIESSHCYPSQLTFFEEVKRVLKPGGAFCFADITESAEHTARINEEFKALGFTVVHHENITANVVKALNVVKETPQFTEAFERWESPNKKGNMKVPLMVINGTLKDLNSGKEYQRWVVRREEATERPVAGEQARAAAAMA

SEQ ID NO: 2925 - protein, 650 aa, Arabidopsis thaliana
MDSGDATSLLLTKIRSLEPDYAPKIIGYLLLHDFGDRDLMHLARGPESILQSTISKVKSLLGIFSNNSPSSTPTSPSPLNPICRPPLNGRGSSHSNGFMDFRRNSPSSPSSTSPWSFNNCINGNNGNNPHISPKHTPISKPFSSHQSNGLSATHSGSADAAGGADLLDDQQLNDCLSFLDDSCSKTEDLVDPSIPLDYSVDGDGETHLHRRSFSCDASFVSGDDGFGGGCKPCVYFSRGLCKNGESCKFIHGGYPDNMDGNGIVADSPRKMENFVRQHEEMMRLKLAYQQQRLASQILGRAPQLPYEKRMDFLLQQHAQRDGGLPFGDERFWSSSPGRLERMELAMHLGDQSNSASRQIYLTFPADSTFKDEDVATYFSLFGTVQDVRIPYQQKRMFGFVSFAHPETVKVVLARGNPHFICDSRVLVKPYKEKGKVLDKKQQQLLQQQIERGNYSPCSSPSGIDPREQSDFHLGSKMLYERREMMRRKIEQADLLRAIELERRRFINLQLPEFKNSVTLNHHRSFSVGSPGYFSSAGNQSPDFQSELNGADALKVTDDTLELHPYPVVNPMSVNNSYSNGAKEETNKSELLDPDSGSTIELVLPSNLFPSASSTDDHKTDDSAETNAKVGVSSTNENDHEPPVTTNNLMQ

SEQ ID NO: 2926 - protein, 614 aa, Phaeodactylum tricornutum
MLASSRTAAASVQRMSSRAFHASSLTEARKFFVGGNWKCNGSVQQAADLVSMLNQSSLSQDTEVVICPSQVHLQSVQSTIRGDVAVGAQDVWTQGNGAFTGETSANMLKDLGVKWAVIGHSERRGKGEPDAQVAAKAKYALDQGLSVIACCGEPLEAREAGTTNEYVFPQIKAYVDALEPKDWDRVVIAYEPIWAIGTGLTATPEQAQDTHEAIRQYLGQVAGAEVAANTRILYGGSASAKTAPGLSAKPDIDGFLVGGASLKPEFADIVNCQGDTKSLKPVNIGINGFGRIGRLVMRAAQNDPMINIVAVNDPFIPTDYMEYMFQFDSTHGLYTGTVNMVDESNIAVDGKPIRVFNERDPSKIQWGSAGADYVVESTGVFTTTEKASAHMVGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPALNGKLTGMSFRVPTIDVSVVDLTCRLDKGAPYATICAAIKAASEGPMKGILGYQNKDVVSSDFISDSHSSIFDEKAGIALTDDFVKLVSWYDNEAGYSMRVLDLIKHMEKSK

SEQ ID NO: 2927 - protein, 295 aa, Desulfotalea psychrophila LSv54
MSSYGRTRTDLKKHKLAPKKRFGQNFLVHKQTAEAIVRAGEVGEDDIITEIGVGLGALTVPMAHQAKHVYGIEIDNGIIKYHEEEQDLPDNVTLIHQDVLKVGFGDLAEKCGGKLKILANLPYSISHPLIFKLIEHRDIIPTATIMLQEEVADRLLAKPGTKEYGIPTILLGCCASIKKKMVLKPAEFHPRPKIDSAVITVDFTKPPELPEYNKELLSRVVRSAFSQRRKTILNTLSSASFFFAEKENKAKNKAMTEKTIEKAGFAVSLRPEVLSIQDFVRLTTVFEQEMNRTEE

SEQ ID NO: 2928 - protein, 1747 aa, Oryza sativa
MPPAPWPTPRTVRQAAELHAHLTTSGRLLHPPSAHHLLNSLVNCLPPSDPLHLRYALHLFDRMPASTFLFDTALRACFRAGTSSGDPDIPFVLFRRMRRAAVRPDGFTFHFLFKCSSSSRPRALLCTMLHAACLRTMLPSAAPFVANSLIHMYTELGLAGDVRRAFDEIPVKDAVSWTMVISGLAKMGMLSDARLLLAQAPVRDVISWTSLIAAYSRADRAKEAVDCFKNMLSEGIAPDDVTVIGVLSACSQLKDLELGCSLHLLVKEKGMSMSENLVVALIDMYAKCGDFGHAREVFDAVGRGRRPQSWNAIIDGYCKHGHVDVARSLFDQMEVRDIITFNSMITGYIHSGQLREALLLFMNMRRHDLRVDNFTVVSLLSACASLGALPQGRALHACIELRLVETDIYIGTALLDMYMKCGRVNEATIVFQRMGKRDVHAWTAMIAGLAFNGMGKAGLEYFYQMRCDGFQPNPVSYIAVLTACSHSCLLNEGRLYFDEMRILYNIHPQIEHYGCMIDLLGRSGLLDEAMDLVKTMPMQPNSVIWASILSACRVHKRIDLAQCAAEHLLKIEPDEDAVYVQLYNICIDSRKWEDASKIRMLMEERQVKKTAGYSSVTVAGQVHKFVVSDKSHPRILEIIAMLEEISHRLKSAGYSPITSQVTVDVDEEEKEQTLLAHSEKLAIAFGLVSLAPNLPVHIIKNLRPTIFRPLGADDGKQKQPDRRVVFLLPPSRRDAPVLVRPIPSSPAPFSLRSSVTMAVRDVASLNRMITGFIRDGLADRARAVYRWMVASGIRETPHTFSTILGVCSTYEALQLHGRVLALGLCCNPFVGSALVNHYMHVESPHAALSLFRELPLQNTAMCNVVLRGLGNLKLTEELICCFLDMRRQYLELNGLSYCYAMKGCYQNGEWLEQGRQLHGVVLKAGWIPSNIFLSNSLVDLYSAIGDSVDTVKALNDILSEDVISWNSILSMYADRGHMKEAVYYLKQMLWHGKMPSVRSFVSLLALSGKTGDWQLGVQIHGIVHKLGFSCSSVHVQTTLIDMYGKCCCFDHSLAIFNEIPSIALECCNSLITSSLGCNMFDAALEILHCMIVEGVTPDDVTFSATMKAISLSASPSLTSCQMLHSCLVKLGFEMDMAVCSSLITAYACAGQLSSSHLIFEGLLDPNVICFTAIISACARYGDGARAMELFDQMVSSGLKPDNVTFLCAIAGCDQAGMFEEGRLVIELMRASRELDPDERHFACMVNLLSRDGFVKEAMEMMEQSPLRHYTKAWSSLLQSCKAHGENVLGKRAANMLIDVGRKDPATTLQVSNFFNDIGDRETALRIKEMTNVKEVKKSGHSLIEMFVARRLFCCIWWWRLTTVLSTSTKSKTAECRPVDEVSTGVGWGCVKWGKVQEGIRAGGVEKAPATCQERTSTRTLVDSCWVLLLNSLVLGLFAEDTVPLKFDLRAYSDSAILGLQCMQAHKVQNLIHCCLQLYMDKKEVVDALSREAKIEPSVTQHVWQKLEENNREFFKAYYLRLMLKNQITAFNKLLEDQLRIINKEYHPGPSSMPLPNGSNSNLLKQNPCFLSESTPMPAMPDDVMCNGNSSGIVDRTQSSDQLIYAGKDIQGLHSSMDASNLLPVQNANSVLFGVENGTTIKTESGYSSNGNFGFCGNAFLESCQSIGDASGGSFSSSELNGQPLDDSILDIESSSFGFLSQLPRNFFSDLPEDFSQSTEILDNYGKSPFLPSEQNNFSDSTGGEHTG

SEQ ID NO: 2929 - protein, 426 aa, Escherichia coli O157:H7 EDL933
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPDFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 2930 - protein, 486 aa, Burkholderia pseudomallei K96243
MQPVVLAGGSGTRLWPMSRERHPKQLINLLGDESLLQSTARRLDGLSGVHPVSERMIVVCGEDHRFTTAEQLRLAGKDATLVLEPLGRDTAPALTVAALRAVGGGDDAVLTVMPADHAVADVARFQQAIAAAVRYAEQGMIATLGIVPTHAETGYGYIRVGAAANAADAGAEAGVAVRKLDRFVEKPHLELARQYVASGEYWWNSGIFIVRASVWLKAIRHFQPAIHDACARAVAQGSEDGPFFRVDRDSFAASPSNSIDYAVMEPLSNLPAVCEGVVVPLDAGWSDVGSWDTLWQISEKDDEGNVARGRVCFEQASSTFAHSEGRLIACVGTQDLVVVETPDAILVADRAHVQDVKKIVGRLKAESGTEASDHRKVHRPWGHYDSVDSGERFQVKRIVVKPGARLSLQMHHHRAEHWIVVRGTARITRGDETFLLSENESTYIPLGVSHRLENPGKMPLELIEVQSGAYLGEDDIVRFEDNYGRH

SEQ ID NO: 2931 - protein, 525 aa, Spiroplasma citri
MKAKQPILLAILDGWGIAPDSKGNAVTQGHMVNVEKLKTKYPWVSAHAAGEWVGLPEGQMGNSEVGHIHLGAGRIKYESLTLINKTIKDGTFNQNPELLAAINFAKKSNGAFHIMGLFSVGGVHSHLNHIFAAYKLAAQEGIKEIYLHIFGDGRDTKPECIKIYLEQFQQLQNQLKVGEIATIGGRYYAMDRDKKYDRVQIAYDVLVSRKGSEFSDPIEYINREYQAGRNDEFLMPAYNINTPKGYIKSGDGVFFANFRPDRAIAIASALTNPNFPGNEAQTYFMPKLHDIYFVSMMEYAETVASKHVAFKPIKVVNGLGEWLSKKGYRQLRIAETEKIAHVTFFFDGGKDYFKNGLATQAEITLTGASADLIPSPKVATYDLKPEMSAYEITDKLITELNQNEFDVIILNFANCDMVGHTGILPAAIEAVKTIDNCLGKIYTAIQKVNGIMIITADHGNVEIMIDETGGPNKKHTSQLVPIIITKEGLQLRQDNPAIADIAPTILDLLGEGIPPEMTQPSLIIK

SEQ ID NO: 2932 - protein, 134 aa, Brassica napus
MGKNDFLTPKAIANRMKAKGLQKLRWYCQMCQKQCRDENGFKCHCMSESHQRQMQVFGQNQRRVLQGYSEEFEKTFLDLMRRSHRFSRIAATVVYNEYINDRHHVHMNSTEWATLTEFIKYLGKTGKKERMNRK

SEQ ID NO: 2933 - protein, 582 aa, Sulfitobacter sp. EE-36
MTDSARSLGSRLSAVLAEVYPDLDADILSSMVLDAFWPEGTTRRKRGRIAGNTLWSERDALLITYGNSIVDGAHKPLDLLNDFLHRYLRGTLNSVHILPFFPYTSDDGFAVSDFRAVNPQLGDWPDINRIAADFTLMSDLVLNHVSSQGNWFNAYRQGQAPYDKFFFEASPQDDLREVVRPRTTPLLQEVETSSGPRHVWCTFSHDQIDLDFRNPEVLLEFLRIIRLHVDNGVQIIRLDAVAFLWKQIGTPSIHLPQTHAIIRLMRLLCDYAPEKIILLTETNVPKAENLSYFGAGDEAHAIYNFPLPPLILHAMMSGNGAHLRRWQRTMPPAPMGCAYLNFTASHDGIGMRPAEGLLPEDEKQQVIDTVLQVGGLVSMRSLPDGGQSPYELNTTFYDALSRTFKGEDDHHHARFICSQTIVMSLEGIPAFYIHAMLATPNDHAQVEHRGMSRAINRHRWDYPSLRDRLADGSSAQARVLGDLSARLKVRQKQKAFHPNATQFTVNLQDDRVFGVWRQSLDRKQSIFALHNVSDASVAISAAALNLIEDQPWLDLISGDLIDASADHITLASYQCMWVTNRF

SEQ ID NO: 2934 - protein, 174 aa, Plantago major
MASAMMSSAATVTAQTSMVGQFSGLKFGSTFPIAKKTGRVSSPSSGLKVRCMQVWPPTGKKKYETLSYLPDLTVEQLAKEIDYLLRSKWIPCLEFELEHGFVYRENARSPGYYDGRYWTMWKLPMFGCTDASQVIAELEECKKEYPNAWVRIIGFDNVRQVQCISFIASKPPGL

SEQ ID NO: 2935 - protein, 812 aa, Pseudomonas aeruginosa UCBPP-PA14
MPDSQDQTPSTVQTLKASILAKLRYSVGRDPSTACPHDWFEAVALAVRDHIIDHWEEATPQGEAPARKRVYYLSLEFLIGRLLLDNLGNLGLLEETRQALAELGVDLQRIVALEPDAALGNGGLGRLAACFMESMASLDIPAHGYGIRYEHGLFRQVLTDGWQQEQTETWLDFGNPWEFERPEVSYYIDFGGSVQVDSEHSGRAIWRPDERIRAIAYDTPIVGWRRASVNTLRLWRARAEEDLQLDRFNAGDHIGAVVDVVKAESISRVLYPADSTEAGQELRLRQEYFFVSASLQDLLDRHLRHHHDLRSLPEQVAIQLNDTHPAIAVAELMRQLVDVHQLAWPDAWALSVATLSYTNHTLLPEALESWPVALMERLLPRHMQIIYLINAFHIDALRAQDIHDFDLLRSVSLIEEGHGRRVRMGNLAFLGSHQINGVSALHTELMRETVFHDLHRLYPQRISNKTNGVSFRRWLFQANPGLTELLVETLGADLLDTPERRLPDLEEHVEDARLRARFAEQRRQNKTALARLVLDSLGVAIEPEALFDVHIKRIHEYKRQLLNLLHTVALYQEIRNDPTADRVPRVKIFAGKAAASYHQAKLIIKLANDIARTINDDPTVRGLLKLVFLPNYNVSLAEAIIPAADLSEQISTAGLEASGTSNMKFALNGALTIGTLDGANVEMSQRIGLEHMFIFGLSAQQVEQRRQAGELEMGGVIAASPRLEEALEAIRSGLFSADDRSRYEGLVDGLVHDDRFMLCADFEAYWHAQCRVEEVWREPDRWWRSALLNVARIGWFSADRTISEYARDIWKL

SEQ ID NO: 2936 - protein, 1100 aa, Pseudomonas aeruginosa UCBPP-PA14
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAELDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLVGYRAAAAGLAHAWHGREGEGAALVLACLEKAAYELLYEADYRPDWLEVPLAGLAELTEHLLKGKNR

SEQ ID NO: 2937 - protein, 484 aa, Bordetella bronchiseptica RB50
MENLGYPARLELYVAGQWRGVEGRRTQVVVNPSTQQPLGELPLASVEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAVLAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVRRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 2938 - protein, 178 aa, Glycine max
  misc_feature (91)..(91): Xaa can be any naturally occurring amino acid
  misc_feature (100)..(100): Xaa can be any naturally occurring amino acid
  misc_feature (122)..(122): Xaa can be any naturally occurring amino acid
  misc_feature (149)..(149): Xaa can be any naturally occurring amino acid
  unsure (1)..(178): unsure at all Xaa locations
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 2939 - protein, 338 aa, Glycine max
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDNRSSIFDAKAGIALNKNFVKLVSWYDNEWGYSSRVIDLLVIVAKKSF

SEQ ID NO: 2940 - protein, 448 aa, Trichodesmium erythraeum IMS101
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 2941 - protein, 392 aa, Bacillus subtilis
MEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 2942 - protein, 108 aa, Brassica napus
DGLFKPDPRFEEAKQFAKSGVFGTYDYGPLLDSLEGNTGYGRGDYFLVGYDFASYMDAQAKVDEAYKDRKRWLKMSIMSTAGSGKFSSDRTIAQYAKEIWNIEACPVP

SEQ ID NO: 2943 - protein, 152 aa, Synechococcus sp. WH 5701
MAVERTFLAIKPDGVQRGLVGEILGRFERKGFKLVGLKQLVPSRELAESHYGVHRERPFFAGLVDFITSGPVVAMVWEGDGVIASARKLIGATKPLEAEPGTIRGDLAVNIGRNVIHGSDAPETAVFEIGLWFEPSELSDWTPADQVWRRED

SEQ ID NO: 2944 - protein, 195 aa, Triticum aestivum
TPAPTSPRFRPISPEMAGAASSVAPVLVICLLSLALFLHRCRSCEAVERERTLAMIKPDGLSGNYKEKIKEAILGSGFDIIEEAVVHLDAERASLFYAEHADRSFFNSLVKYMTSGPVCAMVLESPDAISRWRNLIGPTDARKAKTSHPDSIRAMCGLDSEKNCVHGSDSPQSAAREISFFFRDDKSEALEHDEL

SEQ ID NO: 2945 - protein, 389 aa, Campylobacter jejuni RM1221
MLTKRSQVLEESITLAITALANELKAKGEDIISFSAGEPDFDTPQTIKNAAISAIEKGCGKYTAVAGIPEVLKAIQTKFKKDNNLDYETNEIITNVGAKHSLFECIECLVEKDDEVIIPSPYWVSYPEMVKFAGGKPVFIEGLEENGFKITAEQLKKAITAKTKVLMLNSPSNPVGSIYSKEELTQIAKVLEGTQITVLSDEMYEKLRYDGFDFVAFASVSEDALKRTVTINGLSKCGAMPGWRFGYMASKNKALISAVKRLQGQSTSNICSITQHAAIPALNGKCDKDIEKMRQAFEKRRNLALDMLKQIPNISVYKPEGAFYLFVNIQKIEKDSMKFCQKLLEQEKVAVVPGIGFGTDGYFRLSYATSDELIEKGLERIANFIKNYK

SEQ ID NO: 2946 - protein, 271 aa, Enterococcus faecalis V583
MKISFIGAGNMASAIAKGALKKQFIAAENLYFYDIQVEKTAAFAQEIGAHAVASPQEAITVADLVILAVKPQFVQAALLEAKEAILDKQPLIVSIAAGTTIAELYQLFETTQPLRLVRVMPNMNALIGAGAAAVCGNAFASPEDIQTVLSLFRAVGQAWELEEQYFSIFTAIAGSTPAYAFLFIDSIARAAVKNGMNKELALEIATQAVLGSAQTLANSTENPWTLIDQVSSPGGTTVAGIVELENNAFISTVIKGIEATILRDQELAKQD

SEQ ID NO: 2947 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTETRYSFTTTAEREIVRDMKEKLAYVALDFEQGLDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 2948 - protein, 334 aa, Colwellia psychrerythraea 34H
MKIKVGINGFGRIGRFVFRAAVERDDIEVVGINDLMDIEYMAYMLKYDSTHGRFKGTVDVVDGKLIVNGNPVRVTAERNPENLQWNDIDVDVVVEATGLFLTDETARKHITAGAKQVVLSAPSKDDTPMFVCGVNLNEYKGQEIVSNASCTTNCLAPIAKVLNDNWGIQDGLMTTVHATTATQKTVDSPSTKDWRGGRGAGQNIIPSTTGAAKAVGKVIPALNGKLTGMAFRVPTPDVSVVDLTVNLIKPATYAEICQAMSAAAEGELNGILGYTEDAVVSNDFIGETCTSVFDAKAGIALTDTFVKVVSWYDNEIGYSNKVLDLVAFISQYEK

SEQ ID NO: 2949 - protein, 568 aa, Magnaporthe grisea 70-15
MSHSSPASSNGVKNHMVVESSPLKPFSFPTPPLPDDEEHVPFKKARTISRELSGASENRSDGSLPDDILISIFEHLDLLELLRLRAVSRHWKEVLTTSPRLCTHVNLAQYSRRINDWSIINVLAPFIGPRPLSIDISNCFHLSDEGFQTLWKSCGRNVKKWRMKSVWEVSAGQILEMSDNVKGLEEIDWSNCRKVGDNLLARVVGWVVPHPPSPTTNTTIGPGGKAVVSRSRSAKQAQHQNQPPPSMPPPGTVIGCPKLRKLDLSYCKHITDRSMAHLAAHASNRLESLSLTRCTSITDHGFQAWADHRLNALSRLSLADCTYLSDNAIVALVTAAKNLTHLDLSFCCALSDTATEVVALGLPQLRELRLAFCGSAVSDASLGCIALHLNELEGISVRGCVRVTGMGVENVLEGCGRLRWLDVSQCKNLAGWLNGGGVERWGFDDRGSRALRYTQSPEEMTFPHLQQGAVVRNSSYQNIPGYMGPGQPPSQRSARGSFSAPESVGPSVAGGSPRAATWHPGRRPGMYAPPGAGFGPVLRPVMLPKGVAKGRTKQPVRFIVEKGHVGLR

SEQ ID NO: 2950 - protein, 126 aa, Solanum carolinense
NKSIILHDCPIDKKDGYVTIRDHRILTELDKRWPQLRHDYFTGINAQPHWRHEFEKHGTCGINRYKQPAYFDLAMKLKDKFDLLTILRNHGINPGSKYHLNDIERAIMTVSIEVPSLKCIEKPPGM

SEQ ID NO: 2951 - protein, 169 aa, Oryza sativa
MFLRRILSGGGGVAALRAARAVKETTGIVGLEVVPNAREVLVGLYTRTLKEIEAVPKDEGYRKAVESFTRHRLQICQEEDDWKRIEDRIGCGQVEELIEEAQDELKLIAKMIEWDPWGVPDDYECEVIEDDTLIPKHVPQHRPVALPEEFFTTLDARHSGPAPGGQAPS

SEQ ID NO: 2952 - protein, 186 aa, Schizosaccharomyces pombe
MGSSSSRRRSSSLVTKVPKPTIDDRLDQGSATNYNSNWVNYKGAWVIHIVLIAALRLIFHAIPSVSRELAWTLTNLTYMAGSFIMFHWVTGTPFEFNGGAYDRLTMWEQLDEGNQYTPARKYLLVLPIILFLMSTHYTHYNGWMFLVNIWALFMVLIPKLPAVHRKRIFGIQKLSLRDDDNDSIPR

SEQ ID NO: 2953 - protein, 834 aa, Saccharomyces cerevisiae
MTNMAEDKTSISKVHSEFSNSSNTTGSEEESRSHQESFDGESSSGESKSKSKLNLEYSADIEPLKFRMTKTNNTNDKLKYSNNGNATDSFMRLKEHLQRGNTLNSNLRVNEFYPFNSIDTEQFENYLREPKYIKMLKRRKNLKQFRRLFLAQELMAYEGETVTSTSKSSEPTSKAIWSTKFSRDGKFMATGSKDGKIRIWKVIGSPVERAELDSSAESNKEARAKSMRIKQQVSSLNNPKEKQFLDSATEKYEEKEKLLNLYAPVFHPTPLRLYKEHVQDVLDINWSKNNFILSASMDKTVKLWHPDRKNSLKTFIHPDFVTCVEFHPTDDRFFISGCLDHKCRLWSILDDEVSFEYDCQDLITSVTLSPEEGKYTIIGTFNGYVHILMTRGLTPVSSFHVADRQTQEQNAHVMVTETDSKIRHGPRVTGLQAFRSQLDNSFRLVVTSNDSRIRIFDLEQRKLLEVLKGFHSGSSQHKAQLSIWHGQPIVVNSSDDHWVYGWRLKSSDRENDQDEPKRKPKGLARSGSLRSIFSKSMSRSSSQNNEEKPHHHLKLTNLLPLPHHSNDHYIKNTDYISFHAHNAPVTCVSIAPPETSKTLSLSNDVICELSLEFFQTSDSFDVLSRSNDDGIMSDVESSLGYNSKPGSISNASATSAIPDVVDAIGTILISTDNVGTIRVFRADMPSVIRKRVLLKLEEYNREVRRRFNSSDSLHSLSRSFNSRAKSNLAGQPAAAYTNTGKGYATGRGYSNICPKSSTSLKTLGSNAQPRTPRESMSSIFSNAHGPTTPTSAMNLPIRCNVCNGSRFEAFSGANDQQDRNYYCVDCGTVVNNFR

SEQ ID NO: 2954 - protein, 308 aa, Oryza sativa (indica cultivar-group)
MGINVYTTGVLIFLESTCVLMDPQLQVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 2955 - protein, 256 aa, Mesorhizobium loti MAFF303099
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 2956 - protein, 275 aa, Sulfitobacter sp. EE-36
MSATARKTAPMPTDILARKGGAPLVSLTAYTTPMAQVMDGICDFVLVGDSVGMVLHGLPSTLEVTMEMMILHGQAVRRGLTQSMLVIDMPFGSYEQSPAQAFENAARLMRETGAGAVKLEGGEVMEDTIAFLTKRGIPVMAHIGLTPQSIHTLGGYKVQGRGAAATQLMADAQAVARAGAFAVVLEKVPQALADQITETVAIPTIGIGASAQCDGQILVVDDMLGLFTAFKAKFVKRYAHLGDDAKAAVQAYADEVTARSFPGPEHVFFDEVSKT

SEQ ID NO: 2957 - protein, 139 aa, Triticum aestivum
  misc_feature (90)..(90): Xaa can be any naturally occurring amino acid
  misc_feature (103)..(103): Xaa can be any naturally occurring amino acid
  misc_feature (108)..(108): Xaa can be any naturally occurring amino acid
  misc_feature (114)..(114): Xaa can be any naturally occurring amino acid
  misc_feature (124)..(124): Xaa can be any naturally occurring amino acid
  unsure (1)..(139): unsure at all Xaa locations
MAPTVMASSATSVAPFQGLKSTAGLPISRRSSSAGLSSVSNGGRIRCMQVWPIEGIKKFETLSYLPPLSTEALLKQVDYLIRSKWVPCLXFNKVGFVFREHNXSPGVXDGRYWXCGKLPMFGCXDATTGGSKWGGSKKE

SEQ ID NO: 2958 - protein, 473 aa, Brassica napus
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 2959 - protein, 149 aa, Methanococcoides burtonii DSM 6242
MERTYVMVKPDGVQRCLVGEIVSRIEKKGLKIAALRMNVMTEAAAKEHYKEHSERPFFGSLVSFVTSGPSVSMVIEGNNAIKIMRAINGATNPVDALPGTIRGDLAVDMGRNVVHASDAPESAEREIGLHFEESEISGYPRADDEWLYE

SEQ ID NO: 2960 - protein, 588 aa, Thermus sp.
MRKEAIHHRSTDNFAYAYDSETLHLRLQTKKNDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPHMPKLNTAHPEVKRYLLDVATYWIREFDIDGWRLDVANEIDHQFWREFRQAVKALKPDVYILGLIWHDAMPWLRGDQFDAVMNYPLADAALRFFAKEDMSASEFADRLMHVLHSYPKQVNEAAFNLLGSHDTPRLLTVCGGDVRKVKLLFLFQLTFTGSPCIYYGDEIGMTGGNDPECRKCMVWDPEKQNKELYEHVKQLIALRKQYRALRRGDVAFLTADDEVNHLVYAKTDGNETVMIIINRSNEAAEIPMPIDARGKWLVNLLTGERFAAEAETLCVSLPPYGFVLYAVESW

SEQ ID NO: 2961 - protein, 174 aa, Triticum aestivum
MSEPIPLLPRPDEHQPPDMDASATGAGAKSKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKAEKKA

SEQ ID NO: 2962 - protein, 158 aa, Hordeum vulgare subsp. vulgare
MAAEHHRDRGVLGGGGAFADRSGQGGYGGDHHDQQKQPAMMCALKAATATAAGSLLVLSGLILAGTVIALTVATPVLVIFSPVLVPAAIALALMSAGFVTSGGLGVAALSVFSWMYKYLTGKHPPGADQLDHAKARLASKARDIKDAAQTRIDQAQGA

SEQ ID NO: 2963 - protein, 304 aa, Anabaena variabilis
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 2964 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTERGYSFTTTAEREIVRDMKEKLAYVAIDFEQELDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 2965 - protein, 405 aa, Leptospira interrogans serovar Lai str. 56601
MMYEKTAEHFEQKYKNLPEGHLLVNLGPSHPATHGILQNVIQIDGERIVEAESVIGYVHRCFEKLGERYTYNQFLVCTDRMNYVSTPLNNIGWILAVEKMMQIEVPDRVTYVRMIISELSRIIDHIICTGILGVDLGAFSGMLHLFHHRENIYQIIEKLTGARLTTTFCRIGGLEKDIYPDFVKEVKLVCKGLKPAIEEFNSLLLKNKIFLGRTEGIGGISAENAIAYGYTGPNLRAAGVDWDVRKDEPYLFYDKVDFDIPIGEDGSVLHRSLVRMEEMRQSIRIIEQLVDGIPSGPWHADLPHAYLPEKHKVYNNMEELIYHFKIIMHGVKVPPGEYYMATEAANGELGFYIVSEGEKSPWRVHVRRPCFWYYQSFAELVRGGLLADSVATMSSLNVIAGELDC

SEQ ID NO: 2966 - protein, 250 aa, Zea mays
  misc_feature (82)..(82): Xaa can be any naturally occurring amino acid
  unsure (1)..(250): unsure at all Xaa locations
GPIASRKFFVGGNWKCNGTGEDVKKIVTVLNEAEVPSEDVVEVVVSPPFVFLQQVKGLLRLDFAVAAQNCWVRKGGAFTGEXQVPWVILGHSERRALLGESSDFVADKVAYALTQGLKVIAWIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 2967 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 2968 - protein, 588 aa, Bacillus thermoalkalophilus
MLKEAIYHRPKDNFAYAYNEKTLHIRLRTKKNDIETVYLLYADPYEWVNGVWQLNRAPMVKSGSDDLFDYWFIEVVPPYRRLRYGFELTAGSETIVYTEKGFYNEAPTDDTAYYFCFPFLNKIDVFHAPEWAKDTIWYQIFPERFANGNPSLNPEGTLPWGSEEPTPTSFFGGDFEGIIQHLDYLVELGINGIYFTPIFYAPSNHKYDTIDYFEIDPHFGDKQTFKKLVDLCHQKGIRVMLDAVFNHCGYYFAPFQDVLKNGNNSKYKDWFHIHEFPLRTVPRPNYDTFAFVEQMPKLNTENPEVKQYLLDVATYWIREFDIDGWRLDVANEVDHQFWREFRQAVKAIKPDVYILGEIWHDAMPWLRGDQFDAVMNYPFTNGVIRFFAKDEIRAEQFANIIMNVLHSYPANVNEVAFNLLGSHDTPRILTTCNNDVRKVKLLFLFQLSFTGSPCIYYGDEIGMTGGQDPGCRKCMIWDESKQDRDILEHVKKLISLRKTHPALGSQGNITFIDANNETNHLIYTKTYKHETILVMINNNNKNIEVTVPLSLKGKRLTNLWTNEQFAVEAKTLRANIPPYGFLLNQVEN

SEQ ID NO: 2969 - protein, 315 aa, Sulfitobacter sp. EE-36
MKDTTFGPKGWTPDRLGSLKGKTYLITGTTAGAGFQATRILLSKGAKVVMLNRNADKSIAAVKTLKDTFGPNAEVSFVRMDLSDLASVRAAAEEVQSTVPRIDALICNAAIAQVPTQQLTVDGFESQLGTNHYGHFLLCGMLFDRIQESAGRIVVVSSLGYNMGIKTIQFDDMNWDKNYSANAVYSQSKLAQMMFAYELQDRLKATDSRVEVYVCHPGASATSLISTSGGLFTRVTWWMMSKTPMVQSAEKGAYPEVMCATEDGLAQRALYGPTGWLQTGGPVGKGTLNPHAYDKPVMEKLWTVSEKATGFHWEI

SEQ ID NO: 2970 - protein, 103 aa, Eremothecium gossypii
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTI

SEQ ID NO: 2971 - protein, 334 aa, Triticum aestivum
  misc_feature (288)..(288): Xaa can be any naturally occurring amino acid
  misc_feature (308)..(308): Xaa can be any naturally occurring amino acid
  unsure (1)..(334): unsure at all Xaa locations
MALASTTASRLISRRLVAPLPPPPSSSCAAPRGGARPGPRRFAVRWEGRPRALLGGFSDADEDVSDDEDEEDGPGALSGGPPRQQQGCEDVIELAAAAFSGPERWDVLGLGQAMVDFSGMVDDEFLERLGIEKGTRKVVNHEERGRVLRAMDGCTYKAAAGGSLSNSLVALARLGSSRASNCYSELRVAAGSVGSDPLGSFYRQKLHRANVQFLSKPVKDGTTGTVIVLTTPDAQRTMLAYQGTSSTLAYDSDLAEIVSKSNLLIVEGYLFEFSHTIEAIKQACEDAXKNGALIAVSASDVSCIKRCXSDFWDIVGDYANLLVPHSQQPKGSWS

SEQ ID NO: 2972 - protein, 213 aa, Rhodococcus sp. RHA1
MTIELEAPPVRRSGRPAGTAAALSETVSRLALGETIVLCDGDRTMLAYSAATATVEQTAFVIRHTSGFLQIALPAPRCDRLLLPAAPTMFAGPPGVGYRQCIGVDAAYGVTTGISAADRTHTARTLADLRTPPGDLTRPGHLVVVAVDPGYRGRCPVPHLALRLADFGRNGLLFADLVDSTRPHDMADRNEAFLFADAHHLSIGMGDVWATYP

SEQ ID NO: 2973 - protein, 271 aa, Candidatus Blochmannia floridanus
MQKKYYKNHVIQKKWGQIFLKDQNIIHSIISILNLKKYQNVIEIGPGLGALTKPISDIIDFLILIERDPNLVNRLLHTFTSKKVKIFNKDAMTIDFSKLLTNPNQKIRLIGNLPYNISTKLIIHLYKYINIIHDMHFMLQKEVAQRIVAQPNNKAYGRLSIFAQYYCKVQALLEVPKKSFIPIPKVESMIVQFIPYHTNNPYPTVNISLLSLLTKFAFHQRRKIIHNSLSSLLNSTEIIQCGINTESRAENLTIQQFCKLTTILHHKYNLN

SEQ ID NO: 2974 - protein, 217 aa, Shigella flexneri 2a str. 301
MNQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 2975 - protein, 147 aa, Arabidopsis thaliana
QTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 2976 - protein, 148 aa, Arabidopsis thaliana
MEQTFIMIKPDGVQRGLVSVKSSAGLRRRVSLCLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 2977 - protein, 91 aa, Methylococcus capsulatus str. Bath
MPSIKIENNPPETRLGELGVRRWPTWSCGVSSFPWTYDESETCYILEGEVTVTPQGGEPVRIGKGDLVTFPPGMSCTWDVHVPVKKHYTFG

SEQ ID NO: 2978 - protein, 274 aa, Magnetospirillum magnetotacticum MS-1
MSTEVRIKRITTRDIRARKGAEPLVVLTAYTAPIARLLDPICDILLVGDSLGMVVYGMETTLGVTLDMMINHGAAVVRSSSKACVVVDMPFGSYQESREQAFRNCARVMAETGCAAVKLEGGRELAETIRFLVDRGIPVLAHIGLKPQAVHAAGGFRAQGRLEAEAEAIRDDARAITEAGAFAVVVEGTVEPVSRALSAEISIPTIGIGASPACDGQVLVIDDLVGLFDDFTPKFVKRYADLRPLITEAAQRYAAEVKARSFPGPEHCFGMPKK

SEQ ID NO: 2979 - protein, 157 aa, Triticum aestivum
SWFNAVLGRHYNDWENEFYRLHNMESTMDFDLGWSDMVSCYGLHGNRHIASLFASRKLWASPYLRGHFLAGLAALPGISKIKDFIQRLLSAQTCLSCFIEQVAVVVDYKDQAGEQQIVQQNSENTILKTAAPVEGHAAAVFTPYAFYKLQDELVEAA

SEQ ID NO: 2980 - protein, 253 aa, Mycoplasma genitalium G37
MQQTFFKDPILGEIIFDENTKWMYELVNTKAFQRLRNIKQLGINFHFYPSGVHTRYAHSLGVYELIRRILNSSAFLNIDQIKKQTVLVAGLLHDLGHGPHSHAFEIYFAKNPDFKKQLFIHEKVTSMLVNSEPIVSILKANKIDPNLIGALIDENQNIQPINWWMRQLISSDLDTDRMDYLLRDAYFTGTSHSLVDYQSIINGMECVDNQGTYEIVFQEKCLPFIENFLITRHHMYQSIYSDGRSIATELNLW

SEQ ID NO: 2981 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 2982 - protein, 3154 aa, Burkholderia pseudomallei K96243
MPRPPMNTDNPRRAEPIAIVGMGCVFPGAAGPAAFLELLRAGRVAVRDVPPERWDAAALHDPDPDAPGRILTRRAATIDGAHGFDPEFFGLSRRDAREMDPRQRLMLKTAWWALEDAGMPGWGLAGRSVGVFLGASNGEFGGAHARLSAIGASTAAGHATSVLANRVSYLLGLTGPSLVVDTACSSSLVAVHLACAALRARECELAIAGGVSLMLRPDASVAFSRARMLAADGRSKPFSASADGYGRGEGAGAVVLKRLSDARRDGDRIVAIVLGSAVNHNGQSNGITAPSAPAQEALIRQAIEAAGVAPEQIDLVEAHGTGTLLGDPLEAKALGRVLGAIDGRAGALPIGSVKGNIGHLEAAAGIAGLIKLALALRHREILASAGFDAPNPHIDFRALNLTVPTARTPLPERARPAIGALSSFGFGGANAHLIAAAPPADQPDRHDRHDQHDSPVRHAGAQTGAPWPALLVLSAASDSALNRLAAATAACARGDRPGAWRLARASHVARSPLRRRLAVVAPDADTLAAALDRAASGGRDGVVARGAAPRRRPALAFLYAGQGAQFPGMAAGLLDGDTELRRTLEHASAITGLPIVDWLAAGGAALDRTDVTQPLMVALQVGLTRQWAAWGVAPDIVIGHSLGDYAAAVAAGALSFDAAMRVAALRGRLAATSARPGGMVAVAAGRDAVAPHLARGAAIAVDNGPAQLSVAGDAAALAETVRRLEAAGIAARPLPVSAAFHSPAMEPMLDAFRAALADVAMQPLRVPMVCNRTGAVLPAGTMLDAEFWVRHLREPVRFADGVRALAREGVALGLEIGPSAMLSRLAPLSAPTLSVVPSLARGTRDRDALLAAVGALWVAGVTPDWRAIDGPDRVHAELPLYPFDDAPFPLLADGTVAAGAIASSGAFGAREAGPAPSPPQASPSLPATPAVAAASASNAAARERALDIGAKLRDAIAEALETSPDRVDPTVPFIEMGADSLVLMAAARKIEAAFGVRIPMRAFFDELSTMEALATYLAAESPRPAAASDRAPAAPSSPGFVAQVVREQLALMRRQLDLLEGRRAAGEPEMPDDAARALRAEIARAERMGDRGEDGRREEGGSEEGRGEWHGGGKDGHGGGDGSGKGGDGSDTGRAVPAVRATRRANTVRDALSPRRQAHLDKLIGDYTRRTAGSRALAARYRDVMADSRASAGFRPSIKEMLYPIVCRSAAGATFEDVDGNRYLDLSMGFGVHLFGHAPDFVTAALRESLSRGLRLGPQADRAGEAAAVIARLSGQDRVAFVNSGSEAVMVALRLARTVTGRERVVIFRGAYHGHFDGVLADAADPADPAAGGAPLVPGVARGAVADTLVFDYGDPASVDTLAAQLGHVAAVLVEPVQSRRPDLQPAAFLRRLRALAEQAGALLIFDELITGFRIAAGGAQAHFGVKADLVAYGKILGGGLPIGALAGRADVMAAVDGGAWRYGDDSAPTAETTLFAGTFNKNPLSIDACVAVLTEIERRGDALYAQLNERSARLHARLEQALAGTPIGIARFGSVFRFVFGRNLDLFFYHLLLRGIYVWEGRTCFLSAAHTDADCDRLVVAVADAVAALRDGGMLDEGEGDHEGEVEGEGEGGPTADPAARDYAAPHADTDTHTDTLPMIRAQRQLAALAEMDPAGAVAYALPLLLALDGPLDAARLRDAVERAAARHDGLWVAMDPLSGTLRMMPPGRLTLGVQALDAAALDAQVRRQMAAPFDLKAPPLLRATLFAFADGTHALLLVGHHAALDGFSLQVLAADIAACYRGAPLPRAASLRRVLAAHRDAERDGRWAAARDGWRARLRDAPAGFDLDVAAPRPPMRALRGAREVRRIEAASARALRARAAAERTSLLAVMLAGFAWLLARHGAADVVIGVPYAGRALAGDGAQRVVGYCAHLLPIRLRAGAVDSVAALLAHTRAALIEALDHADYPFAHIVDDLALKRDPARPLLVPATFNVDRVPPALDFGEGVAARLRSPAVGAGRFDLACNVIDDGDALTVEFDHDEALYGGGRAQRLADEYLQLLEALAQGGERPLHDGAGHVARWATVVAAGRAEPLAVRWRRHLERAPQQVAVAVDGDARLSRAALDRWSDAVADAIEGAISGVRAGVIEGVIDGAVEDKIEGAAEAARASATAGPVALLLPRTEALPVAMLACWKAARAWLPIDPATPAERIAEMIRRAGCALVVRDAATAAAADGAIAPRCATLDLPPRAAAGRRAARRPWPAPNPEDVAYVLFTSGSTGRPKPVAVPHRALEWYVQGLLARLGLPSGLSCGLVSTFAADLGLTATLPALFDGGCLCIQSDAAARDPLLLAAVHRKRPVDLLKIVPSHLEALLAGAPDPLLLPRRVLVLGGERAGPGLLRRLAECAPPALRVMNHYGPTETTVGVAMGEWTRGADALRLDAPLAGAALVLLDDAGRRAPAGVRAQLYVGGPQVALGYPGCPDETAARFGARPASGVAGPLYATGDLGRLDADGTLTIVGRTDDQAKIRGYRVEPGEVAAALEGLPGVASAAVVAAEHPARGTVLVAYVAGDGAQADPASLALALHARLPDYMMPARIIPCRSLPLTANGKLDRGALPAPDWATHAPGEPASATVSSEAERVQATLVAVWRELFGRPDIGVHDEFFALGGDSILGIRMVARLHRDGLRLLASDLYRHPTIAALAPLIRPVDAQAEQGVLSGPVPLLPAQRRWLEIGAGLRPHANLSLLLELDAEVTPARVADAFARLLHQHDGLRMRARTDGGELVQTYGPPAPVPLHRVAAGHATPAALTRLQALADPAASPLVLGWLDGAPSRLLIVMHHWITDAVSCAILLDDLARLLRDPDAPLGPKTPSLRQWAQTLTERAASPDALAQLEYWTLSTSLPPPALPARSGGARGDAADGEWPGAPGAVGLTLSADETRDVTAGPAAQAGAETEDLLLAALALALGGRTGEPLLYVELEGHGRTPPDGLPEPARTIGWFTARHPAWFDLTGVPEAAAVAAVRAQRLSIPNRGADYGALRHLGPDHARDALAAGRRPAVSLNWLGQLAGIEHAPFRLVSWRPGCPLRGAERAADLPQPHALAVETMLIDGCLRIEFIYDAARFDAATIDTLAADYAAALLRLARERAAPPAPPPDSPGELDADDLAALAASR

SEQ ID NO: 2983 - protein, 499 aa, Bradyrhizobium japonicum USDA 110
MAASILIADDDAVARRLIENMVQKCGYETVVVDSGDAAIAALTAPDAPAIDGVILDLVMPGLDGMGVLAKIREAGLSVPVIVQTAHGGIDNVISAMRAGAADFVVKPVGMERLQVSLRNALNASALKGELQRIRHSREGRLTFSDIITRAEAMAGVMRTAQKAANSSIPVLIEGESGVGKEMFARAIHGSGERKAKPFVAVNCGAIPDNLVESILFGHEKGAFTGATERHTGKFVEAHGGTLFLDEVSELPLAAQVKLLRALQEGAVEAVGGRKPVKVDVRIISATNRRLLERVKQGHFREDLFYRLHVLPLTIPSLRTRREDIPHLLRHFLARFAAEENRTITGISGEAVAHLAQLDWPGNIRQLENAVYRAVVMSEGDQLGLGDFPLLASQPYPATEIPTAPLMLEPIAAPSVVSSGSEIPIAPLPSVGTLPMLTATGDVRPLEDMENEIIRFAISHYRGQMSEVARRLKIGRSTLYRKLDEAGVPGHGGKSGEETH

SEQ ID NO: 2984 - protein, 92 aa, Brassica napus
MAGPAKASWMVAMGVGAVEALKDQAGLCRWNYALSSIHRAAKAKANVRGGGGVSQGKKQLPASAAAVAERRRADKAEEGLRTVMYLSCWGPN

SEQ ID NO: 2985 - protein, 602 aa, Kluyveromyces lactis
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 2986 - protein, 478 aa, Bradyrhizobium japonicum USDA 110
MRRLRRIKILATLGPASSDLAMIRRLFEAGADLFRINMSHTPHDKMRELVATIRNVESSYGRPIGILVDLQGPKLRLGAFAEGSVQLQNGQTFTLDSDKAPGDATRVNLPHPEILAALRPGHALLLDDGKVRLIAEETSKEHAVTRVVVGGRMSDRKGVSLPDTDLPVSAMTPKDRADLEAALVTGVDWIALSFVQRADDVIEAKKMIRGRAAVMAKIEKPQAIDRLADIIEASDALMVARGDLGVELPLERVPSLQKQMTRMARRAGKPVVIATQMLESMIQSPVPTRAEVSDVATAVYEGADAIMLSAESAAGKFPVEAVSTMNRIGEEVERDPIYRSVLTAQRPAPESTAGDAIADAARQIAETLDLPALICWTSSGSTAVRVARERPKPPIVAITPNIAAGRRLAVVWGVHCVVAEDARDQDDMVSRAGQIAFRDGFVRAGQRVIIVAGVPLGIPGTTNMVRIASVGPEGGADI

SEQ ID NO: 2987 - protein, 719 aa, Acidovorax sp. JS42
MKTRPSAFPSSANSYQNQSIHGTLPARRPPAPAPPAGRVHNFCPRPSAAHALPRITFRALFLHTMAQAPVWLTYGFTYLAAAVIAVPIARALGLGAIIGYLAAGIAIGPWGLALVSNVQDILHFAEFGVVLMLFLVGLELQPSRLWSLRRPIFGLGTAQMVGCAALLWAAAWAFGLPWRVGLVGALGLALSSTAIALQVINERNLMRTDSGQKAFSILLFQDVAAIPILALLPLLGVAVRAAELDHPHEVQELLLEAAKILGVVGAIVLGGRLALRPLLRWIAKSKTPEIFTATSLFLVVGIAMLMLSVGLSMALGAFLAGVLLADSEFRRELETDIEPFKGLLLGLFFIAVGMSIDFGVILRTPWGMLALLLGFLGIKALVIWTLARVTAMPYQERPVFTLLLAQGGEFAFVVFQAGAGFRAIPAEMASLLIGAVALSMLISPLLLVLLDRVLLKRFATLKTAPQAQEISEPQSAPVIIAGFGRYGQIVARMMLAQGVPATVLDHSVEMLEVAHTFGYRVFYGDATRVNLLRMAGAEHARILVVAVDAPEQSLKIVQLAKKHFPQLQIVARARRDALARAARSGRGACGTRGVRVQPAHRTHRAGAQRPVAARGRHLGRALPRAQHGAVQPHVRAPQRPRGHDRRRQAGPRPAGGADGQGAPGTPGRGGGWRRPAARCAPGTQGSITKEPVAPVHQALQALVSIADYRYPSTRRVREG

SEQ ID NO: 2988 - protein, 1112 aa, Lycopersicon pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISMIYILISTGNLRWLARIIEKLEHKIIMQRRKKQRGQRNYRRRNNHF

SEQ ID NO: 2989 - protein, 1112 aa, Lycopersicon pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIMQRRKKQRGQRNYRRRNNRF

SEQ ID NO: 2990 - protein, 1112 aa, Lycopersicon pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEKLEHKIIMQRRKKQRGQRNYRRRNNHF

SEQ ID NO: 2991 - protein, 1525 aa, Arabidopsis thaliana
MEERRDDESSPTHQGSELAERVKLLSFESQGEALSKDSPRSVEQDCSPGQRASQHLWDTGILSEPIPNGFYSVVPDKRVKELYNRLPTPSELHALGEEGVRIEVILVDFQKDKKLAMLKQLITTLVSGSGTNPALVIKKIAGTVSDFYKRPTLESPSKLALEENAFLFENHGAQLLGQIKRGCCRARAILFKVLADTVGLESRLVVGLPSDGTVNCMDSNKHMSVIVVLNSVELLVDLIRFPGQLVPRSAKAIFMSHISPAGESDSAENDSCDSPLEPNSPLYERRDPESTEKDENLQFYRKLEGYPNASGSSLRSLMLRPSTAIERKLSNTSHSEPNVATVFWRRSRRKVIAEQRTASSSPEHPSMRRGRSMLSTGRNSFRDYTGEASSPSSAVREMYEKSKQNRLLQGREDENSSVIDNNVSGLHLDDELNSKKTMSLPSSPHAYRCQTFGRRGPSEFAVKDTWNKVVESSTLQNQPLLPYQEWDIDFSELTVGTRVGIVFRGVWNGTDVAIKLFLEQDLTAENMEDFCNEISILSRVRHPNVVLFLGACTKPPRLSMITEYMELGSLYYLIHMSGQKKKLSWHRRLRMLRDICRGLMCIHRMKIVHRDLKSANCLVDKHWTVKICDFGLSRIMTDENMKDTSSAGTPEWMAPELIRNRPFTEKCDIFSLGVIMWELSTLRKPWEGVPPEKVVFAVAHEGSRLEIPDGPLSKLIAVNHNFCADCWAEPEERPNCEEILRGLLDYHENLEAIMRQVHSSVLIAVEQAETPNKIVLHMHPFCCVSDHSPSTPSFSMYAATPETPFGSARSQPNVLALPAAAREPPVDVKINDIAGNSIAGILYKWVNYGKGWRPRWFVLQDGVLSYYKIKGPDKIVVIHETEKGSRVIGEESTRMISRNKRHAATNNTNHQLRRKPFGEVHLKVSSIRESRSDDKRFSIFTGTKRLHLRAETREDREAWIEALQAVKDMFPRMSNCELMAPTNNLDISIEKLRLRLVEEGVSESAIQDCEQITRSEFSAIQSQLLLLKQKQWLLIDTLRQLETEKVDLENTVVDETQRQAGNGDSEETISESDDDNEQFDEAEEEMDTCDSLSSSSFKSIGSVFRTSSFSSDDDGLTNGFESENDDVDPSIKTIGFNYPHVKRRKKLPDPVEKEKSVSLWSMIKDNIGKDLTKVCLPVYFNEPLSSLQKCFEDLEYSYLLDQASEWGKRGNNLMRILNVAAFAVSGYASTEGRICKPFNPMLGETYEADYPDKGLRFFSEKVSHHPMIVACHCDGTGWKFWGDSNLKSKFWGRSIQLDPIGLLTLQFDDGEIVQWSKVTTSIYNLILGKLYCDHYGTMKIEGNGEYSCKLKFKEQSMIDRNPHQVQGIVEDKNGKTVARLFGKWDESIHYVMVDQGKVNESHLLWKRNKQPENPTKYNLTRFGITLNELTPGLKEKLPPTDSRLRPDQRYLEKGEYEMGNAEKLRLEQRQRQAREMQERGWKPKWFRKEKGSETYRYIGGYWEARDSGSWDDCPDIFGQVHQSIK

SEQ ID NO: 2992 - protein, 312 aa, Triticum aestivum
MEGSISGPSEKRVAVVTGGNRGMGLEICRQLAGHGLAVVLTARDDKRGAEAAETLREEGLSDVAFHQLEISEPASAARLAAFVKKKFGKLDILVNNAGVLGVTTDVGDPATLQETLAGKDGMERAEWLRQRTTQTTQDAEDCLRINYHGNKTVTEALLPLLRSSSDGRIVNVTSAWGLLRYFSGDELRRELDDVANLTTQRLDEMSDLFLEDLGKGNGALERRGWPADPVYAAYMASKALVCAYTRVIAREEGAALRVNCVHPGYVVTGMNDYTGVLTAAEGAAAAVAVALAEKGGVTGAYFDRTELGASFV

SEQ ID NO: 2993 - protein, 991 aa, Lycopersicon pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGVEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 2994 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTERGYSFTTTAEREIVRDMKEKLAYVALDFEQELDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 2995 - protein, 111 aa, Arabidopsis thaliana
  misc_feature (17)..(17): Xaa can be any naturally occurring amino acid
  misc_feature (106)..(106): Xaa can be any naturally occurring amino acid
  unsure (1)..(111): unsure at all Xaa locations
MSLRPLMSAFTGKFSVXVVGYACYIGTPGKGILAGDEFTGTNGKRVASINVENVETNRRYLRERLFTAPGALPCLSGVILFEETLYQKSSDGKLFVDILKEGGVLXPGIKV

SEQ ID NO: 2996 - protein, 389 aa, Azoarcus sp. EbN1
MKALCWHGKKDVRYDTVPDPRIEDPRDAIVKVTSCAICGSDLHLYDGFMMGMESGDILGHEFMGEVVEVGAADHRLKVGDRVVVPFTICCGECEQCRRGNFSVCERSNRNKALADKTFGHSTAGLFGYTHLTGGYAGGQAEYVRVPYADVAPVKITSGLSDDQVLFLGDILPTGWQAAVQCDIQPTDTVAIWGAGPVGQFAIRSAVLLGAKQVIAIDRVPERLGMAQAGGATTINCEDESVIERLNELTGGKGPEKCIDAVGMEAHATQSLDSLYDRAKQAIMLETDRPHVLREMIYVCRPAGTLSVPGVYGGLIDKLPFGALMNKGLTLRTGQTHVNRWTADLLRRIEEGQIDPTFVVTHVAALEDGPEMYKTFRDKKDGCIKVVLKP

SEQ ID NO: 2997 - protein, 109 aa, Arabidopsis thaliana
  misc_feature (10)..(10): Xaa can be any naturally occurring amino acid
  misc_feature (22)..(22): Xaa can be any naturally occurring amino acid
  misc_feature (43)..(43): Xaa can be any naturally occurring amino acid
  misc_feature (49)..(49): Xaa can be any naturally occurring amino acid
  unsure (1)..(109): unsure at all Xaa locations
MASSMLSSAXVGTAPAQATMVXPFTGLKSSAAFPVTRKTNKGXSSIASXWGRVSYIKVWPPIGKKKFETLSYLPDLSDVQFAKEVDLPFPHQGDSLVLLLLSHKHRIWN

SEQ ID NO: 2998 - protein, 353 aa, Leptospira interrogans serovar Copenhageni str. Fiocruz L1-130
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDITIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 2999 - protein, 272 aa, Methanosarcina barkeri str. fusaro
MVDQNQKIGFIGAGKMGSALMQGIIKAGIVKPENLGAADVYEPFLNDLKAKLGINISTDNSVIARASDILLLAVKPQTLGSVLENLKADITSDKLIISIAAGVPLATYENALPAGTRVIRVMPNIAATVSEAASGIAPGKNATPEDVKTALEIFSAVGTAVQVSESIMDAVTGLSGSGPAFIFPVIEAMADGAVLEGMDRKSALTLSAQTVLGAAKMMLETGLHPGELKDMVTSPAGTTIQGVHALEEAGVRAAFMNAVIRATERSKELGKK

SEQ ID NO: 3000 - protein, 332 aa, Zea mays
  misc_feature (182)..(182): Xaa can be any naturally occurring amino acid
  misc_feature (296)..(296): Xaa can be any naturally occurring amino acid
  misc_feature (302)..(302): Xaa can be any naturally occurring amino acid
  misc_feature (307)..(309): Xaa can be any naturally occurring amino acid
  misc_feature (313)..(313): Xaa can be any naturally occurring amino acid
  misc_feature (316)..(316): Xaa can be any naturally occurring amino acid
  misc_feature (318)..(318): Xaa can be any naturally occurring amino acid
  unsure (1)..(332): unsure at all Xaa locations
LKPETKLFRCRPSTPFHGVAFLVGLASLASLETIKKQVAIMYLWPKALEVPIMDPSKASKKPVGILLVKVVRAQNLRKKDLLGKSDPYVKLKMSDDKLPSKKTTVKRSNLNPEWDEEFKFVVTDPESQSLEVNVFDWEQVGKHEKMGMNMVPLKDLPPEETKFTTLNLLKTFFFFFLYPRPXPPQNEKSRGELTLKLTYKPFKEEDIEKEDTQGADVIEKAPDGTPAGGGLLYVVVHEAQDLEGKHHTNPYAKIIFKGEEKKTKVIKKNRDPRWEDEFEFVCEEPPVNDKLHVEVXSIALNXGLIHXXXNFGXYVXSXFQDVSCFNEVPSIL

SEQ ID NO: 3001 - protein, 152 aa, Coccidioides immitis RS
MSLEQTFIAIKPDGVQRGLVGPIISRFENRGYKLVAMKLVSPSKEHLEKHYADLSDKPFFKGLVTYMLSGPICAMVWEGRDAVKTGRTILGATNPLASAPGTIRGDYAIDVGRNVCHGSDSVENAKKEIALWFSEGELIKYKHSQHEWIYEA

SEQ ID NO: 3002 - protein, 418 aa, Oryza sativa (japonica cultivar-group)
MMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 3003 - protein, 107 aa, Arabidopsis thaliana
  misc_feature (106)..(106): Xaa can be any naturally occurring amino acid
  unsure (1)..(107): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFXY

SEQ ID NO: 3004 - protein, 385 aa, Dechloromonas aromatica RCB
MDTPIRIDSRFPNMGTTIFTVMSRLAAECGAVNLSQGFPDFQAEPALFDAMHRHMLAGRNQYAPMAGLPELRQAIADKVAALYGTRFDVESEVTVTAGATQAIFTAIAAFVRPGDEVLVFEPVYDSYVPAIETVGGTAVYAQLKFPDYTPDWAQVAGLISPKTRMIIVNSPHNPTGSLLTAADLDKLAELVRGTDIVILSDEVYEHILFDGEQHASLCGHPELAVRTIVVSSFGKTYHITGWKIGYVVGPAALMAEFRKVHQFNVFTVHAPSQLAIAEYMQDASRHLGLAAFYQEKRDFFRQLMAATPFELLPCRGTYFQLARYDRISDLPDRAFAEWMAREVGVAVIPVSVFNADGRDDKVVRFCFAKREETLRAAAERLCKAL

SEQ ID NO: 3005 - protein, 195 aa, Oryza sativa (japonica cultivar-group)
MAAAARWWVAAVVVAVAAMAGAAKGDFAADKAECADKLMALATCLTYVEEKATARAPTRDCCAGLGQVVAGSKKCLCVLVKDRDEPALGFRINVTRAMDLPSGCSIAATFSDCPKMLNMSPDSKEAEIFKQYAREHESNNATKPAPAAAAAATGSAGKATAATGDAGVGRRQRSSLAARAVAAAVLAAVFGLTVA

SEQ ID NO: 3006 - protein, 121 aa, Brassica napus
RSRPIQIRSASPRIQRDDRSAYSYTSNTPSLRSNYSFTARSGYSVCTTTTLPNYMAITESAKARIRSHSAPRQRPLTPEKDRAGSARKRLSYPVPVQPPVDYGDSNSQSLRSPSLKSIRGS

SEQ ID NO: 3007 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRRGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 3008 - protein, 386 aa, Bacillus thuringiensis serovar shandongiensis
HGHQANGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 3009 - protein, 323 aa, Aspergillus oryzae
MSLGRTFKLNSGYNIPAIGLGTWLSKPHEVENAVEAALRAGYRHIDAAACYQNENEVGNGWKKSGVPRDQIFITSKLWNTHHHPEHVEEAVNKTLKDLQTDYLDLYLIHWPVAFEHTNETLTPIDPVTKRFRLANVPIADTWAALEKLVEAKKIRSIGISNFTQDKIDDLLKTAKIPPAVNQIEAHPYLQQPGLHKYLKEKNILSVAYSPLGNNIYNAPRVVDDPDVKAIADKLGKDPAALLISWAVQRGTAVLPKSVTPSRIESNFQDFIIPDAEFEALNKLDRNQRYNFPFRWGIDVFGEVGAEETERRAEEHAAKQREGA

SEQ ID NO: 3010 - protein, 765 aa, Thermococcus kodakarensis KOD1
MKKGGLLLILLILVSIASGCISESNENQTATASTVPPTSVTPSQSSTPTTSTSTYGPSERTELKLPSVNYTPIYVGIEKGCPSGRVPVKFTYNPGNKTVKSVSLRGSFNNWGEWPMELKNGTWETTVCLRPGRYEYKYFINGQWVKDMSDDGTGRPYDPDADAYAPDGYGGKNAVRVVEGREAFYVEFDPRDPAYLSIADKRTVVRFEAKRDTVESAVLVTDHGNYTMKLQVWWDFGETWRAEMPVEPADYYILVTSSDGGKFAVLNTSESPFFHFDGVEGFPQLEWVSNGITYQIFPDRFNNGNKSNDALALDHDELILNQVNPGQPILSNWSDPITPLHCCHQYFGGDIKGITEKLDYLQSLGVTIIYINPIFLSGSAHGYDTYDYYRLDPKFGTEDELREFLDEAHRRGMRVIFDFVPNHCGIGNPAFLDVWEKGNESPYWDWFFVKKWPFKLGDGSAYVGWWGFGSLPKLNTANQEVREYLIGAALHWIEFGFDGIRVDVPNEVLDPGTFFPELRKAVKEKKPDAYLVGEIWTLSPEWVKGDRFDSLMNYALGRDILLNYAKGLLSGESAMKMMGRYYASYGENVVAMGFNLVDSHDTSRVLTDLGGGKLGDTPSNESIQRLKLLSTLLYALPGTPVTFQGDERGLLGDKGHYDEQRYPIQWDTVNEDVLNHYRALAELRKRVPALRSSAMRFYTAKGGVMAFFRGHHDEVLVVANSWKKPALLELPEGEWKVIWPEDFSPELLRGTVEVPAIGIIILERG

SEQ ID NO: 3011 - protein, 1566 aa, Oryza sativa
  misc_feature (73)..(73): Xaa can be any naturally occurring amino acid
  misc_feature (113)..(113): Xaa can be any naturally occurring amino acid
  misc_feature (135)..(135): Xaa can be any naturally occurring amino acid
  unsure (1)..(1566): unsure at all Xaa locations
MDVDSRMTTESDSDSDAAAQGGGGGGFGSETSSASPSAPGTPTAMGAGGGAAPIAAAAIAAAASAAVVAGPRXAPGYTVVNAAMEKKEDGPGCRCGHTLTAVPAVGEEGAPGXAGATADVHCYDVSSNKWSSKCXRLTPVGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVVFVNARLHVSGGALGGGRMVEDSSSVAVLDTAAGVWCDTKSVVTTPRTGRYSADAAGGDASVELTRRCRHAAAAVGDMIYVYGGLRGGVLLDDLLVAEDLAAAETTNAANQAAAIAAASDIQAGREPGRYAYNDEQTGQPATITSPDGAVVLGTPVAAPVNGDMYTDISPENAVIQGQRRMSKGVDYLVEASAAEAEAISATLAAVKARQVNGEAEHSPDREQSPDATPSVKQNASLIKPDYALSNNSTPPPGVRLHHRAVVVAAETGGALGGMVRQLSIDQFENEGRRVIYGTPESATAARKLLDRQMSINSVPKKVIASLLKPRGWKPPVRRQFFLDCNEIADLCDSAERIFSSEPSVLQLKAPIKIFGDLHGQFGDLMRLFDEYGAPSTAGDIAYIDYLFLGDYVDRGQHSLETITLLLALKVEYPLNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGTANNAGAILVLGRDLVVVPKLIHPLPPAITSPETSPEHHLEDTWMQILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 3012 - protein, 448 aa, Arabidopsis thaliana
MGEYCNEDLSCFPANELRFSKHVHDNVHGNIYLDPLCLKFIDTEQFQRLRELKQLGVTNMVYPGAVHSRFEHSLGVYWLAGETVQRLKTFQGMELGIDNHDLQTVRLAGLLHDIGHGPFSHMFEREFLPKVISGCQWSHELMSINMIDYIVDTHHIDVDAKMLKRVKDMILASTEVSELKGNAEKRFLYDIVANGRNGIDVDKFDYIVRDSRACGLGCNFQFQRLTEPMRVIDNEICYPAKEYRTVHKLFATRADLCGTVYMHPKKMAIELMIVDAMVKANNVLEISSMINDPSQYWKLDDTILKTIERSPDPELAEAKELILRLSRRHLYQFCNEYAVPKDKIDHFKPITPEDIICFSEEDIAVTNVKIDLARGRENPLECINFYKDYNSAEKFVIPEDRVSHLLPTTYQEMIVRVYAKKPELVEAVSEAFENFQMRTYGIKAQVLM

SEQ ID NO: 3013 - protein, 870 aa, Coccidioides immitis RS
MGAPISELQGPVGPGFSRPKHKRTFTGFGPRDIKKVVASIPEPQRQAWRKFAPQAFKTKEEFEKEVVRHVETTLARSLFNCDELAAYSGTALAFRDRLVIDWNKTQQRHTFADQKRVYYLSLEFLMGRALDNAMLNVGLKDVAKDGLSDLGFRIEDVIDQENDAALGNGGLGRLAACLLDSLASMNYPAWGYGLRYRYGIFKQEIVNGYQIEVPDYWLDFNPWEFPRHDVTVDIQFYGEDKKYHDQTGKLVHSWEDGEIVQAVAYDVPIPGYDTPTTNNLRLWSSKAASGEFDFQKFNAGDYESAVADQQQAETISAVLYPNDNLQRGKELRLKQQYFWCAASLFDIVRRFKKTKRPWSEFSHQVAIQLNDTHPTLAIVELQRILVDQEGLDWDEAWGIVQGTFGYTNHTVLPEALEKWSVDLIRHLLPRHLSIIFDINLGFLQWVEKTFPNDRDLLTRVSIIEESSPKMVRMAHLAIIGSHKVNGVAELHSDLIKTTIFKDFVEIYGPDKFTNVTNGITPRRWLHQANRRLSDLIASKLGGYEFLKDLTLLDKLERYLDDKEFKKQWAEAKYQNKVRLTKHIYDTTRVRVNPEALFDIQVKRIHEYKRQQLNIFGVIHRYLKIKAMTPEERKKVVPRVSIFGGKAAPGYWMAKTIIHLINKVGEVVNNDPEIGDLLKVIFIEDYNVSKAEMICPASDISEHISTAGMEASGTSNMKFVLNGGLIIGTCDGANIEITREVGEQNIFLFGNLAEDVDDLRHAHVYNPSSIEFDPDLRAVFDCILSGKFGSAEEFSAIIDSIVDHGDYYLVSDDFHSYIETQGLVDDAYKNQDGWVEKCIQSVARMGFFSSDRVISEYAESIWNVEPVEVNE

SEQ ID NO: 3014 - protein, 583 aa, Burkholderia pseudomallei K96243
MPHDVSLIALLAAGFGLAMIFGYLASLLKMPPLVGYLLAGIVMGPGTPGFVGDLALAQQLAEIGVMLLMFGVGLHFSLGDLLSVRKIALPGAIVQIAAATALGAGLALWWGWSVGGALVFGLSLSVASTVVLLRALEGRGLIESVNGRIAVGWLVVEDLVMVLVLVLLPPLAALLGGGGAPAHGDAAVHAGEAGGSLWAALGVTLLKVAAFVALMLVVGKRVFPRILWLVARTGSRELFTLCMIAAAVGVAFGAAKLFDVSFALGAFFAGMMMRESEFSRRAADETLPLRDAFSVLFFISVGMLFDPRVLIDEPLHVLEVAAIVVLGKTLAAVALVLAFRYPLNTALTVGVSLAQIGEFSFILASLGRGLGLLSAEGQSLILAVALLSIALNTLLFAAVDPVLAWIRKRSAFARRLESRDDPLAALPMSTPQAHLTGQVVIVGYGRVGTRIAHALDARGIAYVVVEQNRETVEKLRADGVAAVSGDAVEPIVLVQAHIARAGMLVVTLPDVFDVRQIVDISRTLNPAIEIALCTNSDEEAALLANEGMGEVFVSETELAHGMTEHVLARMGAGEAHARRSAAH

SEQ ID NO: 3015 - protein, 435 aa, Sinorhizobium meliloti
MTLDLSTFAREKGVKYFMISYTDLFGGQRAKLVPAEAIADMQKGGAGFAGFATWFDLTPAHPDLFALPDASAVIQLPWKKDVAWVAADCIMDDAPVEQAPRVVLKKLVAEAAQEGLRVKTGVEPEFFLISPDGSKISDTFDTAEKPCYDQQAIMRRYDVIAEICDYMLELGWKPYQNDHEDANGQFEMNWEYDDALRTADKHSFFKFMVKSIAEKHGLRATFMPKPFKGLTGNGCHCHISVWDLAGEVNAFADNKAEFGLSAEGRHFLGGIMKHASALAAVTNPTVNSYKRINAPRTISGATWAPNSVTWTGNNRTHMVRVPGPGRFELRLPDGAVNPYLLQAIIIAAGLSGVRSKADPGRHYDIDMYKDGHKVTDAPKLPLNLLDALREYNRDEELQEALGREFSAAYLKLKQGEWNTYCSQFTEWEHQTTLDV

SEQ ID NO: 3016 - protein, 727 aa, Zea mays
  misc_feature (114)..(114): Xaa can be any naturally occurring amino acid
  unsure (1)..(727): unsure at all Xaa locations
MSIAAVSADGLLALADEAERRYDFSAAAACLESALRPPYAAALLPLTEARARLRLASLLLAPRGSSRVPRAGAPAAAKTHLERALLILSPLPSAPPRLKLLAHSHLAGAYAVLXAIASRKNVLHRGLGLLDSASASGLLQREPALLWTCNFQAQLGSVFTNDGDAASALSALSVGASAAAELGSPQLELFFAASELHVHLLCWEDSAAVENAVTRASLLWDALTAEQMEHWVGLFFYTQLLQTFYLLRICDYKAASQHVERLDTAVKSEMQRGRQITALANDLSTLERTLGQSGLKEREMLALSHKQRQLKGQLRALCGYDSLNDVLDYGDKLLLAPPLMHGEWLPRTAVFVLVDLMVVMVGRPKGIFKECGKRINSGLRLIHDELVKLGIVDGVMEADLEHSTIWTAGLYLILLLQFLENKVAVELTRSEFVEAQEALAQMKNWFTRFPTILQGCESIIENLRGQYAHSVGCFDEAAFHFLEAKKLTESKSMQSMCETYAAVSYICKGDAESSSQALELVGPAYRTMDSFVGVREKTCIIFVYGLLLMRQHNPQEARNRLASGLKIAHQQLGNIQLVSQYLTILGTLALQLHDAAQAKEILKSSLTLAKTLFDIPTQIWILSVFTELYRELEEKENEMENSEYEGKKEDDLQRRLSEAYSHSFHHELVEKSRIQPLHMSSKQPEMAVPSANGDLDIPESVGLSAPQPFLKRLVEAEPMRRSTRRRR

SEQ ID NO: 3017 - protein, 327 aa, Sulfitobacter sp. EE-36
MTAPTLRRYLTQNSFDPDLVFLLEDIASASRLIAGLVRRGAFEGNLGAAGEINVQGEAQKTLDIMANDVFERECANSPRVAALVSEEVEEVTWLKEPQKGDYLLYFDPLDGSSNLDVNLSVGSIFSVMQVQADGDRNVLHNGRNQICAGYAIYGPSTMFVVTKGDEVAGFSSDPDTGEFSLTHPKMTVPAETSEYAINTSRARYWYAPVSRYVDEAIAGKEGPRGRSFNMRWTASMVADVHRILTRGGVFLYPADSNNQKTGGKLRLMYEANPMAMVIEAAGGAASTGQGAIMDVAPTAPHQRVPVILGSRDEVAVLDSYHKDAADS

SEQ ID NO: 3018 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 3019 - protein, 73 aa, Arabidopsis thaliana
GVIKYGRKLIGAPDPQKFEPGTIRGDLPVSVGRNIIHGSDGPKTPKDEISLWFNPQELVFSTSNFEKGLYGDK

SEQ ID NO: 3020 - protein, 420 aa, Acidovorax sp. JS42
MCPSPHACPHMKPIRKSAKLNNVLYDVRGPIVDAAKQMEDEGQKIIKLNIGNLAPFGFDAPEEIQQDMIRNLPNSAGYSDSKGIFAARKAVMHYSQQQGVAGVTLDDIYLGNGASDLITMATNALLDDGDELLVPAPDYPLWTAAASLSGGRPVHYLCDEDNGWMPSLTDIRAKITPRTRGIVVINPNNPTGALYSDELLKGIVQIAREHNLVLFADEVYDKVLYDGVKHTAMASLSTDVVTLTFNSLSKAYRSCGYRAGWMVISGDKTAARDYIEGINMLANIKLGSNVPGQWAIQTALGGYQSINDLVKPGGRLCRQRDLAYELITAIPGVTCVKPQAALYMFPRLDPEMYPIADDRQFFMEVLRATRVMLVQGSGFNYPDNQHFRIVFLPHEDDLREAIGRLAGFLAAYRQRHAKAA

SEQ ID NO: 3021 - protein, 111 aa, Actinobacillus actinomycetemcomitans
HLKYTHPALAIPELMRILIDEDRFRMQKAWDTTRRIFSYTCHTLMSEALETWPVEMMAKILPAHLQMIFEINDHSSICENLHHYRYDFIRRVSLVEEGDQRKVRMGWLSVV

SEQ ID NO: 3022 - protein, 557 aa, Pediococcus pentosaceus
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPRFKRSRQDRTNQYRDFYFWRSGNGKKAPNNWEAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADQHELDMVFEFQHLRLDNSQHGLGKWSTRKTPLVALKKVISDWQVGLEGRAWNSLFWNNHDTPRAVSRFGDDRPAYRVRSAKMLATCLHLLQGTPYIYQGEELGMTDAHFTELASYRDIESLSAYRDLVTERQLLSPADMMARLAAASRDNSRTPMQWDTEVNAGFSDAAPWLTVNPNYRQINAAAALADPDSVWYYYQHLIQLRHQYPSVTLGSFELLWADDPQYSYMHGNGKADLASLLQFHSRDTVPTTGSISDPTAKCLISNYGEQQPNKLRPYEAWVYQLA

SEQ ID NO: 3023 - protein, 392 aa, Desulfovibrio desulfuricans G20
MTQTRRVARRVQQIRISATKLMPMLAARIGGCVSLGQGVPSFSTPPHIVDAVCRVLRDDPSAGKYSLQPGMPALRQAIAEHLTAAKGFAADPDSEVAVTVGAMEALLMALLTVVDRGDEVIIPSPGYASHAEQVLMAEGVPVHVPLRPADWGLDVEAVRAAVTERTRAVIVCNPGNPTGTVYADEDVRALCRLALEHNLVLISDETYDYMVFGGHAAPLSPASLPEMRENVIVINSFSKKYALTGWRVGYAAASAGWMGEMLKVHDATAICAPTVSQHAALAALTGPQDCVEQMCAALEKRRSLTMDRMAALAPAFTCVPPRGAFYVMARYSCTPEPSPEVARRILEEARVITVPGASFGPAGENHLRLSFGADEAELTECFDRLQRWAERQ

SEQ ID NO: 3024 - protein, 498 aa, Aspergillus oryzae
MGHTVPPLKDQSLFIEKAYVNGEWVGAQSGETFEVHDPASGKLIGTCPEFNAADTEKAIQAATEAFPKFRTTLARERARMLRRWYQLMIDNAEDLATLITWENGKPLADAKGEVNYAAAFFEWFSEEAPRIYGDTIPSSVAGNRVMTLKQPVGVCSLITPWNFPAAMITRKAGPALAAGCTVVVKTPGETPFTANALAELAHRAGIPKGVFNIVTSLKNTPEVGEALTTHPEVRKVSFTGSTNVGKLLMKQSSSTVKKVSWELGGNAPFIVFDDVEDLDAAVAGAVASKFRSSGQTCVCANRIYVQRGIYDEFVKRFVEKVKGFKVGAGFEEGVTHGPVIHGRAIEKIDEHVRDAESKGAKVAVGGRKLSDLGPNFYDMTVLTDMNKDMLVASEETFGPVAGLFPFETEKEVVDLANRAEVGLAGYFFSGNVKRIFRVAEALEVGMVGVNTGLISDVASPFGGVKQSGFGREGSKYGIDEFLTIKSVTFGGMGEPLQS

SEQ ID NO: 3025 - protein, 310 aa, Agrobacterium tumefaciens str. C58
MRKLWKRPEMTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 3026 - protein, 468 aa, Pseudomonas syringae pv. syringae B728a
MSKSVQLIKDHDVKWIDLRFTDTKGKQQHVTMPARDALEDDFFEVGKMFDGSSIAGWKGIEASDMILLPDDETALLDPFTEEPTLVLVCDVIEPSTMQGYDRDPRAIAHRAEEYLKSTGIGDTVFVGPEPEFFIFDEVKFKSDISGSMFKIFSEQASWMTDGDVDGGNKGHRPGVKGGYFPLPPVDHDHEIRTAMCNALEEMGQTVEVHHHEVATAGQNEIGVKFNTLVKKADEVQTLKYCVHNVADAYGRTATFMPKPLYGDNGSGMHVHMSISKDGKNTFAGEGYAGLSDTALYFIGGIIKHGKALNGFTNPSTNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIELKSEEEIKVRTFVHPLEYELYYSC

SEQ ID NO: 3027 - protein, 476 aa, Campylobacter jejuni RM1221
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAMEHLKNSGIADTAYFGPENEFFVFDSVKIVDTAHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 3028 - protein, 232 aa, Thermococcus kodakarensis KOD1
MEWNVIRLDEVDSTNEYAKKLIPDVSEGTVVVAKRQTSGRGRKGRAWASPEGGLWMSVILKPPMIDPRLVFVGALAVSDTLRDFGIGAWIKWPNDVWVGNRKISGVLTEVKGDFVIMGVGLNVNNEIPDGLKETATSMMEALGEPVDIGEVLERLLEYLGRWYKTFLENPPLVVEEVRGRTMLIGKEVRVLLDGNDLVGRVITISDDGSLILDVDGQTVKVVYGDVSVRINR

SEQ ID NO: 3029 - protein, 255 aa, Mycoplasma genitalium G37
MKKIHDQLKKLSSQIDGIIEIVDARAPTLTHNSEIISYFLNKPKLILALKTDLAQYKPNKKILFGSLKEPFKLKKKVLKTLTTLFANKRQQLKAKGLLIKQFRLAVIGMPNVGKSSLINLLINKNHLKVANRAGITKSLNWIQISPELLLSDTPGVFLKRIDEIQIGYKLVLTNVIRREVVNIEEVGMFAFNYLKKHYKQLLPFEADSFINFLEKFAKVRGLIKKANELNTNLACEIFINELINGKYGKLSYELN

SEQ ID NO: 3030 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGGDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 3031 - protein, 409 aa, Bradyrhizobium sp. BTAi1
MNVLAKQPSPFKPAQRLSAIGVSEILKVTGLAAQMKREGQNVIILGAGEPDFDTPEPIKDAAARAMRDGATKYTALDGSPELKAAIRAKFKRDNGLDFAQDEITVSAGAKQVLFNAMMATLDPGDEVIIPTPFWVTYADIVAIAGGTPVLVPCSEANGFRLSPEDLARAITPRTRWLMLNSPSNPSGAAYSEHQYRPILDVLLKHPSVWLMVDDIYEHIVYDGFRFVTPVAIEPALRNRTLTVNGVSKAYAMTGWRIGYGAGPSALIKAMAVVQSQSTSCPSSISQAAAIEALTGPQDVIADRCRSFQQRRDLVVDALNSIEGISCCVPEGAFYTFASCAGLIGRTTPDGRVVEDDTVFADYLLRAAGVAVIPGSAFGLAPYFRISYATSAAELRDACQRIAAAAARLL

SEQ ID NO: 3032 - protein, 399 aa, Rhodomonas salina
MVLRNQLDHSKNIKNFTVNFGPQHPAAHGVLRLILELNGETIIKADPHIGLLHRGTEKLIENKTYIQGLPYFDRLDYVSMMINEHAFCLAIERLLNIEVPLRAQFIRVIFSEITRILNHLLAICCHAMDVGALTPILWGFEEREKLMEFYERVSGARMHAAYFRPGGVSQDLPLGLCADIFKFCEQFSSRIDELEELLTENRIWKQRLVDVGVITFEQALNLGLTGPLLRSTGFSWDLRRTHPYEIYDKLDFDIPIGKNGDSYDRYCIRIEEMRQSLSIIVQCLNNMPQGSFKVNNMKISPPSRVDMKRSMESLIHHFKYFSEGFTIPKGIVYAAVEHPKGEFGVSLVTDGTNKPYRCKIKAPGFIHLQALDFLSRGHLLADLVTIIGTLDIVFGEIDR

SEQ ID NO: 3033 - protein, 754 aa, Streptococcus pyogenes MGAS315
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSISSLGINGEGVGLNYHCGLFKQVFKHNEQEAEPNYWIEDDSWLVPTDISYDVPFKNFTLKSRLDRIDVLGYKRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWITKVVHNIAKAGFFSSDRTIEQYNEDIWHSR

SEQ ID NO: 3034 - protein, 352 aa, Leptospira interrogans serovar Copenhageni str. Fiocruz L1-130
MNRVLTYLSPGELDWREMPRPILSHPEDAIVRPVASSTCDLDIMIIQGRTPFKGPFDIGHECIGEIIETGEGVRRFYPGQLVVVSWHISCGQCHRCRKGLMNTCASYPQGAMFGMSIGGKWGGFFSDFIRVPNADISLFVLPPGINPSYVASLSDNIPFGYELTVPHLTRNCGVDVLIMGGTGSIGLFAAAYAKAGGAGSVDYVDTNKMRLGIAEKIGVNPIESPPKQRIGRRPGKYPITVDTSGSSEGLLCAIRSTEPEGYCSSIGGHFGDIAFPMLEMYAKGIHFYTGRGLGRINFEAATDFIISGKVKPELIVTEERPFDEAAEVLRDPSMKPVLVRQTMLSKAYQPKV

SEQ ID NO: 3035 - protein, 372 aa, Chenopodium rubrum
MAPSFDLLCAEDNSSIFDEVDDNYYGVVDDDVLQICNLQQQHGNLRNFDDFTLILLIIIKEHNFEALISGFFVANHECLASLFDNERQHFLGLDYLKRFRNGDLDLGARNLVIDWIHKVQSHYNFGPLCVYLSVNYLDRFLSAYELPGKAWMMQLLGVACLSLAAKVDETDVPLILDLQVSESKFVFEAKTIQRMELLVLSTLKWRMQSVTPFSFIDYFLYKLSGDKMPSKSLIFQAIQLILSTIKGIDLMEFRPSEIAAAVAISVTQQTQIVEFTDKAFSFLTDHVEKERLMKCVEIMHDLRMSSRSNGALASTSVPQSPIGVLDASACLSYKSDDTSTTPSGSCGNSAHSSPASAPPPKRRKLDRTSQIS

SEQ ID NO: 3036 - protein, 189 aa, Glycine max
MNVSHASVHPVEEAPTTEGGGADQNVNAPRVRMKDIQGMPGTAGGLSLRVSQFVFAAAALSIMASTSDFPSVTAFCYLVAAAGLQAMWSFSLAITDVYALLVRRSLQNYRIVSLFTIGDGLVSSIQVTSTLTFAAACASAGITILIDNDLGNCSQNHCVQFETATGMAFICWFTTVPSFLLNFWSLASR

SEQ ID NO: 3037 - protein, 207 aa, Oryza sativa (japonica cultivar-group)
MEHHRHRGAVVLVVAAAAMAMAMSAVRGDFAADRAECADKLMALSTCLTFVQDGASGGAAAPTPDCCSGLKAVLAASRKCLCVLIKDRDDPNLGLKINVTKALSLPQLCNAPANISDCPRLLNLPPNSKDAQIFEQFAKQQAAMQGSPSASPGGSSAPAAGAQKSGAAVLRWLGVDGVGGGGARAVALLLFLLSSAVAVAAPLLLVF

SEQ ID NO: 3038 - protein, 394 aa, Triticum aestivum
MTTRNGQIKNFTSNSGPQHPAAHGVSRSVLEMNGEVVERAEPHIGSLHRGTEKLIEYKTYLQALPYFDRLDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSVRIIVQCPNQMPSGMIKADDRKLCPPSRSRMKLSMESSIHHFELYTEGFSVPAPSTYTAVEAPKGEFGVFLVSNGSNRPYRCKIRAPGFAHSQGLDSMSKHHMPADVVTIIGTQDIVFGEVDR

SEQ ID NO: 3039 - protein, 174 aa, Candida albicans SC5314
MAEKRLFKEYNQYQKHLPQLNNDQIVSLSPLSPDKNILLWEATIAKPTRKDSPYYYGGQWKLSINVPTSYPIDPPTIKFVTPIVHPNINLGSGEICLDILKKESWSPAWNLEHLVVAILMLLDQPEPDSPLNIDAANLYRQDKVAYESIVQFNIWKHNNFYSAFVRDTSGVRSL

SEQ ID NO: 3040 - protein, 120 aa, Glycine max
  misc_feature (58)..(58): Xaa can be any naturally occurring amino acid
  misc_feature (88)..(88): Xaa can be any naturally occurring amino acid
  misc_feature (92)..(92): Xaa can be any naturally occurring amino acid
  unsure (1)..(120): unsure at all Xaa locations
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 3041 - protein, 343 aa, Solibacter usitatus Ellin6076
MNALLLTQYMHLEMVEMPVPAIGADDVLVRVRACGICGSDVHGLDGKTGRRIPPLVMGHEAAGEVVETGANVTDLRPGDRVTFDSTVYCGRCFHCTRGEVNLCDNREVLGVSPGPYRRHGAFAEYVSVPRRIMYRLPDSLSYEQAALIEAVSVAVHAVNLTPVRLGDSAVVVGSGMIGLLAMQAAKHAGCTRVIAVDPDEGRLRLAIGAGATDAINPKSTDAAAAIRELTEGRGADLAIECVGATDPIRTAIAGVRKGGAVTLVGNVAPEIEFPLQSVVTRQIRLQGSCASNGEYPACIDMMARGAIRVDELITAVAPLEEGPSWFDRLYRHEPHLMKVILRP

SEQ ID NO: 3042 - protein, 222 aa, Zea mays
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGLGVPNDIDMIAFDLVPQR

SEQ ID NO: 3043 - protein, 591 aa, Listeria monocytogenes str. 4b H7858
MEKAGIYHQPASSYAYSYDAKTLHIRIRTKRLDISEVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVGNTIWYQIFPERFANGNPAISPENALPWGSKDPNTTDFFGGDIEGIIEHLDYLAELGINGVYLTPVFEAPTNHKYDTVDYKKIDPHFGDKETFRKLVQEAHKRGIRIMLDAVFNHIGDTSAEWQDVVLNEEKSAYRDWFHIHSFPVRQNENGNIEGEPTLSYDTFAFTTHMPKLNTANPEVQKYLLDIATYWIREFDIDGWRLDVANEVDHAFWKEFKKAVQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDETKQNQDMLAFTKQLIALRKDNQAIITSGELTWLGASSETGITAFSKELNGEKLHFLFNQAKEDKDFTISFENTATDIWNNRAVTENLVVPAKGFLVVKENS

SEQ ID NO: 3044 - protein, 274 aa, Zea mays
VSIDELNHILDEVNAHILPSRNDLTPVTTIAGGSVANTIRGLSAGFGISTGIIGACGDDNQGLLFVNNMSFSGVDLTRLRAKKGHTAQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVVRVPAIGESNAVDTTGAGDLFASGFLYGLVKGLPLEECCKVGACSGGSVTRALGGEVRPENWQWMYKQMHARGLLLPELKN

SEQ ID NO: 3045 - protein, 486 aa, Pseudoalteromonas tunicata D2
MIMFLPIILAGGCGTRLWPLSRGNFPKQFLTIQDDGLSLLQHTITRLKGLNHAAPMLICNEEHRFIAAEQVRQLGCGHSGIFLEPVGRNTAPAIALAALKAVQNNDDAVLLVLAADHVIEDSAAFVASVEQASILAEQGKLVTFGIVAKNPETGYGYIQRGAALPQGTGFTVAGFVEKPNLATAERYLAENADLAHGEDKWYWNSGMFMFKASRYLAALLEYRPDIYHACVAAMANQDVDHDFVRINKAAFIACPDDSIDYAVMEPLCANADSEDVVVVPMDAGWNDVGGFAALWQVSEQDENGNAFKGDVKAFDTKNTLVFGEDKLVATVGVEDLVIINTKDAVLVAHKDKSQQVKEIVNQLKAEQRPEVTFHREVYRPWGKYDSIDSGSRFQVKRITVKPGEKLSIQMHHHRAEHWIVVSGTAKVTNGDKDILLTENQSTYIPVGVIHALENPGKVDLELIEVQSGSYLGEDDIVRFEDRYGRK

SEQ ID NO: 3046 - protein, 442 aa, Desulfotalea psychrophila LSv54
MTREEIMKIVEEENIQYFRLQFVDILGHMKNVAVPKSQIGKALDGQMMFDGSSIDGFVRINESDMYLKPDYNTFCVLPWRNKNGRGVARIICDVHKADETPFEGCPRVNLKRVLAEAKELGYTMNVGTEAEFFLFEQDEKGRATTITNDVANYFSLDPEDSGNDCRREIIETLEKMGFEIEASHHEVAEGQHEISFKYADALATADNTVTFKWVVKSIARQYGLHATFMPKPIFGVNGSGMHTNQSLFNIDGTNAFFDESDPLQLSPVAYSYIAGSLKHALVCTAVNNPLVNSYKRLVPGYEAPVYAAWSASNRSALVRIPASRGLSTRTEMRSPDPSCNPYLALAMQLNAGLDGVRNNATPPAAVDQDIFSMSNAEMDEVGIKVLPGSLKEAVDELKGSPLAKETLGAHIFEKFIEAKEKEWESYRIAVTNWEIEEYLNVY

SEQ ID NO: 3047 - protein, 526 aa, Aspergillus niger
MAASSSLDHLSNRMKLEWHSKLNTEMVPSKNFRRTSIIGTIGPKTNSVEKINSLRTAGLNVVRMNFSHGSYQYHQSVIDNAREAAKTQVGRPLAIALDTKGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTSGKTARYLSKYRPVCPIVMVTRNPAASRYSHLYRGVWPFLFPEKKPDFNVKVWQEDVDRRLKWGINHALKLGIINKGDNIVCVQGWRGGMGHTNTVRVVPAEENLGLAE

SEQ ID NO: 3048 - protein, 485 aa, Propionibacterium acnes KPA171202
MMTNDRSLPSDLPTQLLIDGEWVDAEASRTFDVINPATEKPLVAIADASVDQGTDALDAAVRAQHSWADTAPRERAEILRKTFNLVTERKDDFARLMTLEMGKPLAESYGEVTYGSEFLRWFSEEAVRIRGDYGLLPEGNIRQLVTKRPVGPCLFITPWNFPLAMATRKIAPALAAGCTVVIRPASATPLTTLLLAKTFLEAGLPAGVLNVITGLDHAVTDAILEDPRLRKLSFTGSTGVGANLLGKAAKHVLRTSMELGGNAPFIVFDDADLDQAIIGAKGAKMRNMGEVCIAANRFIVHESVAEEFTDKMIEMMSGLVVGDGLDEKSEVGPMITERDREKVDGLVRSAIEAGATLRCGGEIPEDKGWFYPPTVLSGVPADAEIMQTEIFGPVAPITTFRTEEEALALANSVPVGLAGYVFTSDTARILRMGQKLETGMIGANLGVFSNAAAPFGGVKESGLGREGSYQGIEEFLETIYVALPA

SEQ ID NO: 3049 - protein, 468 aa, Acidovorax sp. JS42
MCCPTACSGPSPTMRTPTTTYLPPRSWRASICHPMTHNTDLNLPLFERAKALIPGGVNSPVRAFRAVGGTPRFITRAQGAYMWDANGQRFIDYIGSWGPMILGHGHPAVLEAVQKAALEGFSFGAPTEREVELAEEIIRHVPSMEMIRLVSSGTEAGMSAIRLARGATRRNKIIKFNGCYHGHADSLLVKAGSGLATFGHATSAGVPQEVVQHTLVLEYNDVAQLEEAFTLHGPDVACVIMEPIAGNMNFVRASVPFMRRARELCTQHGALLVIDEVMTGFRVALGGAQSLYAQAIPGFKPDITVLGKVIGGGMPLAAFGGSRAVMEQLAPLGPVYQAGTLSGNPVATACGLATLREIAKPGFYDALGARTRALIDGLAGAASAAGVPLCGDTQGGMFGFFLLPQLPQNYPEVLNTDGMRFNTLFHGLLDGGVYIAPALYEAGFVSAAHTEQDIADTVAVARDVFQKL

SEQ ID NO: 3050 - protein, 788 aa, Propionibacterium acnes KPA171202
MTQDLASAIAFQVRSTSGRSVTASTPMEVWQGLSACVVGRIADDWQATDAAYKAERQEHYFSAEFLMGRALLNNLSNLGLVNETREALASFGIDLSEVLEQEPDAALGNGGLGRLAACFLDSCATLELPVTGYGILYRYGLFKQLFDNGFQTEHPDPWMEEGYPFVIRREEQQRIVRYADMWVRAIPHDMPITGYGTRNVGTLRLWKAEPMEQFDYQAFNSQRFTDAIVERERTSDISRVLYPNDTTFEGKVLRVRQQYFFCSASLQEIVDNYIEHHGEDLTGFAKYNSIQLNDTHPVLSIPELMRILLDEHGMGWDEAWEVVTHTFAYTNHTVLAEALEKWEMQIFDRLFPRISEIVREIDRRFREDMNKRGVDGQTIEYMAPVSGNQVRMAWIACYASYSINGVAALHTEIIKRETLKEWHAIWPQRFNNKTNGVTPRRWLNQCNPRLASLLSEVTGSDTWVKDLSVLANYTDSVDESVYDRINEIKHANKVDFAAWVAEREGVKIDPDAIFDVQIKRLHEYKRQLLNAFYVLDLYFRIKDDPSLNVPKRVFVFGAKAAPGYIRAKAIIKFINEVARLVNNDEDINGRIKVVFIHNYNVSPAEHIIPAADVSEQISMAGKEASGTSNMKFMMNGALTLGTLDGANVEILDAVGDDNAYIFGATEEQLPSLKRDYDPRWHYENVPGLKRVIDTLTDGTLDDNGSGWFHDLRQSLMEPGWEVPDVYYVLGDFASYRDVKDKMAADHADARGWARKAWVNVTKSGRFSSDRTIRDYAEQVWKLEPVRAE

SEQ ID NO: 3051 - protein, 685 aa, Saccharomyces cerevisiae
MSLTPTNEILFHYKSSVKVGELERYVITYHLYDGEEIPPDLNLNSLWLKVRNMNPLSYRAAYLMGPFMLYCDVKTAQYHHSQKIVASVDYPKFEPNVQTQQDFVAELSVHNIRQKYVWIADVMSQILFTTNTNVTYEVTIGTSKESVENPHDLPSHLGSYSPKLTVNRLTTLDLWNLPVQITTPQKKKHLVVLTHGLHSNVSTDLVYIMEQIYKAQKNYPHEQIVVKGYRGNVCQTEKGVKYLGTRLAEYIIQDLYDESIRKISFVGHSLGGLIQAFAIAYIYEVYPWFFKKVNPINFITLASPLLGIVTDNPAYIKVLLSFGVIGKTGQDLGLENDVEVGKPLLYLLSGLPLIEILRRFKRRTVYANAINDGIVPLYTASLLFLDYNDILEQLQKLKENSKKSPLINDASTPVNQDFFNKTFISPLTKMLSILAPQKFPTENGSEIPKVSFFESASSILLPPLPERAYIMDPDSRDPVIIHDKIYNEDDIPQSEFDIEDGFFGKKNILLQAFSAGKKERAKYRNLEETIARRWHEGMAWRKVVVALKPDAHNNIIVRRKFANAYGWPVIDHLIDVHFNGDDDDDNDENDDINSTQVVEPIQSVTEGKKKYRKAENIPQEYGWLNKVETNGVFDEGPTGMISTVGEIVEALAKRGFSAVIDRRNASEDPNDEVLRFEEMNSDLVQ

SEQ ID NO: 3052 - protein, 226 aa, Bordetella bronchiseptica RB50
MLTQQELKQQAAEAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 3053 - protein, 398 aa, Burkholderia sp. 383
MSSNRGVVYLGPGQVEVQKIDYPKMVDPSGRAIGHGVILKVVSTNICGSDQHMVRGRTTAPVGLVLGHEITGEVVEIGRDVETLKLGDLVSVPFNVACGRCAMCKDTHTGVCLNVNPSRAGGAYGYVDMGGWIGGQAEYVLVPYADFNLLKFPDRDQAMSKIRDLTCLSDILPTGYHGAVSAGVKPGSTVYIAGAGPVGMAAAASARLLGAAVTIVGDMNAERLAHARAMGFETVDLSKDASLGEQIEQILGVPEIDCAVDCVGFEAHGHGSSGHSEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 3054 - protein, 390 aa, Glycine max
MAASTTSQVYIQVIDDVMNKVRDEFVNNGGPGDEVLKELQSIWESKMMQAGAIVGPIERSGAPKPTPGGPITPVHDLNMPYEGTEEYETPTAEMLFPPTPLQTPLQTPLPGTVDNSMYNIPTGPSDYPSAGNEPGANNEIKGGRPGPYMQPPPSTWTNQNQNQRAPLDVNVAYVEGRDEAERGASNQPLTQDFFMSSGKRKRDEIASQYNAGGYIPQQDGAGDAASQIFEIEVYGGGMSIDAGHSTSKGKMPAQSDRPASQIPQLDGPIPYDDDVLSTPNIYNYGVFNEDYNIANTPAPSEVPASTPAPIAQNEVDEEDDDDEPPLNENDDDDLDDLDQGEDQNTHHLVLAQFDKVTRTKSRWKCTLKDGIMHINNKDILFNKATGEFDF

SEQ ID NO: 3055 - protein, 551 aa, Anabaena variabilis ATCC 29413
MFDSIDAALSDLKAGRAIVVVDDENRENEGDLICAAQFATPDMINFMAVEARGLICLAMTGDRLDELDLPLMVTNITDPNQTAFTVSVDASPHLGVSTGISAEDRARTIQITLNPATKPSDLRRPGHIFPLRAKAGGVLKRAGHTEAAVDLSRLAGLYPAGVICEIQNPDGSMARLQQLIEYAKHHDLKIISIADLISYRLQHDRLVYREVITKLPSQFGQFDIYAYRHTLDNTEHVAIVKGNPENFRDEPVMVRMHSECLTGDALGSLRCDCRMQLQAALKMIETAGQGVVVYLRQEGRGIGLINKLKAYSLQDMGLDTVEANERLGFPADLRDYGMGAQMLMDLGVKKIRLITNNPRKIAGVKGYGLEVVDRVPLLIEANDYNSYYLATKAKKLGHMLLQTYLVTVAIHWQDDPQLVTKRYERLEKLRHLVRSYDLLLQEEARPLAIALFDKPSLIVHLGFDQEKVASCDWYSQSGHPYLQAILPILDNLATLPYVQKLEFLISSGSDPLSNLQVQLDRQTISPDKLPSSVGSDLETQKIYSFSKEVEE

SEQ ID NO: 3056 - protein, 458 aa, Pseudomonas syringae pv. syringae B728a
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSASGSEIGISNLWAHGGFMPNGVTGLIASFAVVMFAFGGIEIIGITAGEAKDPRRSLPQAINAVPLRILLFYVLTLFVLMCIYPWPQIGTQGSPFVQIFDNLGIASAATILNIVVISAAVSAINSDIFGAGRMMYGLAREGQAPASFARVSRHGVPWMTVLVMGIALLGGVLLNYLIPKDVFLLIASLATFATVWVWLMILLTQVSMRRSMSREEAAQLKFAVPFWPYGPAAAIAFMLFIFGVLGYFPDNRAALIVGAIWIVLLLIAYAVWVKPKALNTTH

SEQ ID NO: 3057 - protein, 780 aa, Zea mays
  misc_feature (131)..(131): Xaa can be any naturally occurring amino acid
  unsure (1)..(780): unsure at all Xaa locations
MSVEEEVERGEEDLFYESLDRILSSSGSSTSASDDDGADRPRHRRSCDAPAAAALDLWTSQPAPVHERRRRLLHLMGLTGDPSLAGFEIARSASGEAAGPPPASPVSWSRSGGAALGSAGKPPLGGRPSAXSLSDGSDAADEDPRCLIRNLDDGREYVVREEFALREVGTGRHLTVEELARSPIVQELMRRQAFSTPNSNCTSNSQSGTSTPIERSSSGSSNGVGRAKRRSSWLRSIRCVAGSFASHSRDRRSSDEKDASPEKGGHHSSSTTDDSQDSVPRHGPARVKVRQYGKSYKELSGLFMTQEIQAHSGSIWSIKFSPDGRYLATAGEDCVIHVWEVLEFERARKENEVCNPLVAMVCNESSETTVGSAAPSESHWEKKLRSKVLHGGGSVSSDRLMVPEYVFALSEKPVITFAGHSEDVLDLSWSKSQYLLSSSMDKTVRLWHMSSTYCLKTFSHTDYVTCIQFNPVDDRYFISGSLDEKVRIWSIPKREIVDWVDLHEMVTAACYTPDGKGALVGSHKGSCHLYDTSDDMLCYKTQIDLQNKRRKSSQKKITGFQFVPGDSSMVIITSADSRIRVLDGFELAHRFKGFRNTSSQISACLAGNGRYIISASEDSHVYIWRNNDGPKPSRKKGIVSVTDSHEYFHCQSVTVAVTWPFASTAMTCLMNPGKQEELERGSEPQDLQTKLAKAQEMPDVEYRSTNITSNNSNHNNGDRTSPTWPEKLNTPPNQSLRATTCHANEGDQALNRSAWGLVIVTAGRGGQIRTFQNFGFPVRV

SEQ ID NO: 3058 - protein, 393 aa, Leptospira interrogans serovar Lai str. 56601
MKPPVNQSCQHYPECAGCDRLHIGYEKQLQHKQEEIEKRFKGFKGLEIRQIIKSPKDQMYRHKVQLPFGHRKIGKKSVLTLGLHNKENTFIIDQKECRIQDEDLTTVAAAIRHWARNENLEPYHEKKGSGLLRHIVLRKANATQEILVGIVTNESEIPGRKKLTDRLYSYIQQFLYKENSKADVVGILQNVNRKNTKVVLGEKEVTWYGRHFVKEKIGKLDFQIGLSTFFQVNPFQIENLYNLILEDLPENKCVVDAYCGIGTISLYIASKSKKVIGLEENSSSIRSAIGASKANGIENVHFIKGKVLDTLRAALNENSDVVVLDPPREGLDAETKSILLNSKVNQILYVSCNPETLLRDAIELTKSFKYEKITPVDLFPHTSHLESVSVFTK

SEQ ID NO: 3059 - protein, 133 aa, Enterococcus faecalis V583
MKETSLVIIKPDGVERKLVGKIIQRFEDKGIDLLHLKFERLTVETVKEHYEHLKDELFFPELLAYMTSGPVVVMVVVGDNVVKKVRKLVGATNPLDAESGTLRADYGLSVTKNLIHASDSVQSAKIEMQRFFG

SEQ ID NO: 3060 - protein, 280 aa, Campylobacter jejuni RM1221
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKANAKNLRAALYSMYGARLELVICKDQPKLYRLNANNEFIFIKDLKMNEKGKINATGGTQKFWEEKHAKFIKNLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 3061 - protein, 167 aa, Synechocystis sp. PCC 6803
MAITPTQLLDWKRQQRPIVALTAWDTAIASVLDAAGVEIILVGDSLGMVALGYETTLPVSLDTMIHHTAAVKRGVQRALVVCDLPFLTYQESPAQAMGSAGRVLQETGAQAVKLEGGHPRMVETVARLTEVGIPVMGHVGLTPQSVHQLGYRQQGQDPATAEKILHQ

SEQ ID NO: 3062 - protein, 377 aa, Nicotiana tabacum
MSVTELKERHMAATQTVNDLREKLKQKRLQLLDTDVSGYARSQGKTPVTFGPTDLVCCRILQGHTGKVYSLDWTPEKNRIVSASQDGRLIVWNALTSQKTHAIKLPCAWVMTCAFSPSGQSVACGGLDSVCSIFNLNSPIDKDGNHPVSRMLSGHKGYVSSCQYVPDEDTHLITSSGDQTCVLWDITTGLRTSVFGGEFQSGHTADVQSVSISSSNPRLFVSGSCDTTARLWDTRVASRAQRTFYGHEGDVNTVKFFPDGNRFGTGSEDGTCRLFDIRTEHQLQVYYQPHGDGDIPHVTSMAFSISGRLLFVGYSNGDCYVWDTLLAKVVLNLGGVQNSHEGRISCLGLSADGSALCTGSWDTNLKIWAFGGHRSVI

SEQ ID NO: 3063 - protein, 466 aa, Actinobacillus pleuropneumoniae serovar 1 str. 4074
MGPATDRGNNLEKVIAAGANMVRMNFSHGVPEDHIERANKVREIAARLGKTVAILGDLQGPKIRVSTFKDGKIFLNIGDKFTLDADLPRGEGHQDAVGLDYKNLPNDVVPGDILLLDDGNVQLKVLSVEGVKVHTEVTVGGPLSNNKGINKLGGGLSAPALTEKDKEDIKLAAKIGVDYLAVSFPQSSADLDYARQLAREAGLEAKIVAKVERAETVATEEAMDDIILGSDVVMVARGDLGVEIGDAALVGVQKRLIRRARKLNRVVITATQMMESMIKKPMPTRAEVMDVANAVLDGTDAVMLSGETANGDYPVETVKSMAEVCLGAETMPSINISRHRMEGTFATIDEAVAMSAMYTANHLEGVSALIALTHSGETAKLMSRISSGLPIYALSRNQQALNRTALYRGVTPVFYDEESRTFEGAKKAIALLKEKGYLMSGDLVLLTQGDELKEGGTNTSRLLKVE

SEQ ID NO: 3064 - protein, 335 aa, Mannheimia succiniciproducens MBEL55E
MKTLDEFIVDRQAEYPNAKGALTGILSSIRLVAKVIHRDINRAGLTNNILGFSGIDNVQGEHQMKLDLFAHNMMKQALMAREEVAGFASEEEENFVAFDTERGRNARYVILTDPLDGSSNIDVNVSVGTIFSIYRRVSPIGSPVTLEDFMQPGNRQVAAGYVVYGSSTMLVYTTGNGVNGFTYDPSLGTFCLSHENMQIPATGKIYSINEGQYLKFPMGVKKYIKYCQEEDAATNRPYTSRYIGSLVADFHRNLLKGGIYIYPHATNYPQGKLRLLYEGNPIAFLAEQAGGIASDGYNRVLDIQPSQLHQRVPLFVGSKQMVEKAQDFMHQFKED

SEQ ID NO: 3065 - protein, 293 aa, Nostoc sp. PCC 7120
MGLTDNYKLNLIQWYPGHIAKAEKNLKEQLSRVDVVFEVRDARIPLATHHPQIDEWVGNKARILVLNRLDMIPPQVRSLWIDYFQNRGEVPYCTNAQHGQGVVGVAKAAQAAGVELNQRRRDRGMLPRAVRAVVIGFPNVGKSALINRLLGKRVVESAARPGVTRQLRWVRISDQLELLDAPGVIPVKLGNQEAAVKLAICDDIGQASYDNQLVAAALIDLVNSLQEQAGELLPKSPLYTRYELDPTPHTGEGYLHALAEYRHKGDVERTARQLLTDYRKGLLGTLPLELPPM

SEQ ID NO: 3066 - protein, 78 aa, Arabidopsis thaliana
  misc_feature (72)..(72): Xaa can be any naturally occurring amino acid
  unsure (1)..(78): unsure at all Xaa locations
MAPSMRLCFSMDASPARGGFDRAFYGLKSSAAFPATRKANNDITFITSNGGRVNCMQEWPPTGKKKFETLSXYPPDLT

SEQ ID NO: 3067 - protein, 218 aa, Vibrio vulnificus YJ016
MNQSSLLAEFGDPITRVENALLALKEGRGVLLLDDEDRENEGDIIYSVEHLTNAQMALMIRECSGIVCLCLTDEHANKLELPPMVVNNNSANQTAFTVSIEAKQGVTTGVSAQDRVTTIKTAANPSAKADDLARPGHVFPLRARPGGVLARRGHTEGTVDLMQMAGLQPAGVLCELTNPDGTMAKTPEIIAFGKQHNMPVLTIEDMVMYRNQYDLKLA

SEQ ID NO: 3068 - protein, 154 aa, Oryza sativa
  misc_feature (15)..(15): Xaa can be any naturally occurring amino acid
  misc_feature (22)..(22): Xaa can be any naturally occurring amino acid
  misc_feature (31)..(31): Xaa can be any naturally occurring amino acid
  misc_feature (41)..(41): Xaa can be any naturally occurring amino acid
  misc_feature (125)..(125): Xaa can be any naturally occurring amino acid
  misc_feature (133)..(133): Xaa can be any naturally occurring amino acid
  unsure (1)..(154): unsure at all Xaa locations
RPRVRQGHDDLGRRXAKYYEVXSRFFKWQCXLKIAPDEPSXLFIDLNAHGLARYAIICQENGLVPIAEPEILVYGSHDIERCVYVTEKVLAACYNGLNEHHVLLEGHILTLNMATGGSESRTVTXEVMPEYTXRALQRTVPGVEPATVLLSGGQ

SEQ ID NO: 3069 - protein, 139 aa, Rhodococcus sp. RHA1
MTERTLVLIKPDAVARGYVGEILGRIERKGLTISALDLRTAPGDIAAAHYAEHEGRPFYPGLLEFITGGPLVAAVLEGPRAIAAFRQLAGGTDPVEKAVPGTIRGDFGLEAQENLVHGSDSVESAEREIALWFPHLAAN

SEQ ID NO: 3070 - protein, 447 aa, Shigella flexneri 2a str. 301
MIFCLQAPHLFRRNTVNVNSSSNRGEAILAALKTQFPGAVLDEERQTPEQVTITVKINLLPDVVHYLYYQHDGWLPVLFGNDERTLNGHYAVYYALSMEGAEKCWIVVKALVDADSREFPSVTPRVPAAVWGEREIRDMYGLIPVGLPDQRRLVLPDDWPEDMHPLRKDAMDYRLRPEPTTDSETYAFINEGNSDARVIPVGPLHITSYEPGHFRLFVDGEQIVDADYRLFYVHRGMEKLAETRMGYNEVTFLSDRVCGICGFAHSVAYTNSVENALGIEVPQRAHTIRSILLEVERLHSHLLNLGLSCHFVGFDTGFMQFFRVREKSMTMAELLTGSRKTYGLNLIGGVRRDILKEQRLQTLKLVREMRADVSELVEMLLATPNMEQRTQGIGILDRQIARDYSPVGPLIRAVVLPVICALITPTPTTAIFQKHCLPLPAAMFSPA

SEQ ID NO: 3071 - protein, 139 aa, Shigella flexneri 2a str. 301
MMVRVKETFDSLAMLEFALDNMPDTPLLTEGFSYKPHAFALGFAEAPRGEDVHWSMLGDNQKLFRWRCRAATYANWPVLRYMLRGNTVSDAPLIIGSLDPCYSCTDRVTLVDVRKRQSKTVLYKEIERYGIDRNRSPLK

SEQ ID NO: 3072 - protein, 442 aa, Desulfitobacterium hafniense Y51
MGFTKEECLKYVQENDVRFIRMQFTDIFGQMKNIAITHNQLAQALDEGVLFDGSAIKGFAGVEASDMLLLPDPSTFTLIPWRPQQGKVARIICDVKNHDGSQFEGDPRYILKRTLQKAHDLGYVFQVGPECEFFLFHTDEEGQPTTITHDAAGYCDLAPIDQGENTRREICLVLEEMGFEIETSHHESAAGQHEIDFKYTDALTAADHIMTFKYVVKIVSQRNGLHATFMPKPLHGVNGSGMHINMSLAKEGRNVFIHPENPGELSETAKQFIAGLLEHIKGITAVANPLVNSYKRLTPGYEAPVHIAWSPMNRSPLLRVPSPRGAGTRLELRSPDPSCNPYLTLALLLEAGLDGLQREMKVPEPVNENIYNLTPEQEKALSLERLPSNLLLALEEMEKDPLIQATLGRHIFTKYIAAKAREWKAYDEMVHQWEIDSYLKIY

SEQ ID NO: 3073 - protein, 347 aa, Mycobacterium tuberculosis H37Rv
MTITALTVTLPLLWRRLTTAGVKYADQGHFVGSAGVPAADAGGRDAASEQIARWTQTCTVVLVCGHGPAKWAFRSWCTSRSCDTLPVALRYRLQSNPLVGKLTTKYFLPLGTRQVGDHVVFFNFGYEEDPPMALPLSESDEPNRYCIQLYHQTASQVDLTGKEVLEVSCGAGGGASYIARNLGPASYTGLDLNPASIDLCRAKHRLPGLQFVQGDAQNLPFPDESFDAVVNVEASHQYPDFRGFLAEVARVLRPGGHFLYTDSRRNPVVAEWEAALADAPLRTISQRDIGAQAKRGLDANTARSQEAIGRRAPVLLAGLTRCAVRVLDWDLRRGGGFSYRIYLFAKD

SEQ ID NO: 3074 - protein, 312 aa, Zea mays
KDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQV

SEQ ID NO: 3075 - protein, 192 aa, Arabidopsis thaliana
MLEKKEKVLLKKAGAEVEKAKEYSRAKNKRAAIQCLKRKRLYEGQVEQLGNFQLRIHDQMIMLEGAKATTETVDALRSGASAMKAMQKATNIDDVDKTMDEINEQTENMKQIQEALATPMGAAADFDEDELAAELDELESEELESQLLQPATTAPPLPSVPVPAGRQPARPVPQKRTAEEEELAALQAEMAL

SEQ ID NO: 3076 - protein, 363 aa, Triticum aestivum
MFVFCLCTRCRICRVSSFPVLLLFMFIHLSYFFLVLLLILGQFFFTRYEKYHGYYGGKEESRKSNYTDMVNKYYDLATSFYEYGWGESFHFAHRWNGESLRESIKRHEHFLALQLELKPGMKVLDVGCGIGGPLREIARFSSTSVTGLNNNDYQITRGKALNRSVGLGATCDFVKADFMKMPFSDNTFDAVYAIEATCHAPDPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPMYFFVVRKPLSE

SEQ ID NO: 3077 - protein, 223 aa, Pseudomonas syringae pv. syringae B728a
MTQDQLKQAVAQAAVDFILPKLDDKSIVGVGTGSTANCFIDALAKHKAAFDGAVASSQATAARLKAHGIPVYELNTVSDLEFYVDGADESDEHLNLIKGGGAALTREKIVAAVANTFICIADGSKLVPVLGAFPLPVEVIPMARSHVARQLVKLGGDPVYREGVLTDNGNIIIDVHNMSITNPVELEAQINAIVGVVTNGLFAARPADLLLLGTAEGVKTLTR

SEQ ID NO: 3078 - protein, 541 aa, Pseudoalteromonas tunicata D2
MAKLQWWQGAVIYQIYPRSFQDSNHDGIGDIPGIIAELDYIKGLGVDAIWVSPFFKSPMKDFGYDISDYRDIDPLFGTLADFDELIDKAHQRDIKIIIDQVLSHTSDQHAWFSESRVDKTNDKADWYVWADAKPDGTAPNNWLSIFGGPAWQWEPRRKQYYLHNFLTEQPDLNFHNPDVRQHVLDNVEFWLKKGVDGFRLDAINFCYHDAQLRDNPAKPVDKRQGRGFSEDNPYAFQYHYYNNTQPENLAFMAEIRALLDRYPGTVSLGEISSEDSLATMAEYTQGGNKLHMGYSFELLTKDYSAAYIRQTVQGLEKQMTEGWPCWAFSNHDVERVASRWAKNGVRSDAQVKMLTALLGSLRGSVCMYQGEELGLTEADVAFEDLQDPYGITFWPNFKGRDGCRTPHPWQHNAEFAGFSTQKPWLPVAKQHLSNSVDLQNADLNSCLNRFREFLHWRKNHQALIVGDIEFIDTPEPLLAFWRSTGDDTILCCFNLSEQSASLDLTTVSLTELADVSHHSGQLVKNQLNLPPFGCYFAKKHD

SEQ ID NO: 3079 - protein, 265 aa, Glycine max
LLHQIHKGIPIIGAGAGTGISAKFEEAGGVDLIVLYNSGRFRMAGRGSLAGLLPFADANAVVLDMANEVLPVVKKVPVLAGVCATDPFRRMDYFLKQVESTGFSGVQNFPTVWLFDGNFRQNLEETGMGYSLEVEMIQKAHKMGLLTTPYAFNQYEAIEMAKVGADIIVAHMGLTTTGSIGAKTAVSLEESVVRVQAIADAAHRINPGVIVLCHGGPISGPKEAEFILKRTKGVHGFYGASSMERLPVEQAITNTVKEYKSISFH

SEQ ID NO: 3080 - protein, 585 aa, Enterococcus faecalis V583
MKKTKIVCTIGPASESVDMLVNLINAGMNVCRLNFSHGDYEEHGARIKNIREAVKITGKRVAILLDTKGPEIRTNDMENGAITMKIGDSVRISMTEVLGTNEKFSITYPELINDVNVGSHILLDDGLIDLEVTDIDRDANEIVTVVKNEGVLKNKKGVNVPGVSVNLPGITEKDANDIRFGIGQGIDFIAASFVRRASDVLEITKILEEENATHIQIIPKIENQEGIDNIDEILKVSDGLMVARGDMGVEIPTEDVPVVQKALIKKCNALGKPVITATQMLDSMQRNPRPTRAEANDVANAIYDGTDAVMLSGETAAGDYPLEAVQTMARIAVRTEETLVNQDSFALKLYSKTDMTEAIGQSVGHTARNLGIQTIVAATESGHTARMISKYRPKAHIVAITFSEQKARSLSLSWGVYATVADKPSSTDEMFNLASKVSQEEGYASEGDLIIITAGVPVGEKGTTNLMKIQMIGSKLVQGQGVGEEAIIAKAVVAATAEEAVAKATEGAILVTKTTDKEYMPAIEKASALVVEEGGLTSHAAVVAIAQNIPVIVGAADATSLINNDEVITVDPRRGIVYRGATTAI

SEQ ID NO: 3081 - protein, 159 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNNKSRIVPRHLLLAVRNDQELGRLLAGVTIAHGGVLPNINPVLLPKRTAEKEPKEGKSPKKTAKSPKKADKKA

SEQ ID NO: 3082 - protein, 424 aa, Campylobacter jejuni RM1221
MTNKKAFKEACKFIAGGVNSPVRAFANVQSEPKFISHGKGAYIFDIDGNSYIDYVQSWGPLLFGHCDKDIQKACQKALHKGSSFGAPTLLETELAKLVLSDFPHLEKIRFVSSGTEATMSAIRLARGFTKKDKILKFEGCYHGHSDSLLVSAGSGAATFNSPSSLGVLEDVAKHTLVAKYNDINSVKELFEKNKDIACVIIEPIAGNMGLVPAKQDFLEELAKICKNNQTLLIFDEVMSGYRASYLGSYGINHIQADIITFGKVIGGGLPAAAFASRAEIMDILSPLGGVYQAGTLSGNPLAMAAGIASLTKAKKKTKLYDKLGKLAKKLTQGMKKLADEKGLPLQVCHVGSMFGYFFTKDPVSNYQDALKSDLALFSKFHKNMLENGIYLAPSQFETGFICSKMDDKIIDTTLEAVRESFKRI

SEQ ID NO: 3083 - protein, 338 aa, Bradyrhizobium japonicum USDA 110
MLATLMYGPGDVRCEQVDDPRILKPTDAIIKLSATCICGSDLWPYRGLQPIDGRAHMGHEYCGVVVEVGREVTTVRPGQFVVGSFCISDNTCPHCRFGFHSSCVQREFMSGAQAPYARVPLADGTLVATAELPSPDLIPDLLATSDVLGTGWYAADAANVREGSTVVVVGDGAVGLMGVLSAKAMGAERIIAMSRHETRQRLAIEFGATDIVAERGEAGIARIKELTRGVGADSVLECVGMQESMTQAIECTRPGGSIGYVGVPHGVTFDGQAMFFAQRRMLGGPAPVRRFLPDLIDRVLAGKIKPGKVFDLKLPLADVAEGYRAMDERRAIKTMITV

SEQ ID NO: 3084 - protein, 314 aa, Nostoc sp. PCC 7120
NGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWG

SEQ ID NO: 3085 - protein, 454 aa, Rhodospirillum rubrum ATCC 11170
MKTAEPQTIDDLERWIKSRGITEVECLVPDLSGIPRGKILPARKFLSCLRDRGLRLPESVFTQTVTGEYPEDDPVDIADSDVYLRPDPRTIRVVPWYEEPTAQVINDCFHRDRSEVHCAPRQVLRNILALYEKQGWKPVVAPELEFYLVRINADPDYPLEPPIGRSGRAETGRQAYGIDAVNEFDPLFEDIYDYAEEQNLDLDTLHHESGSAQMEINFLHGDPMELADQVFLFKRTVRQAALRHNVYATFMAKPLAGQPGSAMHLHQSITDAESGRNILVKKNGEDSDLFRWHIGGLQKYLPHCMLMLAPNVNSYRRFLPDQSAPINMHWGHDNRTVSLRVPYADASARRVENRLSGADANPYLAIAASLACGYLGMIEKIEPTAPITGSAYTRAHNLPRHLPDAIERFERARPLHELLNADFVRVYASVKWAEWDAYQHVISSWEREYLLLNV

SEQ ID NO: 3086 - protein, 619 aa, Brucella suis 1330
MPHDTPLIATIVIGLCLAFIFGAIATRLKISPLVGYLLAGVIAGPHTPGFVADQDLILQLAEIGVILLMFGVGLHFSLKDLLSVKAIAVPGALAQIAAAAALGTGLGLALGWDVQAGMVFGLALSTASTVVLLRAMQERRLIDTERGRIAIGWLIVEDLAMVMALVLLPAIASVTGRAQGMAASDPIVTWLGLGIGGTILLTVAKVVLFIVLMLVVGRKVIPWLLNVVAQTGSRELFRLGVLAIALGVAFGAAHLFGVSFALGAFFAGMVMSESELSHRAAEESLPLRDAFAVLFFISVGMLFDPMSLLKDPLPLLGTLAIILIGKSVAAFFIVRAFRRPVSTALTISASLAQIGEFSFILAGLGVSLNLLPPAGRDLILAGAILSIFLNPVMFIVAERMRPWLEKRGATNLTADESNATEHNIAEPEPLPHTLLTGHTIIVGYGQIGGRLAAGLQEKEVPFLVIEDSPKICISLKEKGIETIAGNASNTEILEAANPGVARNLVIAIPNAFEAGRVTALGRAANSGLHIVVRACSQAEAQYLRDLGADSVILGEEEIAGAMANAIGADPRSERNEHVPAPIEVPAGPKENMPEKAEDTATDIVNENGGDMKREGMVIG

SEQ ID NO: 3087 - protein, 735 aa, Yarrowia lipolytica
MSFRQQFQQGGNPNGQMGFNNMNMSPNMNNAKIGGMDMGAQMGQMGQMGQMPQMAQMGQMGQMGGMPQMGGPMGGQMNGMNMGGMSGAGGMPNVGGMPNMAGMPNMGQGMNMGQGMNPQVGRGGPMGPQGMMGQQGMGGMQQGGQVQMGGGPQMQPPQRQPQPQQQQQQQQQQQQHHHQQQQQQVPMPQSQLIPQQGGIPVMAGGQPQKNFDFPPPGQTMMQPGLTVPPVQSHLGLVSSDDARQQETPLVNPPSAAESLAEMPTLFNGQGITDLTEIMKNKRDPKTAQELNLRRFVSKDLNESSTLPKKLKQEADKLNAKRYEISFYHSFGPIRSQEPQSIFQDGYLGYGNGWTGLNTRFVYPRDRKKHNRNTRDLVLSRQQMNQQAAEPELLVPIRLDFDLGRLRLRDTFMWNLNEKTYPVHFFVENMFEDFHFPHQYIQSVTNSITEQLQDFQPHQYPQDPRHVIGNGDATRNEDMRVVVRLDITVGQHNLIDQFEWDINDSLNSPEEFAATMCAELSLSGEFATAIAHAIHEQTQVFSKSLLLLGHTFDQRPVDDEDIRREICAPIPDGSVMRPKNSVNEYSPALFEISEAELSRLDKDKDRDSRQKRRQGRAGRRGAPSLPDFKKVVRTFRTPVYSAVLPGAVDRKVELAKQALQAEEEEEEEDSDGNVVVRPAKRQRTTGRHVPVRAAAANAAVAVAAQSQELETNYVEELADPTSFWVTLKCPHSSLRG

SEQ ID NO: 3088 - protein, 382 aa, Arabidopsis thaliana
MSHSAVSQAGAVSVSIENQRSLRRSVFKQNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 3089 - protein, 380 aa, Yarrowia lipolytica
MLPPPRARCRHKSFRHPHPSHRHRHTPTHSRITRPTRTATMEDSDVLMRDINDDGLKPMDAMGAGGEGTFTELTPTTRGQLDAWIARLTECQPLSEDDVNELCNMAKGVLQKEENVQPVHAPVTICGDVHGQFHDLMELFKIGGPCPDTNYLFMGDYVDRGYYSVETVSYLVAMKVRYPNRLTILRGNHESRQITQVYGFYDECLRKYGNANVWRAFTSLFDYFPVTALVENQIFCLHGGLSPMIESIDNIRELNRFQEVPHDGPMCDLLWSDPDDRGGWGMSPRGAGFTFGADISEQFNHTNNLSLISRAHQLVMEGFSWAHEQQVVTIFSAPNYCYRCGNQAAIMEVDENLSNSFLQYDPCPRPGEPSVSRRTPDYFL

SEQ ID NO: 3090 - protein, 339 aa, Acidovorax sp. JS42
MTEDHRLTVLFTDFAPTDQAAMQQRLPAHWHAHFVQREHLVASDTEDGAIEVLCVFVRTRVDESVLRMLPRLRLVATRSAGFDHIDLEACRKRGIAVCHVPDYGSASVAEHAFALLLGVTRHLTQAHERARQGSFAYRGLTGFELEGRTLGIVGLGRIGRHVARIAVGFGMDVLAYDPAFAASAARPAGVSLVTWEQVLQGSDILSLHVPATEATRHLIDARAFARMKPGVVVINTARGALIDEAALLRALDDGSVAAAGLDVLEQEGALSPEVPTGCGGLGCDTGWMASSPLLTHPRVLVTPHVGFNTTEAIARIFDETISNIAAWHAGRLRNRVDEP

SEQ ID NO: 3091 - protein, 679 aa, Oryza sativa
MAQVVAAAGTAAAVAAVGRPLGGGGSGADALRPAARLSFAPRWCGGSAGAARARRESAVTSVISRAPRLDAEVLPVSADDDADVKEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKSYTEYDVLMLECFFAVYASSGGIGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQVRKVQSAQATGGSFAMTMRVAFAFQFLAIGAPETGVAELACPRFSFPSGTTRHMRARCAGGRALRADGEKDSCRFAN

SEQ ID NO: 3092 - protein, 799 aa, Actinobacillus pleuropneumoniae serovar 1 str. 4074
MALTAQFSALFERGLQAYCEERSLNPTQLSDQQWYQLVAQVAHQAALQFFPKNAPLVDTRKVNYLSMEFLVGRLLGNNLQNLGVYQYVVDEVAKYGKTLVDILEQETDPAFGNGGLGRLAACYLDSMASLAQPAVGYGLHYQYGLFKQSFDWAGRQHEEGDAWGRDFFPLQSHRADFRQPVGFAGEVRHIAGDKYEWQPAWTIYGEAFDLPVVGYKGVQQPLRLWQGYSETAFDLAKFNDGDYLDSESMVIDASKITKVLYPNDNHQNGKELRLMQQYFHCACSVADIIKNHLAKGRILDQLAEFEVIQLNDTHPAIAIPELMRLLLDQYGYSWEKAWSICSKVFAYTNHTLLPEALEQWDQNLVAKLLPRHLIIIERINLELYQQVKACFDEDELANVWDETAIIANNRVRMANLCVVGSFAVNGVAQIHSDLVVSDLFPAYAKLFNGRFHNVTNGITPRRWIRQANPLLSALLDQHIEGDWTQNLELLRQIEPLAENSAFQTAYAEIKQQNKQALTKVIEETLGIQVNQNAIFDVQIKRFHEYKRQHLNLLNIIATYQELKANPDMPFVPRVFIFAGKAAPGYFMAKQIIQAINNVAHVINHDPDMQGKLQVAFLPNYSVSLAEKIIPAADVSEQISLAGKEASGTGNMKLALNGAITLGTLDGANVEIAEFAGEENVVIFGHTVESVRELREKGYVSREYYEQDEVLRKAIDALADGSFAGGNKEIFEPLVYDLLNKDYFCVLADFASYREAQQEVAKRYQNQTAWLKSTILNTARLGSFSSDRSIRDYQTRIWKK

SEQ ID NO: 3093 - protein, 957 aa, Escherichia coli
  misc_feature (165)..(165): Xaa can be any naturally occurring amino acid
  unsure (1)..(957): unsure at all Xaa locations
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVXKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFNVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 3094 - protein, 281 aa, Mesorhizobium sp. BNC1
MSATGGAKSFTPPDIAKAKGKAPIVCLTAYTTPIARLLDPHCDVVLVGDSVGMVMHGLPSTLGVTLDMMIMHGKAVRRGLERALMVVDMPFGSYEEGPEQAFRNAARVMAETGCAAVKLEGGESMAETIRFLTGRGIPVMAHVGLTPQAVNAFGGYQVQGRGEDGDRVMRDAQAVAKAGAFSVVLEKVPEPLARRITKEIPIPTIGIGASPACDGQVLVVDDMLGMFTDFRPKFVKRYAELAEAAEAGIAAYAKDVRQRRFPAPEHVFSDMPKPVKGGEAA

SEQ ID NO: 3095 - protein, 315 aa, Escherichia coli K12 [sequence omitted]

SEQ ID NO: 3096 - protein, 312 aa, Ralstonia eutropha JMP134
MMKRICISEFMDPAAVQALTPGFDVRYEPGWVDQRGALLDALAGADALIVRNRTQVDAALLERAPALRVVGRLGVGLDNIDVAACRDRGIRVIPASGANARSVAEYVVTTAALLLRGAYLGSAEVAGGKWPRARLSEGREALGKTLGLIGFGDIGRQAAALAQAFGMRVVAHDPMLAPDDPVWSATGVVCMTLDALLAQSDAVSLHVPLVAATRHLMNAQRIGAMKRGAVLINTARGGVVDEGALAGALLEGHLAGAALDVFEAEPLPADSVLADVPNLVLTPHIGGVTREANARVSMMIAEKVRQTLEALP

SEQ ID NO: 3097 - protein, 284 aa, Thermococcus kodakarensis KOD1
MREITPRKIIEMKGKEKIAMVTAYDYPSALLADKAGMDIVFVGDSLGMVVYGEPNTLNVSMEQMVFHTRAVAKAVKRALVLADMPFGSYEVSVEEGVKNAMRLIRAGADAVKIEGGYDHKKLVKKLVRMGIPVMGHTGLTPQRYLRLGGYRLMGETEEEIEEILRDAKALEKAGAFAVVLEFVLADVAKLVTEEVSIPTIGIGAGPHVDGQVLVWHDLLGIYENVPPFVKKYADLASIIQLALENYRGEVKEGRFPAKEHYWEFLDKDDFERKKMKALERLEDE

SEQ ID NO: 3098 - protein, 409 aa, Pseudomonas syringae pv. syringae B728a
MSKTSLDKSKIKFLLLEGVHQSAVDVLKAAGYTSIEYHTKSLPEAELKEKIADAHFIGIRSRTQLTEELFDCAKKLVAVGCFCIGTNQVDLNAARERGIAVFNAPYSNTRSVAELVLAEAILLLRGIPEKNASCHRGGWIKSAANSFEIRGKKLGIIGYGSIGTQLSVLAEGLGMQVYFYDTLTKLPLGNATQVSSLNELLGMSDIVTLHVPETSETQWMIGEKEIRAMRKGSILINAARGTVVELDALADAIKDKHLIGAAIDVFPVEPRSNDDIFESPLRGLDNVILTPHIGGSTAEAQANIGLEVAEKLVKYSDNGTSVSSVNFPEVALPAHPGKHRLLHIHENIPGVLSEINKVFAENGINISGQFLQTNEKVGYVVIDVDAEYSDLAQAKLQQIKGTIRSRVLF

SEQ ID NO: 3099 - protein, 204 aa, Brassica napus
  misc_feature (182)..(183): Xaa can be any naturally occurring amino acid
  unsure (1)..(204): unsure at all Xaa locations
MEEIRKEIDVGDWHSNLPHDEWTQLTVPGSRASARYKHAAAVVDEKLYIVGGSRNGRYLSDVQVFDLRSLTWDSLKLKTEDGDGSLGEAFPAISDHRMIKWGNKLLLIGGYSKNQSDNMSVRFIDLETHLCGVVEASGNVPVSRGGHSITLVGSRVFVFGGEDKKRRLLNDLHVLDLETMTXXDVGETSQTRPVPRFDHTAATH

SEQ ID NO: 3100 - protein, 446 aa, Polaromonas sp. JS666
MNKPSTSSMHSATGTALDSALAETTARYRARNPGSERLLRKAADVLPAGNTRSVLFYTPFPLYMARGEGCHLWDADGHRYLDALGEFTAGIYGHSNPVIRQAIVAALQDGLSLSSHTAREAALAHEIQRRFPGMALLRFTNSGTEANLMALAAATAHTGRRKVLVFNGAYHGGVLSFGGGGSPVNVPHDFVVAPYNDLDAVRGLVQTHGPQLAAILVEPMLGAGGCIPAEPAFLHGLRALADACGALLILDEVMTSRLSGGGRQALLGLKPDLTTLGKYFGGGLSFGAFGGRVDVMSRFDPRRADALGHAGTFNNNTLTMAAGLAGLTQVLTPAALDALNQRGERLRERLNGVFKRHAVGLQFTGLGSVMQLHATDRPLRNAADLAGADDRVKALLFFDLLERGIFLARRGLVALSLPFGDAEADEFVAALDAVVTARHALLPVAG

SEQ ID NO: 3101 - protein, 489 aa, Salmonella enterica subsp. enterica serovar Typhi
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 3102 - protein, 471 aa, Salmonella enterica subsp. enterica serovar Typhi
MVSINDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 3103 - protein, 1010 aa, Chlamydomonas reinhardtii
MQLASRALAASAAALSAPRAAKCAVPAPVAVSASRSKAVAPTRRSQGPGRQVSVKVAAPESPASSGEVIVNFDNTTDSGYTVISVQANNKPGLLTSITALFRDLGVDVGKAVVEGDEDRINDKFYVRSLSGGKLSEDKAADCVKALDVLLRSKPTGTEATRPKFENTAATGGTGKARLYTLMDTYMKNDVLSIQEDIVNHVEYTLARSRVNFDNFEAYQATSFSLRDRLIERWNDTQTWFKEKDPKRVYYLSMEFLMGRSLLNTLYNLDIKESYQEALAELGYDLETLADLERDAALGNGGLGRLAACFLDSMATLNLPAWGYGIRYQYGMFRQTIQNGFQHEQPDYWLTFGNPWEIERLIVSYPIKFYGHVSVVNEDGRQLFRWNAGETVTAVAYDNPIPGFGTRNCINLRLWAAKPSKEFDLEAFNTGDYVAAILSKQRAETLSSVLYPDDRTYEGKELRLKQQHFFVSATIQDCVRRYRDAHPNDWEQFPEKVAFQLNDTHPTIAVAELMRVLMDDHKLGWTKSWDICNKVFAFTNHTVLPEALERWPVALIEKLLPRHMQIIYDINWRFLQTVRNKFGDDWERISRMSVIEEQPNGEKMVRMAFMAVVASHTVNGVAAIHSEIIKETIFKDFYELWPNKFQNKTNGVTQRRWLAFCNPPLRQLITKKLGNDDWTLHLDNLRELRKYANDPEFQTEWRGVKSEAKKKAAALIHRLTGVRVSTDAMFDIQIKRIHEYKRQLLNVLGIIYRYDQIKKMTPQQRKSVVPRVCVIGGKAAPGYEMAKRIIKLICAVGDKINQDPDMGDLLKLVFLPDYNVSSAEVIIPATELSQHISTAGTEASGTSNMKFTMNGSLIIGTLDGANVEIAEEIGDENIFIFGAKAHEVARLRAERRNLHVDERFNHVVNMIRTGHFGWEDYFGPVVDAITTGGDYYLVANDFPGYLETQFRADEVYKNQTEWTRMSIMATAGGGKFSTDRTIAEYARDIWHAEPCQVPQPEAKSKSKPASS

SEQ ID NO: 3104 - protein, 501 aa, Saccharomyces castellii
MESRLARLTTLQVTAGDNLRRTSIIGTIGPKTNNPEVLVALRKAGLNIVRMNFSHGSYEYHQSVIENARKSEELYPGRPLAIALDTKGPEIRTGTTTGEVDYPIPPNHEMIFSTDEKYAKACDDKVMFVDYANITKVISKGKIIYVDDGVLSFEVLEVVDGKTLKVKSLNAGKICSHKGVNLPGTDVDLPALSEKDKADLRFGVKNGVHMVFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAILDGADCVMLSGETAKGNYPINAVTTMADTALIAEQAIAYQPLYDDLRNLTPKPTSTTETVAASAVAAVYEQKAKAIIVLSTSGTTPRLVSKYRPDCPIILVTRNPRAARFSHLSRGVFPFVYEADSVADWTEDVELRLKFGIEKAIEMGVMKKGDTYVSIQGFKAGEGHSNTLQVSNA

SEQ ID NO: 3105 - protein, 469 aa, Rhodospirillum rubrum ATCC 11170
MSDVKTILEMIKENDVKFVDFRFTDPKGKWQHTAQYVTTIDEESLVEGIMFDGSSIAGWKDINESDMILKPDLKSAFMDPFSAQPQLVLFCDVLEPSTGQPYERCPRSIAKKALSYLASTGIGDTSYFGPEAEFFVFDDVRFDVSMNRVMYEVDSEEGPYVTGKIFDEGNYGHRPPIKGGYFPVPPVDSAQDLRAEMLSTMAEIGMPVEKHHHEVAPSQHELGVRFNTLIEAADDMQKYKYVVHMVAHAYGKTATFMPKPIAGDNGSGMHVHQSIWKDGKPLFAGSGYADLSEMALYYIGGIIKHAKALNAFTNPSTNSYKRLIPGFEAPVLLAYSARNRSASCRIPYVASPKGKRVEVRFPDAAANPYLAFAAMMMAGIDGIENKIHPGDPMDKNLYDLPPEELMGIPTVCGSLREALDSLNADRDFLKKGGVFTDDMIDGYVALKWEEVYNLEHAPHPIEYKMYYSV

SEQ ID NO: 3106 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 3107 - protein, 476 aa, Saccharomyces castellii
  misc_feature (457)..(457): Xaa can be any naturally occurring amino acid
  unsure (1)..(476): unsure at all Xaa locations
MLQSRLARLTHLRTEPSANDIRKTSIIGTIGPQSNNVPTIVALRKAGLNIIRMNFSHGSHEFHQSVIDNARESESQYHGRPLGIALDTKGPEIRTGSFVRDNGVPVKTGHEMIFSTDPQYKECGDDQIMYVDYANITKVMEVGKFIYVDDGAISFEVLQVKDAETLKVRALNDGTLNSHKGVNLPGTDVDLPALSEKDKQDLQFGVKNNIHMIFASFIRTPDDIRTIRQFLGEDGKQIKIIAKIENEQGVNNFDQILQLADGVMIARGDLGIEIPAPEVLAVQKKLIAKCNLAGKPVICATQMLESMTYNPRPTRAEVSDVGNAILDGADCVMLSGETAKGAYPIDAVNMMADTALIAEEATAYLPNYDDIRNCTPKPTPTTETVAASAVAAVFEQDAKAIIVLSTSGDTARLCSKYRPNCPIILITRNDNTARFSHLYRAVFPFVYNKPALDDWVXDVQNRIDFGIEMAKQMGIL

SEQ ID NO: 3108 - protein, 336 aa, Pseudomonas syringae pv. phaseolicola 1448A
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDIKIPESTQEFAINMSNQRHWEAPVQRYVNELLAGEEGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 3109 - protein, 337 aa, Triticum aestivum
  misc_feature (10)..(10): Xaa can be any naturally occurring amino acid
  misc_feature (242)..(242): Xaa can be any naturally occurring amino acid
  unsure (1)..(337): unsure at all Xaa locations
GTGGRGGATXWGEAPPDPFNCIHVADTPTLDALKKGAPERWRLIKAHGTAVGLPTDDDMGNSEVGHNALGAGQIYAQGAKLVDLALASGKIYEGEGFKYIQQSFETGTLHLIGLLSDGGVHSRIDQLQLLLKGASEHGAKRIRVHILTDGRDVLDGSSVTFVETLENDLAKLREKGVDARIASGGGRMYVTMDRYENDWQVVKRGWDAQVLGETPHKFPSALEAVKKLRDDPKANDQYLPPXFVVLDESGKPVGPIVDGDAVVTFNFRADRMVMLAKALEYEDFDKFDRVRFPRIRYAGMLQYDGELKLPSHYLVAPPEIERTSGEYLARNGVRTYA

SEQ ID NO: 3110 - protein, 554 aa, Bacillus subtilis subsp. subtilis str. 168
MKKAWWKEAVVYQIYPRSFKDSNGDGIGDIQGIRTKLSYIKELGADVIWICPLYDSPNADNGYDIRDYQNILSEFGTMEDFDELLGDIHDLDMKLIMDLVVNHTSDEHPWFIESRSSIHSEKRDWYIWKDGKNGKTPNNWESIFGGPAWEYDQKTSQYYLHLFDKKQPDLNWENEKVRNAVYDMINWWLDKGIDGFRVDAITHIKKKEGFPDMPNPKGLDYVPSFPYHMNADGIMDLLTELKENTFSRYPIMTVGEANGVAPKEAADWAGEKNGIFSMIFQFEHLGLWDVEINESIDIVAFKRILTDWQDSLEGIGWNALFMENHDQPRSVSVWGDDGVYLKESAKALSAVYFLMKGTPFIYQGQELGMTNVAFPSIEDYDDVALKRLYETKTAKGTSHEDVMKIVWKKGRDNSRTPMQWNAGPYAGFSEAKPWIGINENYKWLNAEAQKNDKTSVYHFYKSLIKLRQTYDVFINGTYELILPEDQQIFAYLRKNESHTALIAANLTGTPALFRHSGLPLSSDALVLSNIETEPHKHMTSVLLKPYEARIYLWC

SEQ ID NO: 3111 - protein, 149 aa, Glycine max
MDADGKIKKGAGGRKGGGPKKKPVSRSVKAGLQFPVGRIGRYLKKGRYAQRVGTGAPVYLAAVLEYLAAEVLELAGNAARDYKKNRIIPRHVLLAVRNDEELGKLLAGVTIAHGGVLPNINPVLLPKKSERASKEPKSPSKATKSPKKA

SEQ ID NO: 3112 - protein, 375 aa, Methanococcus maripaludis S2
MNVVPIGPIHPILKEPLRIKLLVEGENVKGAEIDMGYVHRGIERIMEGKHYLKCIHLSERVCGICSYIHTQSFAECIENMCDIEVPEKAKYLRVITCELERIHSHLIAAAVYNLTIEHETLGIWMLNVRESIMDLLELITGNRVNMGFNVVGGVRLDLNKEILDKIHKKIDEFEEDVKNIIEVFETGPLIGMRSKHIGKIGYKEIMKTRAAGPVARASGIPESDWRIRHETYKALNFKPDWRNEGDNYARMMVRHDEVLTSVELIRRALEHYAESSGIVRNKAEIRATEGEWYNEAHRGEVYYKIAITDGGLIKRIIIRTPTVMNLEAYKYMIKDCPTIADAVATYTSIDPCVSCTERTIQLKDLNTGKLSDYKI

SEQ ID NO: 3113 - protein, 472 aa, Acinetobacter calcoaceticus
MTTKILPVIMAGGSGTRLWPLSRTQYPKQFLKLSPDGYTLLQATLFALKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSAMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 3114 - protein, 214 aa, Streptomyces clavuligerus
MSAATSPAERRVSARVGAISESATLAVDAKAKALKAAGRPVIGFGAGEPDFPTPEYIVESAVEACRTPKYHRYTPAGGLPELKKAIAERDLRDSGYPVDPAQVLVTNGGKQAIYEAFAAILDPGDEVIVPAPYWTTYPESIRLAGGVPVEVVADETTGYRVSVEQLEAARTERTKVVLFVSPSNPTGAVYSREDTEAIGRWAVEHGLWVLTDEI

SEQ ID NO: 3115 - protein, 872 aa, Chlamydomonas reinhardtii
MAYRQLQGTNRGASAGAPVAYSRPMQGRVGRSALRVQAVAEAERPTAAKSSGSAEPVTTDITSKLKYLFGRNGDYTNADAYQGTAWSVREKLIDSFNKTHEHWKKEDPKFIYYLSAEFLMGRSLTNTVYNLGLEGEYGNALREMGYHMEKVADAERDAALGNGGLGRLAACFLDSMATLDLPGWGYGIRYKYGMFKQGLKDGYQVEMPDIWLTKGNPWEVRRDDVKFEVGFGGRVERKKVNGKEMTVWTPSEKVIAQAYDNPIPGYATPTTSNLRLWDAVPVHEFDLSAFNAGDYDRAMLERERAEGISAVLYPNDSTPEGKELRLKQQYFFVCASLQDVMSRFRAVHGANWEALPEKACFQLNDTHPTIAVAELMRLLVDVEGLEWDAAWTITTKCLNYTNHTVMPEALEKWPVKVMAKMLPRHMEIIEVINEGWTKWLGVHLKDLKSEERAKKIAAMSIIHANPWNADEMLVNMAYLAVVGSSAVNGVAAIHSNIVKDEILNDFYEIFPSKFQNKTNGVTPRRWLAWCNPELAQLITEALGSSEWINDTEKLAGLRAFASDPAFQAKWAAVKKAKKAKLAELIKKIHGDDVNQNALFDIQIKRIHEYKRQYLNVLSIIWRYKQLKKMTPEQRKASAVPRVCVIGGKAASAYDMAKRIIRLVTAVGEVINKDPETKDYLRLYFLPDYNVTLAETIIPAAELSQHISTAGTEASGTSNMKFQMNGCLIMGTWDGANIEIAEETGVENVFVFGVRAEEINQLRKDRKNFKTDPRWDELMKDIEGGMFGDKDYFKPLVDSVNNMKVGNDWFLLANDFAGYLAAQEEVDATYKDQAEWLRRSIMYTAGSGKFSSDRTIREYAEDIWHVKPARPSA

SEQ ID NO: 3116 - protein, 500 aa, Ralstonia eutropha JMP134
MLRSRHLLSGSFFNGRTTMLKLQDPSLLRQQCYIDGRWTDGERRIDVTNPATGELVAQVPQFGVAETRHAIEAANRALPAWRARLAKERSALLRKWFELILANQDDLARIMTAEQGKPFAEAKGEIAYAASFIEWFAEEGKRVYGETIPAPVSSQRIVVTKEPIGVCAAITPWNFPAAMITRKAGPALAAGCTMVVKPASQTPLTALALAVLAERAGIPAGVLSVVTGSAGAIGGELSSNPLVRKLTFTGSTEVGRVLMAQTASTIKKVSMELGGNAPFIVFDDADLDAAVEGAIISKYRNAGQTCVCANRIYVQDKVYDAFAQKLVAAVAQLKVGNGMEDGVRIGPLIDEKAVAKVEEHIADALGKGARVLEGGHRHGLGHTFFQPTVLADVAPNMLVAREETFGPLAPLFRFKTEDDVVAMANDTEFGLASYFYARDLGRVWRVSERLEYGMVGVNTGLISNEVAPFGGVKQSGVGREGSHYGIEDYLVIKYTCMAGI

SEQ ID NO: 3117 - protein, 458 aa, Marchantia paleacea var. diptera
MPKRSNGSLVVRCAVSVVRFSKENVSCDLASENFTFSRDSFPVVSTVLRVSEAVYRMAAVASLGSALSVSSAALSQNVSVSNNATKESAFLGLRMGEVAKFGGALLSVSTVAANLKSKPGVLSVNAVTAPAETMNKPSSKKTATKSTCIITGASSGLGLATAKALADTGEWHVIMACRDFLKAERAARSVGIPKDSYTVIHCDLASFDSVRAFVDNFRRTERQLDVLVCNAAVYFPTDKEPKFSAEGFELSVGTNHMGHFLLARLLMEDLQKAKDSLKRMIIVGSITGNSNTVAGNVPPKANLGHLRGLAGGLNGVNSSSMIDGGEFDGAKAYKDSKVCNMFTMQEFHRRYHAETGITFSSLYPGCIAETGLFRNHVTLFRTLFPPFQKYITKGYVSEEEAGKRMAQVVSDPKLSKSGVYWSWNKDSGSFENELSEEASNPEKAKRLWELSERLSGLV

SEQ ID NO: 3118 - protein, 262 aa, Thiobacillus denitrificans ATCC 25259
MPVTLSTLKALRQKGEKIAVLTCYDASFARVFDAAGVDVLLVGDSLGMVIQGHASTLPVKLAEMAYHTRCVAAGTTRAFIVADLPFGSYQPSPERAYTAAARLMAAGAHMIKLEGGAVMVDTVAFLAARGIPVCAHLGLLPQSVNQLGGYRVQGREDGDAAQLVADARALEAAGAGLIVLEMVPAALAKTVTAALSMPTIGIGAGADCAGQVLVSYDMLGLYPRAPKFSKNFLAGAGSVDAAVRAYVAAVKDGSFPAAEHAF

SEQ ID NO: 3119 - protein, 320 aa, Arabidopsis thaliana
MSALTFPIGSVHHLMPVLALGTAASPPPEPIVLKRTVLEAIKLGYRHFDTSPRYQTEEPLGEALAEAVSLGLIQSRSELFVTSKLWCADAHGGLVVPAIQRSLETLKLDYLDLYLIHWPVSSKPGKYKFPIEEDDFLPMDYETVWSEMEECQRLGVAKCIGVSNFSCKKLQHILSIAKIPPSVNQVEMSPVWQQRKLRELCKSKGIVVTAYSVLGSRGAFWGTHKIMESDVLKEIAEAKGKTVAQVSMRWAYEEGVSMVVKSFRKDRLEENLKIFDWSLTEEEKQRISTEISQSRIVDGEVYISEKGPIKSVTEMWDGEI

SEQ ID NO: 3120 - protein, 837 aa, Thiobacillus denitrificans ATCC 25259
MSEPNADFVPLLALEPLPTSGRVLTQDLERYQFYHLGRLPSCPPIYTYKALAWALRDRLMSDWMNTYTTRDRPGRRRAYYLSLEFLIGRALANHVLNLGLDAESREALHNFGQTLEDIAELEPDAGLGNGGLGRLAACFMDSCATLNLPVMGYGLHYQYGMFHQHIENGYQVEDPDNWLRDGNPWEVERSEFTCRVQFGGHTEHYHDKAGIHRARWADTSDVLAVPFDMPISGYRNRVVNTLRLWKAAATDAFDLDEFNAGSYSEAVAAKNLAEHISMVLYPNDASENGKELRLRQQYFLASASLQDALRQWRVAGNSDLSKFAEHNVFQMNDTHPTIAVAELMRLLLDIMGMQWDEAWAITSQCMAYTNHTLLPEALERWPVELFERLLPRPLEIIYEINARFLREVAVKWPGDMERRRRMSIIEEEPVRQVRMAWLAIVGSFSVNGVAALHSRLLQEGLFRDFVELWPDKFNNKTNGVTPRRWLAHANPGLGKLVSARIGEGWIAELAQLEKLKAAADEPALQAEWRAVKRANKERLAALVKAECGVDFNPDALFDVQVKRIHEYKRQLLNVLHIVHLYNRLNHGELDGWADRCVLIGGKAAPGYAMAKRIIKLVNSVAEVVNSDPDINGRLHVAFLPNYRVSSMEIIAPATDLSEQISTAGKEASGTGNMKFMMNGAVTIGTYDGANIEILEAVGAENFFLFGLRADEVEALRPHYQPQAYVDKDPALRAVIDLLASGHFNLCEPGIFDDIVDALLSPQDPWMVLADFRSYVDAQERVAQAWQDPARWARMSILNTASSGFFSTDRTMQEYNADIWKLKPFAAEGRHASAGTAV

SEQ ID NO: 3121 - protein, 816 aa, Arabidopsis thaliana
MGETGDDAGPSEQGPSNQTWWPSEFVEKFGSVYLGSQEETSSTKDSPRNLGQDGLPSSTASNILWSTGSLSEPIPNGFYSVIPDNRLKQLFNNIPTLEDLHALGDEGLKADVILVDFQKDKKLFRQKQLITKLVSGLNSKPATIIKKIAGLVADVYKQSTLQSPAKSTQSFENCGIQLLGQIKHGSCRPRAILFKVLADTVGLQSRLVVGLPSDGAAESVDSYSHISVTVLLNSVEMLVDLMRFPGQLIPLSTKAIFMSHISAAGESDSAENDSCDSPLEPNSPMFGYPEKFDHENAEKDENLSLHRKLDGSPNTSGPPSRNMLLRSASALERKLSFSQSESNMANEFWRQSRRKVIADQRTASSSPEHLSFRARTKSMLSGDKNLARDFTGDVATSSCKSVGGAKMETKRIRRRSISITPEIGDDIVRAVRAMNEALKQNRLSKEQGDDDSSPNSPNDRTESSHLQKNVSGFHLDAHDQVSGGRSTLSREPLDPQKAISLPSSPQNYRSQYEQSGSSHRNISHIWDKVLGSPMFQNKPLLPYEEWNIDFSELTVGTRVGIGFFGEVFRGIWNGTDVAIKVFLEQDLTAENMEDFCNEISILSICFHQCMHLRLLVVILFLGACTKPPRLSLITEYMEMGSLYYLLHLSGQKKRLSWRRKLKMLRDICRGLMCIHRMGIVHRDIKSANCLLSNKWTVKICDFGLSRIMTGTTMRDTVSAGTPEWMAPELIRNEPFSEKCDIFSLGVIMWELCTLTRPWEGVPPERVVYAIAYEGARLEIPEGPLGKLIADCWTEPEQRPSCNEILSRLLDCEYSLC

SEQ ID NO: 3122 - protein, 433 aa, Bacillus subtilis subsp. subtilis str. 168
MAYPNGKLSEEKVFKDPVHRYVHVRDKLIWDLIGTREFQRLRRIKQLGTTYLTFHGAEHSRFNHSLGVYEIVRRMVDDVFKGRPEWDDSERELCLAAALLHDLGHGPFSHSFEKVFHLDHEDFTRGIILGDTEVNQVLRKVSPGFPQDVAEVIAKTYKNKQVVSLISSQIDADRMDYLQRDAYYTGVSYGHFDMERILRVMRPREDQIVIKESGMHAVEDYIMSRYQMYWQVYFHPVTRSAEVILTKILHRAKQLHDEGYVFTHAPVHFYSIFEGKLTLEDYVKLDESIILYYFQAWEDEEDAILSDLCRRFINRQLFQYVEFNPNEEMSAYFELTSLFKEAGIDPSYYLVVDSSSDLPYDFYRPGEEEERLPIHLLTQNGQIKELSRQSAIVESISGKRRTDHKLYYPKDLICDGTKHPEAKMKIRQLLGLT

SEQ ID NO: 3123 - protein, 296 aa, Bacillus thuringiensis serovar konkukian str. 97-27
MVIQWFPGHMAKARRQVTEKLKLIDVVIELVDARLPLSSRNPMIDEIITHKPRLVVLNKADMADDRLTKQWIAYFKEKGHMAISINAQAGQGMKEIAAACKVLVKEKFDKMVAKGIRPRSIRALIVGIPNVGKSTLINKLAKKNIAKTGDRPGVTTAQQWIKVGKEMELLDTPGILWPKFEDELVGLRLATTGAIKDSILNLQDVAVYALRFMEKHYPERLKERYNLNDIPEDIVELFDAIGKNRGCLMGGGMIDYDKTSELVLRELRGGKLGKMTFETPEEFAEQTEDAEKVEEV

SEQ ID NO: 3124 - protein, 316 aa, Rhodobacter sphaeroides 2.4.1
MTVVLTTSPGFGRHGRVPARIEAEGWTFLRAADAAEMEAHLPEADYLVVGLVPVTAEVLAKGPRLKGVLKHGVGVDNIDIPACTAAGLPVTNTPAANADAVAELAMGLMFAMARFIPQGHASVTSGGWDRRIGTQLGGKVLGIVGLGNIGKRLARLARGLGMEVLATDRVEDPAFARDCGVTYLPLEELLARADYVSLHVFGGAGNAALIDDRALARLKPGARLVNLARGEVVDLDAVARALESGQLGGVAIDAYVTEPPDVSHPVFAHPNAVFTPHSGADTLEALENVGLMVIEDIRTLIAGGRPARCLNAAELG

SEQ ID NO: 3125 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 3126 - protein, 122 aa, Arabidopsis thaliana
ERADQPSERPRASLRLSSVIRVAFPVKATMVVLLNGLKSSVAFQATRRVTTAFPSITGNGGGVNCMQVWPPMGRKKLGTFFNLPALTVSEWVKEVDYLIRTRGIPGVESRLEHGLVSRGPGT

SEQ ID NO: 3127 - protein, 425 aa, Arabidopsis thaliana
MGNALVKKEPPPPVVLVPPLFDYPPLSARTRMLESSYNLLFGKLALRCLFEDYFEEANRFTGKFLLKPTDDPHVDLVASVSGAVDGRVEGDFVGNAEFRWQSDVDDPHTFVDLSVSTSNPVLLMRSSAYYPKYGIGAFAVYPLISKITGKSSEEYRIMGLRYGSTNLSVGATVTPFSANNELPKHAWLVSKMGSLTVGVQYEPLHGSKDLAKYTDPRNWSCAAGYGVGSQSPLTPSFNIGIELARSSQFIASFYQHVVVQRRVQNPFEENQVVGITNYIDFGFELQSRVDDSKTPPNAPDSLLQVAASWQANKNFLLKGKVGAHSSTLSLAFKSWWKPSFAFNISATTNHRTGNVQCGFGLRVDNLREASYQRADPNFVMLTPNKEHLAEGIVWKMGKRPMYQADVDAENFSELPKELRPSQKIL

SEQ ID NO: 3128 - protein, 228 aa, Lactuca serriola
ATVLTPYAFSKLQEQLVLAPQYASLLVDESYFIVRHHTEINGGSKVIWIPDDEFISCSCHDFEFSGILCRHVLRVLSTNNCFNVPYQYLPIRWRSQIGTGNDQNAQNQMLQLQSVVSSLVSEAVETDERLNFVSGEINMVLTRVKEFPGACNDMAYDDDDDDSTPDSLILPEVEDSDNSIVHGFTRHSHEGGLNLGKLKERRSNSKRRLACCGQFGQDANDCPLMGSG

SEQ ID NO: 3129 - protein, 2679 aa, Mesorhizobium sp. BNC1
MTQSVLPDIAAIDENVGRIAIVGMSGRFPGAPSVDALWDLVSKGKHAFAHFRPEELEDAFEDAVRASKDYVPARPYLDDVDLFDAEFFGMYPRETALIDPQFRVFLEICWEAIEGAGYDPYSLPGQVGVFAGSALSTYLINNVLSDREKAEAFASNYQVGMFSELIGAINDTLATRVAYKLDLRGPAFTIQSACSTSLLAVAQACQNLLTYACDMALAGGVSITFPQKRGYIHQEGGMVSQDGFCRPFDADAGGTVFGSGAGVVLLKRMEDALKDGDHIHAVILGYGVNNDGSSKVGYTAPSVDGQAEAISAAHASAGIDPGTIGYIECHGTATPLGDPIEFAGLRKAFGDASMGQSVCALGSVKGNLGHLDAAAGVTGLIKAVHALKHAKIPPMANFQNPNPRIKLEDSPFYIPRELHDWPAQDHPRRAGISSFGVGGTNAHLVAEEAPPSPDLQEEEKEENSSFIIPLSARNESSLRAARRNLAAMLKSGPHMPIAAVAHTLQHGRHHFSHRAAVIAGNIEEAIAGLEGERPITGKATETSPPVVFMFPGQGAQYVGMGLGLYEREPEYARWIDHGARLLEEQAGIDIRKFLCRNNVQGEELSAALKDTRITQPALYLVEYAAARLWMSRGLKPDAMIGHSVGEFVAATLANVMTFDDALLLVAARGQLMQEQPKGAMISVRADAETVRDFLDDGVEIAAINAPKLCVVSGTFEAADVICKKLEAADIAFSRLHTSHAFHSAMMNEAAAALREQTDKIAYGRATIPYISCLTGEWQTDELGTSPEYWARHCRDAVRFAEGLVTVCRDRKPALLEVGPGRTLSTFAAQTIGRSDLAAVIQSLPEHDRASQAASAFAEAHARLWVAGCTLEWPALPAEARRRVPLPTYPFERRRHWIDPPPPIRRAIPNVEASPTGQAASQDGPPYPTPSFGNTPMNAVTPAPSPSRIEKLENALLARLAEMSGEEMTPDALCATFLELGFDSLFIGQFAQKIEKEYKVKLSFRELLGNIPSVSALARHLDKEMPPEAVQQPLPAQTAQGPGQAVSSPARQQQAITAPPPTAGAVDAIFQSQMLMMQQLFAQQIQALQAMGGAQAAQPPEELPAPTAQAPAALPPSSVPAKMADREIGGERLRLHKPGARASDGELSPEKRKFIADLAESYAARNARSKAFTAAHRSRLADPRTAAGFRPEWKELVFPIVSDRSKGSRIWDIDGNEYIDLVNGMGQTAFGHAPDFVVDAIRAQTEKGFAIGPQTPLAGEVADLISKMTGHERVTFCNTGSEAVMAAMRVARAVTGREKIVVFGNDYHGQFDEVLVKGRTRNGSPVALPIAPGIPPSSLSNMTVLSYGSSESLDWIRANAEDVAAVIIEPVQSRHPELRPVEFVRELRQIANEREFALVFDEVVTGFRVHPGGIQAVWGIRGDMATYGKVLGGGMPIGVLAGDSRFMDALDGGRWNYGDDSAPMVAPTFFAGTFVRHPLVLAAAKAVLRHLEGDGQALYTRIADRTKLLVDELSADLAARGIEGCINHYSSWFVTDFSSRDPLGMLFYPKARMLGLHIQDGYPCFLTTAHAEEDFRRIAEVFRETLDALQRVGILAPAGERASPQPAPVARPAAENVITSAGLTESQKEIWLAAQAGDEASCSFNESFSLNLQGTLDKEIFVQAIEMVVARHDALHIRFSRAGDRFEMIPDFRIPLETIDLTHNNTPEAALEEIVAEEASTPFDLANGPLARARLLSLAQDRHVLIFTAHHIVCDGWSANVILEELASAYTALCDGRTPDLPPALSFAAYADDVAAREAQPATEEFWLKQFETIPELPEMPTDRPRPEQRTFAGGTCTAFVEKDVYKRLKMAGAKSGATLFSTLLGALQVMISRLSGSTDIIIAIPSAGQSLVPDQTLVGHCVNLLPIRQQIDAEARFEEHLRQTQQLVLQAFEHQDYTYGTLVRKLGLKRDPSRLPLTEIQFNLERVARNAVFKGLSAKVTPNPKAFSNFDMFLNMVEGNDGIRIDIDYNGDVFDRATIERWLGHFTILVSVLADGMGAKIADLPILSENEMRWLIEELNETDADYERDRFMFELFAAKAAEQPKAIAAVHEGKSITYGALEARSNQLARHLQTKLSMPGLRVALALDRSIDMLVALLAIMKAGHTYVPLDPGHPPARLAQTMKTARVSGVICASGEIGKLGEPDTSVIRMDTESEEIARQDSRPLDLQLLDTEAPAYVIFTSGSTGTPKGVEISHRALVNFLSSMAMEPGFSSEDTLLAVTTISFDIAGLELYLPLIMGGRVVIANRTEVQDGFALVKLLRASGANVLQATPTLWQMLVEAGLSNQPKLKMLCGGEPLPKDLARKLLTIGGELWNMYGPTETTIWSSVARIVNADDPIHIGRPIANTQLYILDGHDRIAPVGVTGELYIGGEGLANGYFDRLDLTQAAFRSVRIGDGLPRRLYKTGDVGRRLPDGTLQLHGRRDNQIKLRGFRIELGEIEAVIGKKAGIRQCAVVAARNKNGDRQLVCHFVPDGQELSPDELSTHAKEHLPAHMVPSFWVATADLPKTANGKLDRKTLEERGVPQRHSAAPVRIKPRTPMEQKLSVIWQEVLQVGEIGIHDNLYALGADSLSIFRIAARMMDDGLPLEAKHLMRHPTVAGLAGFAEEQGNAAANGAVAPIPSLRDFRHGARRRLERLT

SEQ ID NO: 3130 - protein, 328 aa, Trichodesmium erythraeum IMS101
MYLYYALGFILLLVALGIVIYLITPRSYESSNTVANSYDDWTQDGILEFYWGEHIHLGHYGSPPRRKDFLQAKADFVHEMVKWGGLDKLPRGTTVLDVGCGIGGSSRILAKEYEFEVTGVTISPKQVQRATELTPQGVTAKFQVDDALALSFPDNSFDVVWSIEAGPHMPDKVKYGSEMMRVLKPGGILVVADWNQRDDRQKPLNYWEKPVMRQLLDQWSHPAFSSIEGFSEQIAETGLVEGEVATADWTQETLPSWFESIWQGIVRPKGLIKFGFSGFIKSLREVPTMLLMRLGFGAGLCRFGMFRAVKSNSVPVSTETATTEVANA

SEQ ID NO: 3131 - protein, 478 aa, Mesorhizobium sp. BNC1
MKRSRKVKILATLGPASSDEEIIVRLHEAGADAFRINMSHTDHPTMRELVARIRSVETQVSRPIGILADLQGPKLRVGTFADKSATLSIGQEFTLDDNPAPGDATRVHLPHPEILQAVQPGHRLLIDDGRLQLAALKTDGRSIVARVIAGNKISDRKGVSLPDTELPLGALTEKDRRDLDAVLQTGVDWIALSFIQRPQDLAEVRKIARGRAALMAKIEKPQAVKRLPEIIELSDGLMVARGDLGVEMPLEAVPGIQKQITRACRRAGKPVVVATQMLESMITAPVPTRAEVSDVATAVFEGADAVMLSAESAAGQYPVEAVAMMNAIAIQVERDPVFNDVINAQRTEPEATGADAISLASREIAETLKLAAIITYTASGTTGLRAARERPKVPIIALSPVVETTRRLSLVWGTHCVVSEDATDLDDMVDRACRIAYEEQFAKPGDRVIITAGVPLRTPGVTNMLRIAYIGSDGLSGL

SEQ ID NO: 3132 - protein, 454 aa, Oceanobacter sp. RED65
MKSRSVLDRFLKQHPDVETIELLVADTSGVLRGKRVEKSLLTKVFEQGFYLPGSIMSLDATGATVEEAGLGAKVGDKDRLCKPIPETLSIVPWHDARDRAQVLCTMHEDDGSAFFADPRQVLKRAVDKFETLGYTPGIALELEFYLIDPERDINGQIQPPLIPGTNRRMTSCQVYSIDELDDYDFFIRDVIEAAAQQGIPADTVIAEYAPGQFEVNLNYGNDILAAADNAILLKRVIHSVAKKHGMMASFMAKPYIQESGNGLHIHLSLMDEQGNNIFADDDPTQNPFMRHAVAGLLDMADATQAFLFPNINSYRRLDPGAYAPTSKTWGNDNRTVAIRIPSGGKDATRLEHRISGADANPYLAVTSILAGVVEGITNELTPPEAVVGDAYEQDHEHISDNARDALRNMEGDARIQEWFGKDFVQVYSICKWQEIRLFEHQITAKEYDLLLPYL

SEQ ID NO: 3133 - protein, 483 aa, Oceanobacter sp. RED65
MPSQLLKTQSYVNGQWKDAQSGQEYQVVNPATGELIAKVADCAAADAEVAVELAHEAFLSWRKTTAKERSQIMRKWFDLIMTNQDELAEIMTMECGKPLAESKGEVAYGGSFIEWFGEEAKRVYGDMIPAPAGDRKVLVNKQPVGVCSAITPWNFPLAMITRKCAPAIAAGCTIVIKPAEATPLTALALCELAEQAGLPKGVLNVVTASSGKEVGEVLSTHPLVKKISFTGSTPVGKILLKQSADTVKKLSMELGGNAPFIVFDDADIDAAIKGAMASKYRNTGQTCVCANRFIVQSGIHDEFVKALAKASDELKLGNGLDEGITQGPLINKAAIDKVSGLVDDAKKKGADVVTGGEPFSSKGGYFYKPTVLTGIKDGMDIATEEIFGPVCPVFKFDKEEEAIAIANDTPFGLAAYFYSQNLSQIWRVADELEYGMVGINEGIISTEVAPFGGVKESGMGREGSKYGIDEYIEMKYLCMGGLA

SEQ ID NO: 3134 - protein, 409 aa, Solibacter usitatus Ellin6076
MSESEIPGQVVVDLEADQSAEGGRRMVLNMGPQHPSTHGVLRLLMELDGENIMKCVPDIGFLHTGIEKEFEEKFYQQAVTLTDRVDYLAPLSNNLGWCLAVEKLLQLEIPPQAQWMRVMLTELTRLNSHLVWLGTHALDIGAMSVFLYCFREREEILKIFELFSGQRMMTSYFRIGGLALEPPRGWQQRVKKFLDVFPSRIDEYENLLTNNRIWTGRTKGIGFISLEDMLDLGITGPMLRAAGLKIDARKDAPYSSYEKFDFEVPTSTDNDVFARYQVRVEEMRQSTKIVRQAMEGMPAGAWKADAPHVVLPDREKMKTQMEALIFHFKIVTEGFRVPEGEVYQVIESPRGELGYYVVSDGTTKPYRVHMRTPSFGNLQAVPKMVEGSLIADVIASIGSMDFVLGDTDR

SEQ ID NO: 3135 - protein, 243 aa, Yarrowia lipolytica CLIB122
MSSELPPLEQAKRIAAHQAVEQHYPKDAKVVGIGSGSTVVYVAEKIASLPKELTKDTVFISTGFQSKQLIQNAGLRLGCIDQYSNGDLDVAFDGADETDPQLNCIKGGGACLFQEKIVAECARKFVVVADYRKQSKALGTVWIQGIPIEVVPDAYNKVIADLKKMGAQSAVLRPGSPGKAGPIITDNGNFIVDAYFGEIQPDAVKDLHIKIKLLLGVVETGLFTNADVAYFGNADGTISTITK

SEQ ID NO: 3136 - protein, 218 aa, Triticum aestivum
MLKKLISKTKSKKKKEAASSSLPTLDRLHETLEMLEKKERLLQKKSSAEIEKAKDYTKAKNKNAAIQCLKKKKLYETQIEQLSNFQLRVHDQIIMLENAKATTDTVDALRSGSSAVKAIQQSLSIDDIENAIEEANEHTENMKQIQDALATPFGASAEFDEDELEAELEDLEEEELDLELPEPPRGTRVAPSALAASSSRLAASDFAELTKLQAEMAI

SEQ ID NO: 3137 - protein, 245 aa, Acidobacteria bacterium Ellin345
MAETHPIMAARVTRSILLSEKTKHIEFEFLDRPKFDFIAGQFVSVREPKADGKFITRAYSIASDPRDDNTLDLCLNRVENGFMSNYLCDREVGDEVRMHGPHGHFVLHEELKDTIFISTGTGVAPFRSMGRWLFQHPERYKGREFWMIYGTRYADDIYYRDEFEQMEREHPNFHYVCTLSRGGDAWTGRKGYVQDHLREILKAHDGGKDMQVYICGLNEMVSGVRDVLKDEFGWDKKQINFERYD

SEQ ID NO: 3138 - protein, 267 aa, Sulfolobus solfataricus P2
MLGKVIQLIKRSDLVVEVLDAREPSLTRSKKIEDIIVKNYKNILLVLNKGDLVPLWVLKAWKDYFKTEENIESVYVSATSHLGTKILRDTMKSLLKGNKGIVVFVGYPKSGKSSVINALKGRHSAQTSAHPLEYGYTKSIQLFKIDNKIYAWDTPGVIPPDGNELEKTIRGYNADLLEDPVKPALMLINRVIEFSKESLISVYKVDFNNPYELLERIAIRRGWFYKSTKEPNIDMAARAVIRDYHEGKIAYYTLPPSLYRDDKSNSI

SEQ ID NO: 3139 - protein, 228 aa, Pyrus x bretschneideri
MGMTGMIYMVTMVFSLTVLVLCSSTVGYDYFQFTQQYQPAVCNSSTTPCKDPADKLFTVHGLWPSNWNGSHPVNCTNKTMNSLTMGNLTAQLEIIWPNVLNRNDHAGFWNRQWNKHGTCGVPKINDSLQYFRTVIKMYITQKQNVSEILAKANIKPEGKNRTLVDILKAIRSGTNNKAPKLKCQKKSSMTELVEVSLCSDHNITQFINCPRPFPQGSPHFCPNNSIQY

SEQ ID NO: 3140 - protein, 346 aa, Sordaria macrospora
EIGPYRLKDENTLVYNDGAWNEFANVLFVDNPVGTGFSYVDTNAYIHELTEMASNFITFLERWFALFPEYEHDDLYIAGESYAGQYIPYIAQAIIERNKNAGPVNHKWNLAGLLIGNGWISPKEQYEAYLQFAYEKGIVKKGTDLATRLENQQRLCQLKITESPDKIDYTECEEILQDMLQQTAGGVGASGKPQCYNMYDVRLKDDYPSCGMAWPPDLKSVTPYLRKKEVIKALNINENKSTGWTECNGQVGLNFHPKTKPSITLLPDILSSGVPILLFSGAEDLICNHLGTEALISNMEWNGGKGFELTPGTWATRRDWTFEGEPAGFWQQARNLTYVLFYNSSH

SEQ ID NO: 3141 - protein, 1786 aa, Anabaena variabilis ATCC 29413
MNTYTIDNHNSYSLVTNQSQECQNTLANLRVIIADLLKCEPEEVDVKVPFLEMGADSIVLVDAIRQIENNFRIKITIRQLFEELTNLSVLANYIEENVKLEPSTLLGQETLELSVNPQPLPQSQQSEQKSETLVEIVLRQQFELMSQQLEILRESNLPTNLSVTPSQNQAAKSVPNAVVQTTPDLKTGELNKSTLKKADSPSSFWRVEQSQAKTLTSQQQQYLNSLIARYTKRTAKSKQRSQSYRPVLADRRASIGFRPETKEILYPIVGDRSQGSRIWDVDGNEYIDISMGFGVHLFGHNVPFITAALEDQIKQGIQIGPQSKLAGEVATLICEMTGMERVTFCNSGTEAAMTAMRIARAATGRAKIAIFKGAYHGHFDGTLAIPQTSEDGKLPAQPMVPGVLQNMVDDVLLLTYGTPESLEIIKANAHELAAVLVEPIQSRKPDLQPKEFLQQLRVVTQQLDIALIFDEVITGFRVHPRGAQAWSGVDADIVTYGKLIGGGMPIGVIAGKAAYMDKIDGGFWSYGDDSYPEVETTFFAGTFSKHPLTMAATRATLLHLKAEGASLQERLNQRTSNLAATLNSYFEQANVPLRIVHFSSLFRFTLSGNSSYLYQPLEMDLLYYSLIEKGVYIWEGRTCFLSTAHTDEDVDYVIQAVKDSVQELQAVGFFSKSPKLSTNQPQTPKTSERVNSAVSLTVQDTIKPEVKEAFKIPLSDAQKQLWFLAQMGDNGSVAYNISLNIQLQGTLDLAAIRQAVQQVVQRHEALRTTISSQGDFQEILPSLKIDVPVIDFSNVKDSQLQVNQWLQNYSRESFDLSNGPLFRVRILKLAEQLHLLVVSAHHIITDGWSISIILQEMMALYSAKCQGHVCQLEPPIQFSSYLDWHRQFCATDEMKAHESYWLQKFADPVPVLDLPTDRQRPPSKTYQGGRQQLLLDPNVSAAIKQLSKQNGCTLFMTLLSAYAVLLYRLTNQDDLTIGIASAGRSLEGSERLVGYCSHMLPIRTQIVGDATFVEHLKACKSVLLEAYEHQDYPFAKLIDKLRVNSNTGMSPLVNATFNLERPVAIPQMYGLESSLLPQSISFADYDIGLNVTEIDHELLLECDYNADLFDAATIDRILGHYQTLLLGIIASPQTLVSQLSLLTATERQQILVEWNQTQIDYDRNQCVHQIFEQQAQLTPNAVAVESGEQKLTYRELNHRANQLAHFLQSLGVKPEVLVGICVERSVEMLVAMLGVLKAGGAYLPLDPAYPQERLAHMLTDSQASVLLTSANLASQLPKSSAKLVKLDTDWQVISRQPIINPTGIVVPSNLAYVIYTSGSTGKSKGVLIPHQALVNHNYAIAKNYELKASDRILQFASFSFDVAAEEIFPTWLSGATLVLRPEEIFSIPDFVQFVKQQDLTVLNLPVAYWQEWVSQMPQISWTPNVRLLVVGSERVPLERFLTWQQLVGSNVSWRNAYGPTEATITATIYGSHLSSHQQTAASLFIGRPIANTQIYILDQHLQPVPIGVTGELHIGGNGLAQGYLHRPELTAEKFIAHPFSNQPTARLYKTGDLARYRSDGTIEFIGRIDHQVKIRGFRIELGEIETALNQHPQVRECVVIASDDQLAHQQLQAYIVFHQQLKVDSSELHRFLKQKLPEYMIPTSFFQLENIPLTPNAKIDRQALNRLGVLINNIEVNRVAPSNHIEEVLANIWTEVLNLKQVGIHNNFFELGGNSLLAMQLLNRVNEAFLIDLPLRSLFECSTIAELSELIQAYKLEHLESDALEQILAEVDELIDTEIEQMLAKF

SEQ ID NO: 3142 - protein, 283 aa, Leptosphaeria biglobosa 'brassicae' group
HTFYNELRVAPEEHPVLLTEAPINPKSNREKMTQIVFETFNAPAFYVSIQAVLSLYASGRTTGIVLDSGDGVTHVVPIYEGFALPHATSRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3143 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 3144 - protein, 226 aa, Lactuca saligna
ATVLTPYAFSKLQEQLVLAPQYASLLVDESYFIVRHHTEINGGSKVIWIPDDEFISCSCHDFEFSGILCRHVLRVLSTNNCFNVPYQYLPIRWRSQIATGNDQNAQNQILQLQSMVSSLVSEAVETDERLNFVSGEINMVLTRVKEFPGACNDMSYDDDDSTPDSLILPEVEDSDHSIVHGFTRNSHEGGLNLGKLKERRSNSKRRLACCGQFGQDSNDCPLMGSG

SEQ ID NO: 3145 - protein, 343 aa, Vibrio vulnificus YJ016
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMVELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 3146 - protein, 143 aa, Shigella flexneri 2a str. 301
MAIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 3147 - protein, 572 aa, Xylella fastidiosa Temecula1
MHHDTSLIDIIAVGLSLAFVLGALAQRLKLSTLVGYLVAGICVGPFTPGFVADQQIANQLSELGVMLLMFGVGLHFSLEDLLEVKAIAIPGALVQIAAATLLGWGLAWTMGWPMVQGVVFGLALSVASTVVLLRALEERRLIDTQRGRIAVGWLIVEDLVMVLALVLLPALAQMLNGNESVAGHTQNAGSDSNAMLTALGWTLLKMTGFVAVMLVVGRRVIPWSLEKVAATGSRELFTLAVLGIALGVAFGSAKLFGVSFALGAFFAGMVLKGSETSHAAATDSLPLRDAFAVLFFVAVGMLFNPAILIEHPFQVLATFLTITIGKSAAAFLIVRAFGHPTSTALTISTSLAQIGEFSFILAGLGIQLAILPETGRDLILAGALLSIIANPFLFTWLDRWQAQQTAEETTLVEPELPPGPSPDLYNHAIVIGYGRVGSMLAQLLQSRHVPLLVIDDNSEHVLKAHAAGIPAIRGSAAADLVLAEAHPERAKIAVLAIPQPLEAGEILAKLRALNPELTLVARAQNDAEVKHLLGHGADATVVAEHEMAHSLAEMVLSSTNHPNSTRLQPAIA

SEQ ID NO: 3148 - protein, 1121 aa, Ralstonia eutropha JMP134
MKRLTEPANALLLNADPLWYKDAVVYQLHIKSFYDANGDGVGDFAGLLAKLDYLVDLGIDTIWLLPFYPSPRRDDGYDIADYRNVHPDYGTLAEARRFVGAAHARGIRVITELVINHTSDQHPWFQRARKAKPGSAARRYYVWADNDQAYAGTRIIFCDTEKSNWSWDPVAGAYFWHRFYSHQPDLNFDNPQVMNEVLSVMRFWLDIGVDGLRLDAVPYLVEREGTTNENLPETHTAIRHIRSHLDSHYQGRVLLAEANMWPEDAQQYFGRSSTGDKGDECHMAFHFPLMPRMYMAIAREDRFPITDIMRQTPELPTDCQWAIFLRNHDELTLEMVTSSERDYLWEVYASDRRARINLGIRRRLAPLMERDRRRIELMNSLLFSMPGTPVIYYGDEIGMGDNIHLGDRDGVRTPMQWSPDRNGGFSHADPERLVLPPLQGPLYGYEAVNVEAQARDPHSLLNWMRRMLALRRKHRAFGRGTLRFLFPGNRKILAYLREYEGEHILCVANLSRAPQAVELDLSAFNGRVPVEMMGATPFPAIGTLTYLLTLPPYGFYWFVLSEDAHPPAWHVSAPEQMPDQITLVLQNKGRPELTEAARRMLNDEVLPPYIRRRRWFGAKDDSIQRATLAYMAPFTKGTTGEEIYLGEVEVRLSGGRTERYQLPLGVLWDRESADSVSQLAHGLSMARVRQGSRVGLATDGFVLEPFAREVIRALRADAELQGPQETIRFRSEPGLSAVQPEQEEIQWMSAEQSNSSLAYNNTAVLKLVRRLSGGTHPEVEMTRYLTAQGYPHSPPLLGEVVRTGADGVPHTLMMVQGYILNQGNGWDWTLDYLSRVIDDALPAQESADEFAEAMNGYATMAGTLGRRLAELHAVLARPTDDPAFAPRPATDAETRQWAEQAMAAITHALALLEKRAQNDPKSASKRFMADVDTLLKARDALPALVNRLAAAAPGSLQTRFHGDFHLGQVLIAQNDTYLVDFEGEPGQPLDWRRRKTSPLRDVAGLLRSIDYAAATVGTDRQERTHAELPPALAERRGGLLERFRETASDAFLGCYRRHMEASGTPWADNAQFQPLLDLFLLERAAYEVEYEAANRVAWIDLPASGLARMVRKLMAGNLEAQ

SEQ ID NO: 3149 - protein, 423 aa, Gibberella zeae PH-1
MAAAESARVQEAQKLAKSDPRKAEAIYKDIISKAPSTTSDAATREYETALVSLGEIYRDEKKTQELVNLVKESRTVFSSFAKAKSAKLVRQLLDLIKEIPDSTDIEISVTKDCIEWATAERRAFQRQDLEVRLVALQMAKQSYYEALGLINNLLRELKRLDDKLRLVEVQLLESRVYHALGNIPKARAALTSARTSAASVYTPPMLQANLDMQSGMLHAEDKDFNTAFSYFIEALDGYHSQDESTRAQAALQYMLLCKIMLNLVDDVNNLMASKQALKYAGKNLEAMKAIARAHSNRSLEEYERALSSYRYELGSDTFIRNHLRRLYDAMLEQNLIKVIEPFSRVEIDHIANMVGLDTQQVERKLSQMILDKVIIGVLDQGAGCLIIFDETHRDESYDAALATIEKLSSVVDVLYTNQASMLE

SEQ ID NO: 3150 - protein, 175 aa, Zea mays
  misc_feature (98)..(98): Xaa can be any naturally occurring amino acid
  unsure (1)..(175): unsure at all Xaa locations
DAWADAWGRGEPYYVEAAPPVDVNKNTEWFMYPGVWTTYILLLFFAWLLVLSVSGCSPGAAWTVVNLAHFAITYHFFHWKKGTPFAADDQGIYSRLTXLTWWEQIDNGQQLTRNRKFLTVVPVVLAPSYRYLIASHLTDYKQPMFFLNTIAVFVLVVAKLPNMHKVRIFGINADI

SEQ ID NO: 3151 - protein, 848 aa, Ralstonia eutropha JMP134
MTDANRPEHADDTRTALSSATIRRAFLDHLFHTQGKPPDHASQNDLYQALAHTVRDRLVQRWISTSEAYLDQPSRTVAYLSAEFLMGPHLGNNLINLGIYSEVQAAMQALGLDLDQILAQEIEPGLGNGGLGRLAACFMDSLATLEIPALGYGIRYEYGIFQQAIIDGMQVEKTDSWLRNGNPWEIQRSEWAVQVRLGGHTEHYADGRGHYCVRWVPAKTVIGVPFDSPILGYRVNTVNTLRLWRADATEAFDFPTFNRGDYLGAVSKKITSENLTKVLYPNDETEQGKELRLEQQYFFVACSLQDMLRLLAADGMPVSRFHEKFAVQLNDTHPAVGIAELMRLLVDEHDLPWEQAWHITCQAFAYTNHTLLPEALEQWPLPLFGRVLPRHLEIIFEINARFLEEARIRFYGDDSRLARLSLINEHGERHVRMAHLACVGSHAINGVAELHSRLMREDVLKDFHEMWPEKFTSITNGVTPRRWLALSNPRLSRLVTDAIGDEWVTDLERLRALEPFADDAGFREQWQAVRRDNKVALAELVRDCTGVVIDPSSMFDVMVKRIHEYKRQHLAVLHIIALYHRIKSDPDLDLTPRTFLFGGKAAPGYEYAKLMIRFITSVADVVNRDPQVRDRLKVVFLPNFNVTYGQRIYPAADLSEQISLAGKEASGTGNMKFAMNGALTIGTMDGANIELCEAIGPDNFFAFGLTAPEVYALRATGYDPAAYYHRNDELRAVIDLVQQGFFSHGDASVFRGLFDAQLRHDPYLLLADFGAYVECQQRVCETYVRPQRWQRMSVLSCARSGRFSSDRAIREYCGRIWKVDPVPVHLLHRAGGTPRQADSRIRAVSKVR

SEQ ID NO: 3152 - protein, 305 aa, Xylella fastidiosa 9a5c
MQHRRWTRATATMIASFSSIAMPHVSLLPSPSPIAFIGGGNMARSMIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFATSHTTATQRTLAEELFNSVGKTLWITEEALMDAVTAVSGSGPAYAFLLAEAMEAAAIMQGLSTANARTLVQQTLLGAARMMTELGETPAALRHRVTSPHGTTEAAIATFQENDFQALVAKAIDAATRRARALGKANDTEPT

SEQ ID NO: 3153 - protein, 491 aa, Escherichia coli O157:H7 EDL933
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 3154 - protein, 963 aa, Thermus aquaticus
MDPLWYKDAVIYQLHVRSFFDANNDGYGDFEGLRRKLPYLEELGVNTLWLMPFFQSPLRDDGYDISDYYQILPVHGTLEDFTVDEAHGRGMKVIIELVLNHTSIDHPWFQEARKPNSPMRDWYVWSDTPEKYKGVRVIFKDFETSNWTFDPVAKAYYWHRFYWHQPDLNWDSPEVEKAIHQVMFFWADLGVDGFRLDAIPYLYEREGTSCENLPETIEAVKRLRKALEERYGPGKILLAEVNMWPEETLPYFGDGDGVHMAYNFPLMPRIFMALRREDRGPIETMLKEAEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRIVAFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVSLPLLWSPQRREGPGLFARTHGQPGYFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVVGGHPLLGRGLGAFLELEGEVYLVALGAEKRGTVEEDLARLAYDVERAVHLALEALEAELWAFAEEVADHLHAAFLQAYRSALPEEALEEAGWTRHMAEVAAEHLHREERPARKRIHERWQAKAGKA

SEQ ID NO: 3155 - protein, 283 aa, Leptosphaeria biglobosa 'brassicae' group
HTFYNELRVAPEEHPVLLTEAPINPKSNREEMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVFTIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3156 - protein, 255 aa, Sinorhizobium meliloti
MTGGRSGGRSSPEDFRHVALAETVSTNSECLLRAREGDPGNLWITAVRQTGGRGRRGRAWFSEPGNLYASLLLIDPAPVDRLHALPLAAAVAVHRAIRRVMPPGGAEAAIKWPNDILIDGRKTCGILLEGEVLADGRRALVIGCGINVAVMPEDALYPVTSLRREGATISPEELFAHLFVTMAETLAVWDRGAGVAAIIDQWRAAAKGIGEAITVNLPDRSLSGRFAGIDRDGRLLLDTGSGPPQTIAAGDVFFG

SEQ ID NO: 3157 - protein, 90 aa, Prochlorococcus marinus str. MIT 9313
MAISVTSACPQSTINELGIRQWPIWTCEASTFPWTYAEQETCLLLEGEVTVKPEGGKPVRFGAGDLVVFPAGMSCIWEVHQAVRKHYRFG

SEQ ID NO: 3158 - protein, 330 aa, Triticum aestivum
AYLGDTIEQVCTKKQAGTGPEFPGYRRPTRPALSFVRKGSDLVEVRKVLGEHAKSIMLMSKVEDPGGGANFDDILAESDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGESIVALHRIGNASVIKLLTV

SEQ ID NO: 3159 - protein, 139 aa, Triticum aestivum
LVDQKRRLAWRFNEHLGKKGISGFINVDYKSKILSVELTMPQDASRDTVRDTRGLSGGERSFSTLCFTLALHGMTEAPFRAMDEFDVFMDAVSRKISLDTLVDFAVAQGSQWVFITPHDISMVKPGDRVKKQQMAAPRG

SEQ ID NO: 3160 - protein, 393 aa, Streptococcus thermophilus CNRZ1066
MTKLSNRVLQMEESVTLAASARAKALKAKGRDILSLTLGEPDFVTPKNIQEAAIASIENGKASFYTVASGLPELKDAVSTYMENFYGYTVKHSEIVVGTGAKFILYAFFATVINPGDEVIIPTPCWVSYVDQVKMVEGVPVTFQTTEANHFKATVEQLEAARTEKTKVVLLNSPSNPTGMIYSKEELQSIGDWAVEHDILILADDIYGRLVYNGNTFTPISSLSDAIRKQTIVINGVSKTYAMTGWRVGFAVGEPEIISGMAKIISQTTSNLTSVSQYAAIEALTGDQSSIEEMRKAFEERLNTIYPLLAEVPGFEVIKPQGAFYLFPNVKKAMEIKGYTDVNDFTNAILEEAEVALVTGAGFGAPENIRLSYATDLDILKEAVRRIKAFMEK

SEQ ID NO: 3161 - protein, 208 aa, Zea mays
  misc_feature (52)..(52): Xaa can be any naturally occurring amino acid
  misc_feature (64)..(64): Xaa can be any naturally occurring amino acid
  misc_feature (104)..(104): Xaa can be any naturally occurring amino acid
  misc_feature (152)..(152): Xaa can be any naturally occurring amino acid
  misc_feature (166)..(166): Xaa can be any naturally occurring amino acid
  misc_feature (182)..(182): Xaa can be any naturally occurring amino acid
  unsure (1)..(208): unsure at all Xaa locations
MLLPERTRDELIKNAAYVDTPGKDILAADESTGTIGNRLSSINVENVEENRXALRELLFCCPAXLTIHLRGVILFEDTLYHNIQDDEPFDDVHLGGMRPPCYLXHQGPIVDDETDNDTTSHGHDHVAQRCPKDYQARARFAKRGPDLKIVPXSDHSVTMRPERSVXLAPYGIIWHENALVPXLCEPDILVDGPHDIDRCADFSDTVLA

SEQ ID NO: 3162 - protein, 598 aa, Klebsiella sp. LX3
MSFVTLRTGVAVALSSLIISLACPAVSAAPSLNQDIHVQKESEYPAWWKEAVFYQIYPRSFKDTNDDGIGDIRGIIEKLDYLKSLGIDAIWINPHYDSPNTDNGYDISNYRQIMKEYGTMEDFDSLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSGMRFDTVATYSKIPGFPNLTPEQQKNFAEQYTMGPNIHRYIQEMNRKVLSRYDVATAGEIFGVPLDRSSQFFDRRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQAAAPHSTSLSLSPWQAGVYKLR

SEQ ID NO: 3163 - protein, 270 aa, Mycobacterium sp. MCS
MNTEHRPPLDVTRLRASLGEGWRTLDVVDETGSTNADLLARAAAGEDVAGSVLLTEFQSAGRGRHGRQWTAPPRSQVAMSVAVDAGGVRPDAWGWLPLLTGVAVRDAVAEVSAVEAGLKWPNDVLVGEGKLAGILAEVAAPQHVVIVGIGLNVTLSAAEAPDPRATSLTMLGARNHDRTALAAALLRNLGTRIARWRRAAGADEGLIADYRRHSLTLGREVTATLPGDRRLDGTATDIDDLGRLTITTGRDSVTVAAGDITHLRPGPTRA

SEQ ID NO: 3164 - protein, 151 aa, Prochlorococcus marinus
MSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 3165 - protein, 339 aa, Achlya bisexualis
MAPVAIGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLQGGCKKVVISAPPKDSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLDTIKAAVKEASEGSMAGILGYTEDEVVSQDFVSDKRSSIFDANACIALNDNFVKLVSWYDNEWGYSNRLVDLVVHMATIDN

SEQ ID NO: 3166 - protein, 389 aa, Magnaporthe grisea 70-15
MSTVGKVSKANTRMTITCKAAVAWEAGKDLSIEDIEVAPPKAHEVRIEIYHTGVCHTDAYTLSGKDPEGAFPIVLGHEGAGIVESVGEGVTNVKVGDHVVALYTPECKECKFCKSGKTNLCGKIRATQGKGLMPDGTSRFKCKGKDLLHFMGTSTFSQFTVVADISVVAVQPEAPMDRTCLLGCGITTGYGAARVTANVEEGSSLAVFGAGCVGLSVVQGAVINKAGKIIVVDVNPAKEEWARKFGATDFVNPTKLPEGKTVVDALVELTDGGCDYTFDCTGNVQVMRAALEACHKGWGESIIIGVAAAGQEISTRPFQLVTGRVWKGCAFGGIKGRSQLPGLVDDYLQGRLKVDEFITHRKKLVEINNAFETMKQGDCIRAVVDMRAV

SEQ ID NO: 3167 - protein, 596 aa, Achlya bisexualis
MQVRRFSSVARKFFVGGNWKCNGSLSQAQSLVDTLNTATIPKNVEVVVAPASIHALSVKSSLRKDIGVSGQDTWSRGNGAFTGEVSAEMLKDAGINYTIIGHSERRQKGETNEEVASKAGYALSKGVSVIACIGETKIEREAQKTMQVVTEQLAAYAKNITDWSNVVIAYEPVWAIGTGLTATPEQAQEVHAGIRSWLKQNVSSAVADATRIIYGGSVTAGNAAELSKKADIDGFLVGGASLKPDFLSIINCQNDKAHQGGPVNIAINGFGRIGRLVLRAAQTNPLLNVVAVNDPFIPTEYMEYMLKHDTVHGHFDGTVRHEGDHIIVNDRKIRVFGEKDPKAIKWGESDVEYVVESTGAFTTKEKASAHLLNGPRKVVISAPSADAPMFVVGVNHDKYDPSMNIVSNASCTTNCLAPLAKVVNDKFGIIEGLMTTVHAVTATQLTVDGPSKKDWRGGRAACFNIIPSSTGAAKAVGKVIPELNGKLTGMSFRVPTANVSVVDLTVRLRNKASYEDIKAAIKYASENELRGILGYTDTAVVSSDFISDPRSSIFDADAGIVLTDDFVKLVSWYDNEWGYSNRVLDLITHMVHTERQ

SEQ ID NO: 3168 - protein, 414 aa, Aeropyrum pernix K1
MVEGVRVYGGWKDDLGLKIIPSKKVAKDLYEIYIGPQHPGSGHMRITIRVDGDIIVEADPDIGYVHRTMEKLGEIRGWIKPIPLFERMAIHDACNITLPYVLAVEKLMGVEPPLRAKYLRTLLCEINRIGAHLYGFAIFGVFLGHSTMYMWAMGDREVFIELAEALTGARLTHSYPIPGGARRDIPADFPDMARRAVRYMRKRLDEYAKIFLNNPVIRSRLEGVGVIPKKAAAEMGIVGPNARGSGIDYDVRLVHPYDAYPEIDFEVPVFEEGDALARTYVRVEEIKQSLRIIEQAVEWLEKHPREPIVDKYLYGKYPPLHKKVLEAEGRAKLLPTVAAMKVPPGRAIGRAETGRGETVYYVESDGGVNPYRVRIVTASARNVIAFKYVLPGHRVMDIPAIYGSLDYFPPEADR

SEQ ID NO: 3169 - protein, 265 aa, Xylella fastidiosa Temecula1
MESRLFNTPAKKAFGQHFLVDRYYIDRIIHAINPQPNDHIVEIGPGQGAITLPLLKCCGSLTAIELDRDLIAPLTAAATPIGKLDIIHRDVLTVDLSILAKQGNKKLRLVGNLPYNISSPILFHVLQQAAIIADMHFMLQKEVVDRMAAPPGSKVYGRLSVMLQAWCEVTTMFVVPPDAFQPPPKVNSAITRLVPRDPTTIRIADTKRFSDIVRAAFGQRRKTLRNSLADICTPAHFEHAGIRTNARAEQLEVTEFIALANAKNT

SEQ ID NO: 3170 - protein, 394 aa, Anaplasma phagocytophilum HZ
MLSERMNCIKPSPTLELSRLTLELRAQGLDIISLGAGEPDFDTPDHVKDAAIAAINAGKTKYTPVEGIPELKDSIIRSVRRDYGIDYVANQVLVGAGAKQCIYNLFMATINEGDEVIIPAPYWVSYPDMVKIAGGAPVIVNCGDYLKLTPELLRGAITPKTKWLIINSPSNPTGAVYSREELAAIAEVLKQHKHVLVITDDIYAKLVYDAEFCGILQVEPSLYDRVYIVNGVSKAYSMTGWRIGYILGNAEAIKAVSTIQSQSTTNANSIAQYAAIAALDGDQSFLDTRIKAFARRRDRVMDAVLSSGVLQADVPQGAFYVFISCGNAIGKHAPKVGVINDGSDMAKHLLNHRVAVVPGVAFGAPNFFRISYALSDDRLSEACERILEACSYLS

SEQ ID NO: 3171 - protein, 66 aa, Arabidopsis thaliana
  misc_feature (27)..(27): Xaa can be any naturally occurring amino acid
  unsure (1)..(66): unsure at all Xaa locations
MAFSMFFYTDVVTSPAQATMDAPFTGXKSSAYLPDTRKANNDITSITSNGCRGSCMKVWPPIGKKK

SEQ ID NO: 3172 - protein, 376 aa, Candida albicans SC5314
MSPVQLAEKNYERDEQFTKALHGESYKKTGLSALIAKSKDAASVAAEGYFKHWDGGISKDDEEKRLNDYSQLTHHYYNLVTDFYEYGWGSSFHFSRYYKGEAFRQATARHEHFLAHKMNLNENMKVLDVGCGVGGPGREITRFTDCEIVGLNNNDYQIERANHYAKKYHLDHKLSYVKGDFMQMDFEPESFDAVYAIEATVHAPVLEGVYSEIYKVLKPGGIFGVYEWVMTDKYDETNEEHRKIAYGIEVGDGIPKMYSRKVAEQALKNVGFEIEYQKDLADVDDEIPWYYPLSGDLKFCQTFGDYLTVFRTSRIGRFITTESVGLMEKIGLAPKGSKQVTHALEDAAVNLVEGGRQKLFTPMMLYVVRKPLEKKD

SEQ ID NO: 3173 - protein, 325 aa, Bacillus subtilis
MRSTLRKDLIELFSQAGNEFISGQKISDALGCSRTAVWKHIEELRKEGYEVEAVRRKGYRLIKKPGKLSESEIRFGLKTEVMGQHLIYHDVLSSTQKTAHELANNNAPEGTLVVADKQTAGRGRMSRVWHSQEGNGVWMSLILRPDIPLQKTPQLTLLAAVAVVQGIEEAAGIQTDIKWPNDILINGKKTVGILTEMQAEEDRVRSVIIGIGINVNQQPNDFPDELKDIATSLSQAAGEKIDRAGVIQHILLCFEKRYRDYMTHGFTPIKLLWESYALGIGTNMRARTLNGTFYGKALGIDDEGVLLLETNEGIKKIYSADIELG

SEQ ID NO: 3174 - protein, 417 aa, Rubrivivax gelatinosus PM1
MAEIKNYTLNFGPQHPAAHGVLRLILELDGEVIQRADPHIGLLHRATEKLAESKTYIQSLPYMDRLDYVSMMCNEHAYCLAIEKLLGVDVPVRAQYIRVMFSEITRILNHLLWIGAHGLDCGAMNILIYAFREREDLFDMYEAVSGARMHAAYFRPGGVYRDLPDTMPQYRVSKIRNAKALAKMNENRQGSLLDFIEDFCRRFPKNVDDYETLLTDNRIWKQRTVGIGVVTPERALNLGFTGPMLRGSGIAWDLRKTQPYDVYDRVDFDIPVGAGGDCYDRYLVRVEELRQSNRIIQQCAAWLRANPGPVITDNHKVAAPGRVDMKSNMEELIHHFKLFTEGFHVPEGEAYAAVEHPKGEFGIYLVSDGANKPYRLKIRAPGFAHLAAMDEMSRGHMIADAVAVIGTMDIVFGEIDR

SEQ ID NO: 3175 - protein, 219 aa, Haemophilus ducreyi 35000HP
MTQQEMKKIAAQAALQFVKPDTIIGVGSGSTVNCFIDALASIKDEIKGAVAASKASEDQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 3176 - protein, 140 aa, Brassica napus
MSHSAASSGKRRIRDLLTQSDNRVCADCGAPDPKWASANIGVFICLKCCGVHRSLGTHVSKVLSVTLDEWSDEEVDSMIEIGGNASANSIYEAFIPDGSSKPGPDASHDHRMRFIRSKYEFQEFLKPSLRITSGKTSSTK

SEQ ID NO: 3177 - protein, 533 aa, Thermoanaerobacter tengcongensis MB4
MKIIVTEKISENGIDYLKKYADVDVKTNISREELLEVIKDYDAIIVRSATKVDRELIEKGEKLKVIGRAGNGVDNIDVEAATQRGILVVNTPAGNTIAAAELTIGLMLAIARNIPQAYHAALNGDFRRDRFKGVELNGKTVGIIGLGRIGSLVASRLAAFNMRVIAYDPYMPDERFEKCGVKRVTLDELLEQSDFITIHIPKTEETKKMIGEKEFKKMKKGVRIVNAARGGIIDEKALYNAIKEGIVAAVGLDVLEVEPKYNVEHQDFHNPLLELPNVVFTPHLGASTYEAQENISIAIAQEVISALNGNLYGNIVNLPGLKSDEFSRLKPYMKLAEVLGALYYQINETPAKLIEVIYRGEVAKSNTEIVTLYAIKGFLKPILEEDVSVVNAKLRAKEMGIEIVEGKIEEIDHYSSLVILKITDTNGKRTQFAGTTYGEELRIVEYMGHKVNFEPTEYMLFVKNKDVPGVIGHIGNVLGDFGINISTMQVSPNKNDGTALMLVSTDKEIPEEAVESLNKLNSIIKAKAVKGLV

SEQ ID NO: 3178 - protein, 251 aa, Rubrivivax gelatinosus PM1
MSDIRRKLVVGNWKMHGTHATNEALLEGLKSAGPLPCEAAVCAPFPYLAQAAERLARSAIAWGAQDCSVHEQGAYTGEVSVAMLADFGCRYVIVGHSERRALHAESDQLVADKAQAALARGVTPIVCVGETLAQRDAGETEDVVKRQLSAVIHTLAHCVGEMVVAYEPVWAIGTGRTASPEQAQAVHALLRAQLAAATPRAAQMKLLYGGSVKPDNAATLFAQVDIDGGLIGGASLKAADFIAICRAASTR

SEQ ID NO: 3179 - protein, 459 aa, Pseudomonas sp. KIE171
MSEENKKQILKVRDFIEKHNIDTIRLGAVDIDGVWRGKQVGAEYFLNKAALDGTQISNILFGWDVADHLVDGLEFTGWDSGYPDIALIPDLSTLSLVPWQEKTASVLCDIQHLNGEPLNLSPRNLLRKAIEKAEQLGYKCYAAYEFEFYLLNDSIASISADQWRSINPVEKSGHCYSMLHHSSSSDIMGEVRKYMRDAGIVLEATNSEHGPGQYEINIKYDDALKAADDAIFVKNGIKEIAAKHGMTATFMAKPSAEWSGSSGHVHMSLSDLAGTPVFANPENPGALSEVGYNFLAGMVALAREMSAIYLPNINSYKRTAGASWAGGNSSWGFDNRTVSHRAITSAGSAARVENRIPGADTNPYLVIAASLLSGLYGIENKLKPKDPILGNAYKVSPELARPLAASLEEAAGIFRESEMARVIFPNEFVEHYAQMKVWEIKQSNSFVNNWELARYLDII

SEQ ID NO: 3180 - protein, 137 aa, Frankia sp. EAN1pec
MSAERTLILVKPDGVSRGLVGEVVGRIERKGLKIVALELRTLERSVAETHYGEHASKPFFGELVEFITSGPLVALVAEGPRAVEALRGLIGATDPVKAAPGSLRGDFALEIGQNLIHGSDSPESAKREIDLFFPGLS

SEQ ID NO: 3181 - protein, 148 aa, Arachis hypogaea
MASKRITKELKDLQKDPPVSCSAGPVGDDMFHWQATIMGPADSPYAGGVFLVNIHFPPDYPFKPPKVSFKTKVFHPNIYNNGSICLDILKEQWSPALTVSKVLLSICSLLTDPNPDDPLMPEIAHMYKSDRAKYENTARSWTQKYAMN

SEQ ID NO: 3182 - protein, 259 aa, Mycoplasma hyopneumoniae 232
MQKPVPKKRLGQNFLKDRKIAEKIVENIDLKNKEIIEIGCGTGFLTNFLLEKAKFVTCYEIDKNLIPILEKKFKNKNLRIINEDFLLAEFESKEKKTIIANLPYYITSKILFKIFANFEKFDKIILMVQNEVADRIVAKPKTPTYSKLSLASQYIAKVRKLFVVGPDSFFPKPKVNSAVVSFDFRANLDAKEMENFFWFTKRCFQFKRKTLYNNLIFFLNKQQIEKIYNFFQFAQNIRPQQLDLVTYIRLADFYFNNIF

SEQ ID NO: 3183 - protein, 339 aa, Medicago truncatula
MGGAKIKIGINGFGRIGRLVARVALKRDDVELVAVNDPFITTDYMTYMFKYDSVHGQWKNDELTVKDSKTLLFGEKPVTVFAHRNPEEIPWASTGADIIVESTGVFTDKDKAAAHLKGGAKKVIISAPSKDAPMFVVGVNEKEYKPEFDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKPATYDQIKAAIKEESEGNLKGILGYTEDDVVSTDFIGDTRSSIFDAKAGIALNDNFVKLVSWYDNELGYSTRVVDLIVHIAKQL

SEQ ID NO: 3184 - protein, 397 aa, Leuconostoc mesenteroides subsp. mesenteroides ATCC 8293
MTSTTEKVKTAVKELKKGKLIILSDDKKREHEGDLVGLASFVTAATVNEALSIARGVLAVPITKSRADELGLDQMTTHNSEKFGTKFTVSVDHIDSTTGVSAYERAATIKNLANLSTTSVDFETPGHIFPLVAEDGGVLTRQGHTEGAVELAKIAGVPPVAYIIEILAQDGKMAREKELKELAKKHDIFQLSMQDLINYREDQKQAGIDEGPTVYLPTQYGDFHLTEFSVNDEEKSDLLIQSSRSFDQIPLVRLHSECLTGEIFGSQRCECGPQLREALKTINKQGGALVYLRQEGRGIGLHEKLKSYVLQENKFDTYDANVHLGHLPDERDYKKAAKILKISGLTKIRLLTNNPDKVQSLIDEGIEVIEQVPLITGINDKNEQYMQTKKEKFNHKL

SEQ ID NO: 3185 - protein, 291 aa, Nocardia farcinica IFM 10152
MSRWDTANIPDQSGRTFIVTGANSGLGAVAARALARAGADVVLACRNLTKAEKVAAEIGARATVRELDLADLASVRAFAAGTERVDVLINNAGVMAVPHRTTADGFEMQIGTNHLGHFALTGLLLDKITDRVVTVSSGAHAVGRIDLADLNWERRRYQRWLAYGQSKLANLLFAYELQRRLGAAGSPILSVAAHPGYAATELQSHTETFLDSVMNVGNRILAQTAEMGALPELFAATMPVEPGAFYGPTGLGGMRGYPGRCGSTKASRDERVAGELWALSERLTGVTYSFD

SEQ ID NO: 3186 - protein, 531 aa, Mycoplasma mobile 163K
MKNVNSKKIVYQIYPSSFKDSKGTGRGDIKGIIEKLDYIKDLGVDYLWLSPIFKSPLKDNGYDVSDYLSINTLFGDLEDLKSLIKKAKEKNLKVMLDMVFNHTSTEHEWFKKWINNDPEYKDFYISKKSVGKPPTNWVSKFGGSAWKEYKKNNWYLHLFDETQADLNWENEKVKEKIKEVIRFYINLGVKGFRFDVINLISKSNFNEDETDGRKFYTDGKKVEDYLQELRNEFPKEGDFLTVGELSSTTMQKASIYSNLDKKRLDSAFTFHHLKIDYDEKGKFIYKKPDIKKLNEIFDTSFTETQKLNGYLAVFLNNHDQPRAVSRFIDEEFHNVGAKMLGMLTLSLPGDTYIYQGEEIGMKNPNFENKEDYKDVETLNYFKELKLEKANDGIKQKSRDNSRTPMQWNSEKNSGFSMVKPWINVAPSYKEINVEKQENDPNSILSFYRKMVKVSKSDKVFANGNITFLPYKENLIQFTRTYKNKTYYFIFSFSNKKISLDSKSNIIILYSNYEYEKNIIKPYQFIVGEISE

SEQ ID NO: 3187 - protein, 136 aa, Corynebacterium efficiens
MTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 3188 - protein, 402 aa, Rhodobacter sphaeroides 2.4.1
MTSSRLSSRLQAVQPSPTIAMTRLAAQLRREGKDIIGLSQGEPDFDTPVHIRQAAAAAIEAGQTRYTDVDGTPELKAAIVEKFRRENGLSYETNQISVGTGGKQVLYNALLATLDEGDEVIVPAPYWVSYPDMVRLAGGVPVTVSCPEEDDFLLTAPALRAAITPRTKWVILNSPSNPTGMGYSAAHLRALADVLLEFPHVLVMTDDMYEHLRYDGWEFATIAQVEPKLMDRVLTCNGVSKAFSMTGWRIGYAGGPADIIKAMATLQSQSTSNPSSVSQAAALAALTGPMEFLAERNEIFRQRRDLCLSALNQIEGLSCVRPNGAFYLFPSCAGMIGRTRPDGRKIETDTDFVMYLVEEAGVAAVPGSAFGLAPYFRISFATDTERLRTACERIRAASARLT

SEQ ID NO: 3189 - protein, 413 aa, Candida albicans SC5314
MKYSILAILAHLLTNIKATQEVFTLSDLPPDSCPIDSPISCSKNAQELENVNSCCYESPAGVILLTQFWDYNPATGPDNLFTQHGLWGNMCSYGYPQFCDPSLEINPNGEIIRSIIVDQFGDEELYNNMSYSWKDYHGKDSSFWAHEYNKHGTCFSTIKPSCYLSNTPKNQNLYDFFRIAIGLFNKLPTYDWLAEAGIVPTNSKTYSLSEIQSALNDKFGANVFIKCDYNHAINEIWYYHHVKGSLLQHNFLPIDSVAHTNCPSTGIKYPPKGKVAHPTLTTKTTTGTSTTIHNPTGIPARSYVHLSGKSGCLISNGKWYTSGTCATYHFKKTIDDSNIEIRSSKGICGINGNEEFTCSRAVSGGTDFQIKDGKIGYQDKFDWCFGSTTGSGSTAQTSVKLADGSCDSFQLLI

SEQ ID NO: 3190 - protein, 445 aa, Magnaporthe grisea 70-15
METVLASSGGTARADHLCVLVHGLWGNPAHMAQVAKALRDRYSRDQLYIIVAKRNSGSFTYDGIELGGQRVCREIEEELEKIKKTGGKITKISFIGYSMGGLVARYAIGLLEAKGVLEKLQCINFTAFASPFLGCRTPLKGWNNHLFNVLGARTLSLSGRQLFGIDKFRDTGRPLIAVMTDQESIFMSGLRRFKRHTLYSNIVNDRAAVYYTTSISKTDPFVDLDKVKLNFVEGYENVILDPDCPVRPKERVAPTAFKALKNAPFFLAMAVLLPIGITAFLLNAGVQTARSSKRLRAHRQSHDSKNYSKLPLWVKEVRGALEDAYENLNSSQRQEFLASETPSEDEGAGGAADDRASTMGVEKAEDDSRLALERKQSHAAMPTLALAPYQFSMIDSLDSLGWRKYRVWIQKNNHSHAAIIVRIVRDSYSEGYQVLKHWLDNEFII

SEQ ID NO: 3191 - protein, 277 aa, Bacillus subtilis
MKTKLDFLKMKESEEPIVMLTAYDYPAAKLAEQAGVDMILVGDSLGMVVLGLDSTVGVTVADMIHHTKAVKRGAPNTFIVTDMPFMSYHLSKEDTLKNAAAIVQESGADALKLEGGEGVFESIRALTLGGIPVVSHLGLTPQSVGVLGGYKVQGKDEQSAKKLIEDSIKCEEAGAMMLVLECVPAELTAKIAETLSIPVIGIGAGVKADGQVLVYHDIIGHGVERTPKFVKQYTRIDETIETAISGYVQDVRHRAFPEQKHSFQMNQTVLDGLYGGK

SEQ ID NO: 3192 - protein, 274 aa, Ralstonia solanacearum
MLDTLKFGFIGGGNMASALIGGLVSRGAPGANIVVVDPTEPARAHAAQTWGATTIAAPGAELADRDVIVLAVKPQQMREVCAQLAPHLRDSLVLSVAAGIRIQDLSRWLGGHARVVRAMPNTPALSGMGMTGLAARAGLGGTDRDIASAIANAVGKSVWVPDEAQIDAVTAISGSGPAYVFYFIEAMQQVALELGLSPEAGRLLAAETFIGAATLAEQSSEPVEVLRERVTSKGGTTYAALTAMDAAGIKPAFVRAMHAAAARGKAMGEEFGRD

SEQ ID NO: 3193 - protein, 470 aa, Salmonella enterica subsp. enterica serovar Typhi
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLKAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 3194 - protein, 216 aa, Lactobacillus reuteri
MKKTKIVSTLGPASTDVDTIVKLINAGANIFRFNFSHGDHPEHLGRIENVHKAEEITGKHVGLMLDTKGAEIRTTVQKEGKINFEIGDKVRISMDPSIEGTHDKIAVTYPGLYDDTHVGGHVLFDDGLIDMVIDEKDDANKELVCHVLNHGVLGSRKGVNAPGVSINLPGITEKDSSDIRFGLENKINYIAASFVRKAQDVLDIRELLKEKNMEDV

SEQ ID NO: 3195 - protein, 371 aa, Malus x domestica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNHERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 3196 - protein, 368 aa, Malus x domestica
MGKGGQSCNGVVRDAKPVEQENMAVWLVDVNTIKILPFKLPAIGPNDVRIRIKAVGICGSDIHYLKTMKCGDFQVKDPMVIGHECAGIVDKVGSKVKHLVPGDRVAVEPGISCAHCQQCKGGRYNLCFDMKFFATPPVHGSLANQIVHPADLCFKLPENVSLEEGAMCEPLSVGVHPFRRANVGPETTVLIVGAGPIGLVSVLAARAFGAPRIVIVDMDDRRLAMAKSLGPDGTVKVSTKMEDLDDELAKIKEAMGSEVDVTFDCVGFNKTMSTGLNATRPGGKVCLVGMGHGVTTVPLTPAAAREVDVVGVFAYKNTWPLCLEFLRSGKIDVKPLITHRFGFTEKEVEEAFATSARGGNAIKVMFTL

SEQ ID NO: 3197 - protein, 275 aa, Gluconobacter oxydans 621H
MSIQPVGQSFGRLVVDQKNVWIGTSWKMNKGPSEAIAAARALESFQPPEGIRSFVIPSFTSLRDVCSVLEDSALLVGAQNMHWEDSGAWTGEVSAPMIAECGASIVEIGHSERRQHFGETDWTVNLKVQAALRHGLRPLICIGDTSDEFEFGVSQETLARQVKIALHGVSRKDLGQVMVAYEPVWAIGSAGRPAEASFVSGIHTRLRAVVRELAGDSGVRIPLLYGGSVSQANIRDYVALPDVDGVFVGRAAWEPADFMRLVESVSGVVSRKIAA

SEQ ID NO: 3198 - protein, 393 aa, Bacillus subtilis
MKLAKRVSALTPSTTLAITAKAKELKAAGHDVIGLGAGEPDFNTPQHIIDAAVRSMNEGHTKYTPSGGLAELKNSIAEKFKRDQNIEYKPSQIIVCTGAKHALYTLFQVILDEEDEVIIPTPYWVSYPEQVKLAGGKPVYVEGLEENHFKISPEQLKNAITEKTKAIVINSPSNPTGVMYTEEELSALGEVCLEHDILIVSDEIYEKLTYGGKKHVSIAQLSDRLKEQTVIINGVSKSHSMTGWRIGYAAGSEDIIKAMTNLASHSTSNPTSIAQYGAIAAYNGPSEPLEEMREAFEHRLNTIYAKLIEIPGFSCVKPEGAFYLFPNAKEAAQSCGFKDVDEFVKALLEEEKVAIVPGSGFGSPENVRLSYATSLDLLEEAIERIKRFVEKHS

SEQ ID NO: 3199 - protein, 368 aa, Malus x domestica
MGKGGQSCNGMVRDVKPVEKENMAAWLVDVNTIKILPFKLPTIGPNDVQIRIKAVGICGSDVHYLKTMKCADFEVKEPMVIGHQCAGIVDKVGSEVKHLVPGDRVAVEPGISCAHCQQCKGGRYNLCPDMKFFATPPVHGALANQIVDPADLCFKLPENVSLEEGAMCEPLSVGVHACRRANVGPETTVLIVGAGPIGLVSVLAARAFGAPRIVIVDMDSKRLAVAKSLGADGTVKVSRKMEDLDDEVAKIKETMGAEVDVTFDCVGFNKTMSTGLNATRPGGKVCLVGMGHSMMTVPLTAAAAREVDVVGVFRCKNTWPLCLEFLRSGKIDVKPLITHRFGFTEKEVEEAFATSARGGDAIKVMFNL

SEQ ID NO: 3200 - protein, 480 aa, Escherichia coli K12
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 3201 - protein, 283 aa, Leptosphaeria biglobosa 'canadensis' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALTPSSMKVKIIAPPERKYSVWIGGSILASLSTFQQMWISKQEYDESGPSIV

SEQ ID NO: 3202 - protein, 148 aa, Solanum chacoense
MEQTFIMIKPDGVQRGLVGEIIGRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSWIYE

SEQ ID NO: 3203 - protein, 283 aa, Leptosphaeria biglobosa 'canadensis' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAERGIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3204 - protein, 283 aa, Leptosphaeria biglobosa 'erysimi' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQRMWISKQEYDESGPSIV

SEQ ID NO: 3205 - protein, 512 aa, Bradyrhizobium sp. BTAi1
MRSPCASVATPAPSLPHGCGLAHTHRHRDQEPSLSFVQKHQLWSAEQTEAALRMRRIAEEQGLKTIRFSFPDQHGILRGKALAVDAALSSLEDGCSITTTLLAKDTSHRTVFPVFTAGGGFGMSEMQGGSDALMVADPTTFRVLPWAPGTGWVLCDLYFANGAPVPFATRNLYRSALAALDQRGYQFKAGLEVECHIFKVEDPRLAPGDAGSPGQPGVPPTVSLLTQGYQYLTEQRFDQMQPALETIRANLTALGLPLRSIELEYGPSQCEFVLQPGIGMEPADTMVLFRSAVKQIAQRHGYHATFMCRPRIPNVMSSGWHLHQSLVARDGSNAFMTSETDGLSALGRHYMAGLLAHARAAAVFSTPTINGYRRYRAYSLAPDRAIWGRDNRGVMIRVLGGPGDRATRLENRIGEPAANPYLYMASQIAAGLDGVDRKLDPGPSADVPYETKASLLPKSLHEAVDALKADAFFRNAFGATFIDYYTFIKTAEIDRFNAEVSDWEQREYFEMF

SEQ ID NO: 3206 - protein, 283 aa, Leptosphaeria biglobosa 'thlaspii' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPGALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3207 - protein, 706 aa, Oryza sativa
MAYTSNAAYRKGAISKGTCGRLILEKTASAKHTIATAAVPSPQCQSRCGDVDIQYPFGIGANCSLAELFNVECKVQHGISKPFIGNVEVLNISLSRSTLRVLNGISTFCYNASGLMGGVHFRFNAKNTPFRFSDVYNKFTVIGCNTLAYIADDGGTGYQSGCFSQCRDLSGLVDGSCSGMGCCQTTIPRGMYYYNVTFDKRFNTSQISRFGRCSYAVLMEAASFNFSTTYINTTKFNGTNGGRVPMVIDWAIREKSCDIAKQNMTSYACLSSNSECVASTNGPGYVCNCSHGYEGNPYLPDPHGCHGVIIGFIVLMIIAFCGQLVIQRRKLTKIKKEYFRQHGGMILFESMKSKKGLAFTVFTEAELIHATNNFDKSRIIGQGGHGTVYKGTVKDNMLVAIKRCALVDERQKKEFGQEMLILSPINHKNIIKLLGCCLEVEVPMLVYEFVPNGTLFELIHGKNQGLQISFSTLLRIAHEAAEGLHFLHSYASPPILHGDVKTANILLDENYMAKVTDFGASILAPSDKEQFVTMVQGTCGYLDPEYMQTCQLTDKSDVYSFGVILLEILTGQVPLKLEGPAIQRSLSSVFLSAMKGNNLDSVLVSDIKGQESMELIGGLAELAKQCLDMCGANRPSMKEITDELGRLRKLSLHPWVQVDAEMAPENLLGGPSTINSGLEIETSSTGYLGEERENLPMNPGSTYYAR

SEQ ID NO: 3208 - protein, 253 aa, Zea mays
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAAQPDVDGFLVGGASLKPEFIDIINAATVKSA

SEQ ID NO: 3209 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 3210 - protein, 248 aa, Mycobacterium sp. MCS
MGDSTLILLRHGESEWNAKNLFTGWVDVDLTDKGRAEATRAGELIADLDRLPDVLYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGRTVLIAAHGNSLRALVKYLDGMSDEDVVGLNIPTGIPLRYDLDSDLKPTVAGGTYLDPEAAAAGAAAVASQGAK

SEQ ID NO: 3211 - protein, 159 aa, Brassica napus
MDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 3212 - protein, 477 aa, Deinococcus radiodurans
MTATPQASARPERPFATVNPYTGETVKTFPFLESAEIPALIERADQAYREWGQRPVTERAAIMRRAAELMLERTDELASLITLEMGKLLREAKGEVALAASILNYYGEQGPSFLEPKTIPVPQGEAAVLHAPLGVLLGIEPWNYPLYQVVRFAAPNLVVGNTVLLKHSELCPQSALALEQLFHDAGVPQGAYTNLFLRIADIEQVIAHPAVQGVSLTGSERAGASVAELAGRHLKKCVLELGGSDPFIVLDAEDLDTTVKAAATGRLSNTGQACIAAKRLMVVDDLYDEFVSRLGQTFSAFVPGDPADPSTRLGPLSSEQAARDLQAQVQDAIDKGATVVAGGQRPEHPGAFVQPTVLTDVTPDMRAYHEELFGPVAVVYRVRDEDEAVALANASTYGLGGAVFSSDLDRAQRVAERLDTGMVWINHPTSSAADLPFGGVKRSGFGRELSSMGMLEFTNQKLVRAFPTKQKPAQVAG

SEQ ID NO: 3213 - protein, 516 aa, Pisum sativum
MAVVAAPKKNNSFNKKDNPNLLLGRFELGKLLGHGTFAKVHLAKNIKTGEAVAIKIISKDKILKSGLVSHIKREISILRRVRHPNIVQLFEVMATKTKIYFVMEYVRGGELFNKVAKGRLKEEVARKYFQQLICAVEFCHARGVFHRDIKPENLLLDENGNLKVSDFGLSAVSDEIKQDGLFHTFCGTPAYVAPEVLSRKGYDGGKVDIWSCGVVLFVLMAGYLPFHDPNNVMVMYKKIYKGDFRCPRWFSPELVNLLTRLLDTKPQTRISIPEIMENRWFKIGFKRIKFYVEDDVVCNLDSLGLDGNNGNDGNDDKKVLNIDEHRDEALESVSESEWDSEVVNRRKNRQLGSLPRPASLNAFDIISFSQGFDLSGLFEEKGDEARFVSGASVSKIMTKLEEVAQLVSFKVRKKDCRVSFEGSREGVKGPLSIAAEVFELTPSLVVVEVKKKGGDKVEYDRFLNTELKSALHSLTMEESAGSSCQNTPDETLQQRAFSDSAIDKHSDSIESLNLDT

SEQ ID NO: 3214 - protein, 350 aa, Bacteroides thetaiotaomicron VPI-5482
MLAYTYIEHGKFELREKPEPKITDARDAIVRVTLGSICTSDLHIKHGSVPRAVPGITVGHEMVGVVEEVGAEVTSVRPGDRVTVNVETFCGECFFCHHGYVNNCTDPNGGWALGCRIDGGQAEYVRVPYADQGLNRIPDTVSDEQALFVGDVLATGFWATRISEITEKDTILLIGAGPTGICTLLCSMLKNPKRIIVCEKSPERIQFVREHYPDVLITTPENCKEFVLQNSDHSGADVVLEVAGTEDSFRMAWDCARPNAIVTIVALYDKPLLFPLPEMYGKNLTFKTGGVDGCDCAEILSLIEEGKIDTTPLITHRCSLNEIEEAYRIFENKLDGVIKVAIVCQTESNK

SEQ ID NO: 3215 - protein, 334 aa, Yersinia pestis biovar Medievalis str. 91001
MEYMTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 3216 - protein, 431 aa, Vibrio vulnificus
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 3217 - protein, 393 aa, Arabidopsis thaliana
MSCFKSKFAGKSYFRRTFHSSIIQFHPQLSILIWHRRYSIIRTYELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 3218 - protein, 178 aa, Glycine max
  misc_feature (115)..(115): Xaa can be any naturally occurring amino acid
  unsure (1)..(178): unsure at all Xaa locations
MASSMISSPAVTTVNRAGAGMVAPFTGLKSMAGFPTRKTNNDITSIASNGGRVLCMQVWPPIGKKKFETLSYLPDLDDALLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 3219 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQATMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLYETWERSTSLLVTGRVDLSSLVSHRLPLSAAEDAFEMALNGQSLKILFEPNGSCI

SEQ ID NO: 3220 - protein, 341 aa, Chromobacterium violaceum ATCC 12472
MKALAKLKAAPGLEMTDVPLPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAKKMGATRAVNVAREDLKAVMQELHMSEGFDVGLEMSGNPQAFRQMLETMNHGGKVALLGIPPSNTAIDWNQVIFKGLEIKGIYGREMFETWYKMVALIQSGLDISPIITHHFKVDEFEQGFAAMLSGQSGKVILDWR

SEQ ID NO: 3221 - protein, 386 aa, Thermococcus kodakarensis KOD1
MNWDRVRGLVLEGKPVVLIDNRREFEADLIYPAEIASPEIVNFMLSMKGLLCLTMDMDEALKRGFFPLPSKEGETNFLVPVDYKETFTGITAEERALTARKIAEGLGVGAFRYPGHLHLLGGIGLNRRRGHTESSLELMEILGFKRYALMVEILDEKGDSHNREYALKLAEEHGLPVLTTDDVWKEFVRRKQLMRIYASARLPTRYGDFRIIAFDNELDFKEHVAIVKEPYGEVPLVRVHSKCLTGDTFASLKCDCGSQLANALRMIAQEGGILLYMDQEGRGIGLKEKIKAYELQDKGFDTVEANKALGRGEDERTYEAAFQMLRALGVSKIRLITNNPRKAKALEEFGIEVVETVPAPGEVTEHNKPYLKVKAEKLGHKLPFKV

SEQ ID NO: 3222 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 3223 - protein, 149 aa, Glycine max
MARQTFIMIKPDGVQSGLIGEIISRFERKGFYLKGLKLVTVDRPFAEKHYADLSAKPFFSGLVDYIVSGPVVAMIWEGKNVVTTGRKIIGATNPAQSEPGTIRGDFAIDIGRNVIHGSDSVESANKEIALWFPEGPANWQSSQHSWIYE

SEQ ID NO: 3224 - protein, 389 aa, Glycine max
  misc_feature (288)..(288): Xaa can be any naturally occurring amino acid
  unsure (1)..(389): unsure at all Xaa locations
MGKREKQKQRHEKGHRGRGSFNYLQEDRDFDDTPRPSPSEEECADDSNEEKEEEEEEEGHENQSHDMPSKFLLYQQSVQSPKGDISYLQKFFLMYVGGRMPLHLQEDFCGTALLSTEWLRSDSRRTVVGLDLDLEALNWCMESNIPKVGADGFSRMSLFHGNVLQPLQSKLVKIDPQQLVSDISLSQNEENLQTDVPESDAPTGSVAQDDKYTKRNIILPGRDIVCAFNYSCCCLHKRAELVLYFKHAREALSTKGGIFVMDLYGGTSSEHKLRLQRRFPNFTYVWEXQAEFDIIQRKTRISLHFHMKKEQRKLRHAFSYSWRLWTLPEIRDCLEEAGFRSVHFWVREMPDTTEIMRTEGFGAGKNVKYEEATSFQQQDSWNAYIVGVA

SEQ ID NO: 3225 - protein, 308 aa, Frankia sp. EAN1pec
MQNTIDLTGRLAVVTGASSGLGLGLATRLAAAGAKVLLPVRDEAKGEAALSHIRAEAPGADVSLRELDLASLKSVEALGDTLNAEGRPIHILINNAGLMTPATRHTTADGLELQFGTNHIGHFALTGWLLPLLNAGHARVTTMTSSAARHAKLNWEDLQSDQAYAPIRAYNQSKLANLLFALELDRRSRAGGWGIVSNAAHPGTTLTGLYAAGPNLGREKSSPIEAAMKRLARWGVLVQGVDRGLLPALYAATSPDAEGGHFYGPDGFGQFTGGPAELEIYRPARDEDAATRLWDVSQRLAGVEFAAV

SEQ ID NO: 3226 - protein, 164 aa, Zea mays
MKPVSVAEHNNHQPRLHSPTPASATKISIPISSSEAALFGKGRYKVWALAAIALLALWSMFAASVTLRLSSVDLATTFGDASDPLIDELDPLEMEQREKLVRRMWDVYTRTDNHVRLPRFWQEAFEAAYEELAGDDTLTTDAAISEIARMSIHRPEVEQSSNKD

SEQ ID NO: 3227 - protein, 283 aa, Leptosphaeria maculans 'brassicae' group
HTFYNELRVAPEEHPVLLTEAPINPKSNRVKMTQIVFETFNAPAFYVFIQAVLSLYASGRTTGIVLDSGDGVTHVVPIYEGFALPHAISRVDMAGRDLTDYLLKILAGRGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3228 - protein, 283 aa, Leptosphaeria maculans 'brassicae' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDRQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3229 - protein, 379 aa, Zea mays
  misc_feature (186)..(186): Xaa can be any naturally occurring amino acid
  misc_feature (320)..(320): Xaa can be any naturally occurring amino acid
  misc_feature (337)..(337): Xaa can be any naturally occurring amino acid
  misc_feature (343)..(343): Xaa can be any naturally occurring amino acid
  misc_feature (347)..(347): Xaa can be any naturally occurring amino acid
  misc_feature (350)..(351): Xaa can be any naturally occurring amino acid
  misc_feature (353)..(353): Xaa can be any naturally occurring amino acid
  misc_feature (357)..(357): Xaa can be any naturally occurring amino acid
  misc_feature (365)..(365): Xaa can be any naturally occurring amino acid
  misc_feature (368)..(368): Xaa can be any naturally occurring amino acid
  misc_feature (375)..(375): Xaa can be any naturally occurring amino acid
  unsure (1)..(379): unsure at all Xaa locations
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPXGVVVDLPTLTEKDREDILQWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEXTDVAKRILDGTDCVMLXGETAAXAYSXFAXXTXAKTXCKPESCVXHPXFSNQSGXTPIP

SEQ ID NO: 3230 - protein, 283 aa, Leptosphaeria maculans 'brassicae' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEVTALAPSSMKVKIIAPPERKYSVWIGGSILASLSTFQQMWISKQEYDESGPSIV

SEQ ID NO: 3231 - protein, 283 aa, Leptosphaeria maculans 'brassicae' group
HTFYNELRVAPEEHPVLLTKAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3232 - protein, 184 aa, Triticum aestivum
KTPQSSPAVWLSPSQSRPTARSRTPWTPRPPGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPKKTAKSPKKAATPKKA

SEQ ID NO: 3233 - protein, 446 aa, Eubacterium acidaminophilum
MHKYIPNTEADKKSMLESIGVSSIEDLFSDIPAELKLGRELNLGEPMSELELVKHMNELADKNKSDFVCFRGAGAYDHYIPSLINHMLLRQEFFTAYTPYQPEISQGTLQMIFEFQTMLCDLTGMDVANASMYDVGTATVEAAVMAVQNKKKCKNVVVSKAVAPETRLILHTYLKQNDIEVIEVDTADGVTDMDKLTAAVGDETAGVIVQNPNFFGVFEDVEAIAGVAHDKKALLIDVVDPISLGIVKRPGDIGADIVVGDAQCFGSALNFGGPYIGFLTTKSKMARKMPGRIVGQTEDTDGKRGFVLTLQAREQHIRREKATSNICSNQGLCTLTVAIYLSTMGKSGLKEVALQCMNKAQYAYKKLTESGKFKPLYNKPFFKEFALTSDVAAADVNAKLAESNILGGYELECDYPEAKNGLLFCVTEKRTKEEIDCLAQVMEVNC

SEQ ID NO: 3234 - protein, 484 aa, Eubacterium acidaminophilum
MKNYNKLVFEVSKEGKKAYSLPKCDVPELDAASVIPAGYLSSEEPKLPELSEVDVIRHFTNLSQKNFGLDGGFYPLGSCTMKYNPKINEDMCRIPGLVNVHPYQPEETVQGSLEVMYNLAQSLAEISGMDEVTLQPAAGAHGEYAGLLSIKEYHKKRGDLKRTKIIVPDSAHGTNPASAYVAGLEIVEIESNSQGGVDIENLKSVLNDEVAGFMLTNPSTLGLFEVNITEITKLIHEAGGLCYYDGANLNAIMGKTRPGDMGFDVMHFNLHKTFSTPHGGGGPGAGPIGVKAHLAEFLPVPVVAKKDDKFVLDYDRPNSMGKIKNFYGNYGVCLRAYAYVKSMGASGLKEVSEAAVLNANYMMHKLKGEYKLPYDQVCKHEFVLDGLRGSELEVTTLDVAKRLLNYGYHPPTVYFPLIVHQAIMIEPTETEGRETLDEFIDALLKIAEEAKKDPQILKNAPQTTLVKRLDEVKAAKDLILKYQG

SEQ ID NO: 3235 - protein, 294 aa, Mycobacterium sp. MCS
MLWRMARIAIIGGGSMGEALLSGLLRAGRQVKDLVVAEKHPDRAKFLAEKHSVLVTSVVEAIDNAHYVIVAVKPADVEHVIDDIAEAAANADTDTAEQVFVTVAAGVSTAYYENKLPAGAPVIRAMPNAPVVVGGGVSALAPGRFATPEHLKEVSAIFDSVGGVLTVPESQLDAVTAVSGSGPAYFFLMVEALVDAAVASGLSRTVATDLVVQTMAGSAAMLLERLDEAQPVGDAAMGTAMDTTAAQLRATVTSPAGTTAAGLRELERGGLRSAVANAVEAAKTRSEQLGITSE

SEQ ID NO: 3236 - protein, 156 aa, Arabidopsis thaliana
MKPRMCLILFIALMRVMSIVSAQSSCTNVLISMAPCLSFITQNTSLPSQQCCNQLAHVVRYSSECLCQVLDGGGSQLGINVNETQALALPKACHVETPPASRCHSGSSVNSHSEHGNGSKTVPREKSSSDGSIKFSFPLLAILFTASYITLIYAKY

SEQ ID NO: 3237 - protein, 637 aa, Arabidopsis thaliana
MAISTMLGSISCCPSPKGYEMVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPILGFFFAGVVLNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGVISLFLLPFVNKIV

SEQ ID NO: 3238 - protein, 219 aa, Sulfolobus tokodaii str. 7
MDPKEVVARFIVDKLKEHKLIGLGTGKTVKKLIEVLSEEGLLKEKIFVASSIDTELEISKREGIVITLYSGLRPQVYIDSFDFVTSDKIMIKGGGAALLREKMLYTFSKEKVFIGEELKLKDLKEYSVPVEVVPVGVAYVISALKERGYEAKIREGNGKIGPIISDNGNIILDVIVKRENLCDFERLVKEIPAIIESGIFCKKDYEIYLANENGRISIL

SEQ ID NO: 3239 - protein, 487 aa, Escherichia coli CFT073
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 3240 - protein, 113 aa, Zea mays
  misc_feature (8)..(8): Xaa can be any naturally occurring amino acid
  misc_feature (19)..(19): Xaa can be any naturally occurring amino acid
  misc_feature (29)..(29): Xaa can be any naturally occurring amino acid
  misc_feature (52)..(52): Xaa can be any naturally occurring amino acid
  unsure (1)..(113): unsure at all Xaa locations
REWYQSHXCGAGFTRKPPXYERFIRPTGXRFTKAHVTHPGLKCTFNLDIISXKKNPNGPMYTSLGVMTRGTIIEVNVSELGLVTPAGKVVWGKYAQVTNNPENDGCINAVLLV

SEQ ID NO: 3241 - protein, 404 aa, Pasteurella multocida subsp. multocida str. Pm70
MAHFPKSDKLEHVCYDIRGPVHKEALRLEEEGHKILKLNIGNPAPFGFEAPDEILVDVIRNLPTAQGYCDSKGLYSARKAIVQYYQSKGIHGATVNDVYIGNGVSELITMSLQALLNDGDEVLIPMPDYPLWTAAATLAGGKPVHYLCDEEANWFPDVNDIKSKITKRTKAIVVINPNNPTGAVYSQDLLLEIIEVARQHKLIIFADEIYDKILYDDAVHHHIAALAPDILTVTFNGLSKAYRVAGFRQGWMILNGPKKAAAGYIEGLDMLASMRLCANVPMQHAIQTALGGYQSINEFILPGGRLLEQRNKAYELINQIPGVSCIKPQGAMYMFPKIDIKKFNIYDDEKMVFDLLAQEKVLLVHGRGFNWHSPDHFRIVTLPHVHQIEEALTKLARFLAHYHQ

SEQ ID NO: 3242 - protein, 324 aa, Arabidopsis thaliana
MMTSMEGMVEKGVLDDIIRRLLEGKGGKQVQLSESEIRQLCFNARQIFLSQPNLLDLHAPIRICGDIHGQYQDLLRLFEYGGYPPSANYLFLGDYVDRGKQSLETICLLLAYKIRYPSKIYLLRGNHEDAKINRIYGFYDECKRRFNVRLWKVFTDCFNCLPVAALIDEKILCMHGGLSPDLDNLNQIREIQRPIEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPAPASSSHPLKKDFHNRTLGYNLSA

SEQ ID NO: 3243 - protein, 162 aa, Brassica napus
MIAPFSFSIPDSIPSSPRFLPLGQHQLQLRFLARPKKNLDHMELMKRLGIGCFAAKHSTREMKTEKDSGGEDLFVESSEKPDHLVVMVNGIIGSSADWKYAAEQFVKKFPDKVLVHRSESNSATLTFDGVDMMGERLANEVLSVIKNRNGLKKISSVAHSLG

SEQ ID NO: 3244 - protein, 160 aa, Schizosaccharomyces pombe
MNSSIKRLHKEYASFQAGDISGLLLLKPVTDVDMFHWKAVIEGPTETPYEGGQWVLDIHVHEGYPISPPSVYFQTKIVHPNISWTNGEVCMDILKTHWSPAWSLQSACLAIISLLSNYDASSPLNVDAAKLLRTGDKTAYNSLVRCTTYLYAKGKIEDLS

SEQ ID NO: 3245 - protein, 363 aa, Neisseria gonorrhoeae FA 1090
MSHISPIPEILADIKAGKMVIITDAEDRENEGDLLMAAQFVTPEAVNFMIKHARGLVCLPMEGAMVEKLGLPMMTQKNGAQYGTNFTVSIEAAHGITTGISAADRALTIQTAVSPTAKPADIVQPGHIFPLRAQKGGVLVRAGHTEAGVDLAQMNGLIPAAVICEIINDDGTMARMPELMKFAEEHKLKIGTIADLIEYRSRTESLLEDMGDAPVQTPWGEFQQHVYVDKLSGETHLALVKGTPSADTETLVRVHEPFSVMDFIQANPRHSWSLPKALERVQQAESGVVILLHHTEDGASLLDRTLPKGANQAYKWDSKSYGIGAQILAGLHVKKLRVLGQPSSFTGLTGFGLEVVGFEEAEK

SEQ ID NO: 3246 - protein, 616 aa, Oryza sativa
MASSKETYRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKNLERMEVEERQAQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 3247 - protein, 256 aa, Photobacterium sp. SKA34
MRHPVVMGNWKLNGSKEMVSGLIKGLDAALNGVEGVDVAIAPPVMYLDLAEQLLNKADSKIILGSQNVDLHNNGAFTGDISPAMLKEFGASHIIIGHSERREYHHESDEFVAQKFAFLKENGLTPVLCIGESEAQNEAGETVAVCARQLDAVINTQGVDALNGAIIAYEPIWAIGTGKAATADDAQRIHAAIRAHIAEKSEEVAKNVVIQYGGSVKPENAASYFAQPDIDGALVGGAALDAESFAAIAKAAAEAKN

SEQ ID NO: 3248 - protein, 413 aa, Xanthomonas campestris pv. campestris str. ATCC 33913
MSPKKTSFPKQDIRVLLLEGISQTAVDVFRAAGYSQIELHAKSLPEDELKARIAEAHIVGIRSRTHLSADVLAHAKRLIAVGCFCIGTNQVDLEAAELAGIPVFNAPYSNTRSVAELVIAEAILLLRGIPQKNAQCHRGGWSKSAAGSHETRGKVLGIVGYGHIGTQVGVLAESLGMQVIFHDIETKLSLGNARAAIDLDDLLARSDVVTLHVPETPSTKDMIGAAEIARMKPGAHLINASRGTVIDIDALDAALTSGQIGGAAVDVFPIEPKGNGDAFESPLIAHDNVILTPHVGGSTLEAQDNIGVEVAAKLVRYSDNGSTLSAVNFPEVTLPEHPDSLRLLHIHRNVPGVLSQINELFSRHNLNIDGQFLRTDPKVGYVVIDVSASEELAGVLKDELGQITGTLRTRVLY

SEQ ID NO: 3249 - protein, 475 aa, Mycoplasma pulmonis
MYSIKKKSKLIATIGPSSDNYEVLKELVENGVTCVRANFSHGDYQEQKRKFDLAKKVSHDLNTPLSLMLDTKGPEIRIGKMKDGVQKIEANQSLKIWVSEEKYKNLLGTSEDISVSYNMSQDLKKGNQVLLDDGKLDTIVEKVTPEYVQVRALNSHNLKTNKRINLPGVAFSLPFLSEKDKKDIAFGVENDINYVAASFVNSKENVLELRAILKSLNAEHVQIISKIESTLGIENIDEIIEHSDGIMIARGDLGLEIPYYEVPYWQKTIIRKCRNVGKVVIVATQMLDSMEHNTNPTRAEVTDVYFATELGADTTMLSGETAQGSFPVEAVKVMSKINQRAEKEFYSKLYYNAQLESNAKLATTKRAKIAYEVAKQTQSGDFKYTVVLSASGNLLKKVANFRPNTSIIGFVEDKKLINAFGIVSSVFVSLESVQKYFELKNNPLAAISTLKNYDARPGDRFLIVHNEKITQHVVE

SEQ ID NO: 3250 - protein, 116 aa, Arabidopsis thaliana
  misc_feature (2)..(2): Xaa can be any naturally occurring amino acid
  misc_feature (15)..(15): Xaa can be any naturally occurring amino acid
  misc_feature (39)..(39): Xaa can be any naturally occurring amino acid
  misc_feature (92)..(92): Xaa can be any naturally occurring amino acid
  misc_feature (97)..(97): Xaa can be any naturally occurring amino acid
  misc_feature (106)..(106): Xaa can be any naturally occurring amino acid
  misc_feature (108)..(108): Xaa can be any naturally occurring amino acid
  misc_feature (114)..(114): Xaa can be any naturally occurring amino acid
  unsure (1)..(116): unsure at all Xaa locations
MXSSMLSSAAVVTSXAQATMVAPFTGLKSSASFPVTRKXNNDITSITSNGGRVSCMKVWPPIGKKKFETLSYLPDLTDVELAKEVDYLLRNXWIPCXEFELEHGFXYXREHGNXSG

SEQ ID NO: 3251 - protein, 201 aa, Malus x domestica
YDYFQFTLQYQPAVCNSSRTPCKDPPDKLFTVHGLWPSNRNAPDPEYCKETTLNVTKIGHLKAQLDIIWPDVYDRTNNVGFWGRQWEKHGICGSPTIQDDVNYLETVINMYTIKKQNVFEILSKGKIEPEGKNRTRKEILKAIRSGTKGKRPKLKCQKHTGMTELVEVTLCSNRNLTKLINCPDLFKPSSQYFCPLIGIQY

SEQ ID NO: 3252 - protein, 165 aa, Oryza sativa
MKAPADHHHHHHHSSTPPPATKISIPISAAAGGAEAALLGKGRYKAWALAAIALLALWSMFAASVTIRWSSGDLAAEFGDLPDPLIDDLDPLEMEDREKLVRRMWDVYTRTGVDRVRLPRFWQEAFEAAYEELAGDDTQASETAVSEIARMSVHRPELEQSSNKY

SEQ ID NO: 3253 - protein, 283 aa, Phoma betae
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVHDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3254 - protein, 385 aa, Sinorhizobium meliloti
MAQMSKRSAVEPFHAMDVLAEATRRRDSGHPVISMAVGQPAHPAPKAALDAARRALDHGRLGYTDALGTHSLKRAIAAHYHSRHGITLDPQRIAVTTGSSAGFNLAFLALFDPGDRVAIARPGYPAYRNIMAALGLEVVEIEANAEAGFTLTPDSLEGAAARAGKPLKGVLLASPANPTGTVTGKAQLKALADYCRDHSIAFISDEIYHGLTFAGEETTALEVADDAVVINSFSKYYCMTGWRIGWMVLPEARVRAFERIAQSLYISPPELSQIAAEAALGAHEELDGYKRAYAANRALLLERLPQIGFSIASPMDGAFYAYADVSRFTNDSMAFARRMLAEIDVAATPGFDFDPLEGHRTMRFSYAGAATEMEEAMNRIARWLA

SEQ ID NO: 3255 - protein, 660 aa, Arabidopsis thaliana
MQRSCRTRRRVSVNKFNGRNSFYKVSLSLVFLLWVLLFFSTLLISHGDGAKDEPLDDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQVSKRLEWMEKKCLTVFTVCLGFGIIAVIAVVIGMGTGLAEKTGSGAWLLLLISSTFIMFVLSL

SEQ ID NO: 3256 - protein, 544 aa, Streptococcus pyogenes MGAS10394
MINRRRIMKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDFYIWRDEPNDLTSIFSGSAWEYDNASGQYYLHLFSKRQPDLNWENEALRHKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAEELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDEEQVFAKDLAGAQVIIANTDVDTVLETKHLQPWDAFCLKLKA

SEQ ID NO: 3257 - protein, 399 aa, Candida albicans SC5314
MLSILSIAALLIATVQAADFSSSCPIDSPISCSSNGDTSNSCCYENPGGIILFTQFWDYNPASGPADSFTIHSIWNDYCSGGYPQFCDTSLEIDSTGSTIESIVVDQFGDQTLYDNMNKYWTDINGNNKKFWAHEFNKHGTCLNTLNPSCYSNYKQNENVYDYYSLVYQLFQKLPTYQWLVSAGIKPSTTATYTLSQIQSALKSKFGAEVYIACDSNNAINEVWYFYNIKGSILQQNYLPIDTVSKTNCPSSGIKFPPKGNSGANTLTTKTTGTTTSGSGSTSVPATSYINLTGKSGCLISNGKYYTSGTCATYHFNTGSSGNTQITSSKGNCGIDSSNQFTCSSSTSATDFQVSGGSIGYNGNFDWCLGAVTGSGSTAQTSVKLSDGSCSSFKLTLSS

SEQ ID NO: 3258 - protein, 489 aa, Streptomyces coelicolor A3(2)
MSKDAVDTAQVAAHPQATGTIPADAGDAGYSKDLKARHVNMIAIGGAIGTGLFLGAGGRLRDAGPALAIAYLVAGVFAFFVVKALGELVLYRPSSGSFVSYAREFLGEKGAYVAGWMYFLNWSTTGIADITAIALYTHYWSMFTSIPQWVLALVALAVVLAVNLISVKIFGEMEFWFAIVKVATLVGFMLIGIFLLATQHEVSGQTPGMGMITDHGGILPHGVMPVVLVMQGVIFSYAALELVGVAAGETAEPHKIVPRAVNSIMWRVALFYVGSVVLLALLLPSSLYSGDESPFVTVLSGIGVPAAGDVMNLVVLTAAMSSLNSGLYSTGRILRSMAMAGSAPRFTGVMSRSQVPYGGILLTCAVCVLGVGLNYLVPSKAFEIVLNVASLGIISTWVIIMICHLVFVRRARAGLVERPGFRLPGSPVTEIVTIAFLLAVVGLMWNDEEVGRKTVLLVPVIAVMLVAGWFGVRRRVAHQAGQERPAPRE

SEQ ID NO: 3259 - protein, 179 aa, Triticum aestivum
  misc_feature (143)..(143): Xaa can be any naturally occurring amino acid
  unsure (1)..(179): unsure at all Xaa locations
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALXLREKMVQSCTKESLLLAVGGNEHYLTGPREGSGPWP

SEQ ID NO: 3260 - protein, 510 aa, Cryptococcus neoformans var. neoformans B-3501A
MSIPIPDRNRRQSVSASDPPNNIPIPANTRGIPVSSFAPHSPPTGTSPRNSSFSFSTSPSTSYLRNASGAFHGIARQLTAFLPPDYPTQENHEKRQGKTKILLLENINLDAADYLKSQGYEVDHVTKAYTEEELIAKLPNYHAIGIRSKTKITAKVIDANPQLLAIGCFCIGTNQVDLEHAAKRGIAVFNSPFSNSRSVAELVISEIIALSRQIIDRTHEMRAGIWNKLSKNCWEIRGKTLGIVGYGHIGSQLSVLAEAFGMSVIYFDVVPIMPLGSARQVDTLEDLLSRADFITLHVPEIPDTIGMMGAEQFSQMKKGAFFINNARGKVVDLSALCDALESDHLAGAAIDVFPKEPGSNGPGFNETLGDFIPRLRKIPNLILTPHIGGSTEEAQRAIGTEVSNALTRYLNYGTTLGAVNFPEVDLRAITAADERHIRVCHVHKNEPGVLRGINNILADHNIEKQFSDSKGDIAYLMADISGVGQEEVEGLYSAIKNTRSNILTRLLFVE

SEQ ID NO: 3261 - protein, 500 aa, Mesorhizobium sp. BNC1
MQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 3262 - protein, 338 aa, Neisseria gonorrhoeae FA 1090
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKIQLYSHCRNGGWILGYMIDGTQAEYVRTPYADNSLVPPHDNVNEEIALLLSDALPTAHEIGVQYGDVKPGDTVFIAGAGPVGMSALLTAQLYSPAAIIVCDMDENRLKPAKELGATHTISPASGDVSKQVFAIVGEDGVDCAIEAVGIPATWNMCQDIVKPGGHIAVVGVHGQSVDFKLEKLWIKNLAITTGLVNANTTEILMKAIFSSSVDYTKMLTHRFKFSQLEKPTTCSNTPPKTKR

SEQ ID NO: 3263 - protein, 501 aa, Candida glabrata CBS 138
MDSRLARLTTLQTSAGEELRRTSIIGTIGPKTNNPETLVALRKAGLNIVRMNFSHGSYEYHKSVIDNARKSEELYPGRPLAIALDTKGPEIRTGTTTNEVDYPIPPNHEMIFTTDDKYAKACDDKIMYLDYKNITKVISAGRIIYVDDGVLSFEVLQVVDDKTLKVKSLNAGKICSHKGVNLPGTDVDLPALSEKDKADLRFGVENGVHMIFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAVLDGADCVMLSGETAKGNYPINAVTTMAETALIAEQAIAYLPNYDDIRNCTPKPTSTTETVAASAVAAVFEQKAKAIIVLSTSGTTARLVSKYRPNCPIILVTRNARTARFSHLYRGVFPFVYEKESVSDWTEDVEARLNFGIEQAIEFGILKKGDTYVSIQGFKAGVGHSNTLQVSTA

SEQ ID NO: 3264 - protein, 332 aa, Buchnera aphidicola str. Sg (Schizaphis graminum)
MTIKIGINGFGRIGRVLFRLAQERENIEVVAINDLLDPKYIAYMLKYDSTHGNFKKDIEVKNNNLIINGKKIRITSIKDPEKLMWDKLLIDVVIESTGLFLTKDTAYKHILSGAKKVVITGPSKDDIPMFVRGANFDKYKGEKIVSNASCTTNCLAPLSKVIDDHFGIIEGLMTTVHASTATQKIVDSASKKDWRGGRGALQNIIPSSTGAAVAVGKVLPNLNGKLTGIAFRVPTANVSVVDLTVRYKKTATYNEICEVVKNASEQKMKGILGYTEDEVVSTDFNGKELTSIFDAKAGLSLNKNFAKLISWYDNETGYSSKVLDLVELVALK

SEQ ID NO: 3265 - protein, 262 aa, Yarrowia lipolytica CLIB122
MPQNEYIEAHIKKHGRRLDHDERKRKREAREGHRISKDAQNLTGFRAKMFAKKRYAEKVAMKKKIREHEQSKVNGTPKEHNPEDGDALPTYLLDRQQPNSAKALSSSIKQKRLEKADKFSVPLPKVRGISEEEMFKVLKSGKRRNKSWKRMITKHTFVGEGFTRRPVKLERIIRPSALRQKKANVTHPELGVTVHLPILGVKKNPQSPMYTQLGVLTRGTIIEVNVSELGLVTAGGKVVWGKYAQITNEPDRDGCVNAVLLV

SEQ ID NO: 3266 - protein, 414 aa, Zea mays
  misc_feature (193)..(193): Xaa can be any naturally occurring amino acid
  unsure (1)..(414): unsure at all Xaa locations
MRRVGTGVRMLCGAALSVLLLLAGGAAASHSRSSCPATPPDAGNTLQVSHAFGPCSPLGPGTAAPSWAGFLADQASRDASRLLYLDSLAVRGRARAYAPIASGRQLLQTLTYVVRASLGTPPQQLLLAVDTSNDASWIPCAGCAGCPTSSAAPFDPAASASYRTVPCGSPLCAQAPNAACPPGGKACGFSLTXYADSSLQAALSQDSLAVAGNAVKAYTFGCLQRATGTAAPPQGLLGLGRGPLSFLSQTKDMYEATFSYCLPSFKSLNFSGTLRLGRNGQPQRIKTTPLLANPHRSSLYYVNMTGVRVGRKVVPIPAFDPATGAGTVLDSGTMFTRLVAPAYVAVRDEVTLPEENVVIHSTYGTISCLAMAAAPDGVNTVLNVIASMQQQNHRVLFDVPNGRVGFARERCTAA

SEQ ID NO: 3267 - protein, 293 aa, Polaromonas sp. JS666
MFFTKPVILEWRPEIAYRLPLLPLPAAPFLTPVFTSSLSFPPDCHTMYKLVLIRHGESTWNLENRFTGWTDVDLTETGIQQAKDAGKLLKAEGYDFDLAYTSVLKRATRTLWHVLDEMDRTWLPVVNSWRLNERHYGALQGLNKAETAKKYGEDQVLIWRRSYDTPPPPLAANDERCERGDPRYAKLPPEQVPLTECLKDTVARVLPFWNESMAPAIKAGKRVVVAAHGNSIRALVKYLDNISDSDIVGLNIPNGIPLVYELDAQLRPLRHYYLGDSEAAARAVAAVSAQGKA

SEQ ID NO: 3268 - protein, 176 aa, Zea mays
  misc_feature (60)..(60): Xaa can be any naturally occurring amino acid
  unsure (1)..(176): unsure at all Xaa locations
TSKLEININNPKRSKRTYASTSPEVAKKISRSLRSLNAQTGLFTKHMKIIHQDPELRAQXVAAIKRTKGTDVARKRASEIQKAFFSDPENRLKRSIAMKGVKFYCSKCGQEGHRSFYCPTLREGSTRVRFRCRLCGREGHNSRTCGKPKSEKEHKQRPHHCSRCGEKGHNRRNCPT

SEQ ID NO: 3269 - protein, 430 aa, Acidobacteria bacterium Ellin345
MVAALGGLLFGFDTAVISGATHALTEAYSLSPSLLGVTVSSALWGTVAGSLLAGIPADRIGRRDSLRFMAVLYLVSSLGCAFAWNWPALLVFRVIGGLGIGGSSVIGPMYIAEIAPAKWRGRLVGFFQFNVVFGILLAYFSNYLVGLGCFGANEWRWKLGIPAVPAALFLIMLFGIPRSPRWLVKKQRVPEARESLQLIGEEDYEKELHDIIESIDADHAQGDSLFDRKYLFPIFLAVSIGMFNQLAGINAILYYLNDIFAQAGFNKVSSDLQAVAIGGTNLLFTMLAMSIIDYVGRKTLLLIGAVGTALCLGGVAWIFHVHQHQGYLLWLLVVYIAFFAFSQGAVIWVYISEVFPNRVRAGGQSLGSSAHWIMNAIIAGVFPALAAKSGSIPFAFFAAMTAIQFFVVLFVYPETKGITLEAMQKKLGIS

SEQ ID NO: 3270 - protein, 328 aa, Schizosaccharomyces pombe
MAFVARQTFEYQMPSTWYPGHMNKTLKRLKNLTSSNDIFVEVRDARIPLTSRNYVMEDFLNKKNRIIVYNKCDLADTFHTKAKVSKHRIQNLAQQFQNVECWFKETSTPEKSAFITPYVSKAPYFAKELLRLIRTLVDQASANGRVYVYFVGMPNTGKSSILNSLRNVALRKSKSAIVGNYPGVTKRISEIVRLFNDMDVYMLDTPGIMTPSITKPEDMLKLSLVGCVKEGIVHPVTVVDYLLFHLNRIDPSLYSKWSLPTNDVDEFLQNTAYKARKLTKGGFDENFVSNYVIQQYRIGRLGRFQLDTIDKNELLIRLHNEQNKKNAK

SEQ ID NO: 3271 - protein, 283 aa, Phoma eupyrena
HTFYNELRVAPEEHPVLLTEAPINPKSNREKTTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHATTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3272 - protein, 388 aa, Arabidopsis thaliana
MSITNTKTSICFSSSSSLPESVRLAQVTMQGGSSGIGYGLKYQSRCISDVKADTDYTSFLTGTLSLKEENEVNPYAFKVHLLRLSSGGSELICEGLFSHPNEIWDLASCPFDQRIFSTVFSTGESFGAAIWQIPELYGQLNSPQLERVASLDAHVGKINCVLWWPSGRCDKLISIDEQNIFLWSLDCSKKSAEVLSKDSAGMLHSLSGGAWDPHDVNAVAATGESSVQFWDLRTMKKVNSIEHAHVRGVDYNPKREHILVTAEDESGIHVWDLRKAKVPVQELPGHTHWTWAVRCNPEYDGLILSAGTDSVVNLWYASATSSDDKTSESPVESTRQRVNPLLNSYTDYEDSVYGLAWSSREPWVFASLSYDGRVSKLSLPHILSTRST

SEQ ID NO: 3273 - protein, 267 aa, Methanococcus maripaludis S2
MRQSKKLGQCFLKDKNFVKKAINRAEITNNDIVLEVGLGEGALTKELAKIAKKVYVIELDERLKPFADEITAEFENVEIIWSDALKVDLKNLGFNKIVANLPYQISSPITFKFLEEDFETAVLMYQYEFAKRMAGKPDTKEYSRLSVAVQYNADVEFICKVPPSAFSPKPDVNSAIVKLTKREPKYHVKDEEFFKKVLKAVFQHRNRTIKRALIDSSHEIEVDRDNLKGILEKIENEFDFTQRVFKTPPEKIGDLSNLLYDEIANLE

SEQ ID NO: 3274 - protein, 490 aa, Zea mays
  misc_feature (179)..(179): Xaa can be any naturally occurring amino acid
  misc_feature (268)..(268): Xaa can be any naturally occurring amino acid
  misc_feature (297)..(297): Xaa can be any naturally occurring amino acid
  misc_feature (341)..(341): Xaa can be any naturally occurring amino acid
  misc_feature (351)..(351): Xaa can be any naturally occurring amino acid
  misc_feature (364)..(364): Xaa can be any naturally occurring amino acid
  unsure (1)..(490): unsure at all Xaa locations
LAALRRSTPTPTPPPPLPPPIPRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPGAGTVRCRCENTAMLGERKNCNLPGIVVDLPTLTEKDKEDIXGWGVPNDIDMIALSFVRKGSDLVTVRQVLGQHAKRIKLMSKVENQEGVVNFDEILRETDAFMVARGDLGMEIPVEKIFLAQKMMIYKCXIAGKPVVTATQMLESMIKSPRPTRAEATXVANAVLDGTDCFMLSGESSAGAYPEVAVKIMARICIEAESSLDXEAVFKAMIRXAPLPMSPWESLHXTAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 3275 - protein, 601 aa, Actinobacillus pleuropneumoniae serovar 1 str. 4074
MAAEGASQLTSVVALLGAAIIAVPIFKRIGLGSVLGYLAGGLAIGPFGFGLFTDSHTILHIAELGVVMFLFLVGLEMQPAHLWGLRKYIFGLGSFQVVGASIALTGLVMAFGYSWQVAFVSAAGFVLTSTAIVMQVLSERGEMTSERGRKMVSILLFEDMLIVPLLAVVAFLSPIHSTEASTPIWQKIAIAVLAMVFLFIIGTKMLNPFFKILARTKIREMMTAVALFVVLGSALLMEVSGLSAAMGAFAAGVLLSTSSFRHQLEVDIDPFKGLLLGLFFLAVGMSLDLNVVWDNLGLILSGVALMMLIKGGVIFLVARLSGSNKLDAHDRAIVMAQGGEFAFVLFAAAHAQKVIDDTVHANMTAIVVLSMVFTPLMIIASQKFIVPRLQKIDEIKPHDHIEEQNPIILVGLGRFGQVVNHLLQMTGYHPTIIELNPKLIAAMKKRGVKSYYGNGAHPDLLKAAGIQTAQMLIVVIDNPKQTLEIVKYARSVNPHIKIIARAYDRYHVYDLVQSGADIEVRETFDSALRTGKQALRELGLDADKVHEIGNMYFGKDRHSIKLMSEVYDPKIERFKNEEMYRTALEQDQEIMAEIQKILARE

SEQ ID NO: 3276 - protein, 283 aa, Phoma herbarum
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREVVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKETTALAPSSMKVKIIAPPERKYSVWIGGSILASLSTFQQMWISKQEYDESGPSIV

SEQ ID NO: 3277 - protein, 429 aa, Streptomyces avermitilis MA-4680
MTTAPILYSTDNIEDFALDPVERAIADIAAGRPVVVVDDEDRENEGDLVIAAEKATPEIVAFMMSECRGLICAPMEGGELDRLQLPQMVDHNTESMRTAFTVSVDASGAHGVTTGISAADRATTLRLLAQGEAGAADFVRPGHIFPLRAKPGGVLVRNGHTEAAVDLARLAGLRPAGAIVEIAGEDGHMLRLPELIPFARKHGLTIISIEDLIAYRQSSEPTVRREAEVHLPTAFGEFTAYGYRSTVDGVEHVALVHGEIGDGEGVLVRVHSECLTGDVFHSLRCDCGPQLEASLERIRSEGRGVVVYLRGHEGRGIGLVSKLRAYELQERGRDTLDANLELGLPADARDYAAGAQILEDLGVRSLRLMTNNPDKTDALLRHGLKVTGREPMPVQAGEHNLRYLTTKRDRMGHDLPWLDTVPVSTCGNQ

SEQ ID NO: 3278 - protein, 316 aa, Mycoplasma mycoides subsp. mycoides SC
MSAEFNWFPGHMNKTLKDIEARIEIVDVVVEVIDSRAPYSSKNATFKKLLKDKPIVYIFSKADIADSKVTQQWVDYYIKNENSKVIVLYNRHTDIVNELINVINELTIKKREKDKAKGIKNTLINALVIGIPNVGKSTFINRVIKGKNVKVGNKPGVTRGIQLIHLNPFINLLDTPGVLPSKLESETVAVNICAINSIKDNVFPKERVAAKLMSYIYNNYDDIIEKYYKINLRLQKPISVIDSYKIFETIGIEKKWYVTEDILDMERILSSFLKDLDKGKLGKISFEKVLEVVPEEIQKAINPEDNKQDNDISSLW

SEQ ID NO: 3279 - protein, 145 aa, Triticum aestivum
PRSSAPRPPPGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARF

SEQ ID NO: 3280 - protein, 283 aa, Phoma herbarum
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREVVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3281 - protein, 220 aa, Vibrio sp. S14
QLNMALMLFLAPSSDELDHVLGEQPYYDIDDVRLTFSPKDFIQVNRDVNVKMVEQAINWLDIQPQDRVLDLFCGLGNFSLPLARRAKAVVGVEGVDEMVARATANAAANGLDNATFYQANLDEDVTKLVWAQEQFDKILLDPARAGAAGVMQHIVNLAPSKVVYVSCNPATLARDSQMLLQQGYKLARLGMMDMFPHTGHLESMTLFVKTNHHKKNSNVM

SEQ ID NO: 3282 - protein, 303 aa, Synechococcus sp. WH 5701
MLGLGTWNAQPGEVGAAVHAALRLGYRHIDCAAIYGNEAEIGTVLSAAIDEGVVTREQLWITSKLWNNAHAPEAVEPALKKTLADLRLDYLDLYLIHWPVAFRPGVLMPESAEDLIALEELPIAATWEALEATVEQGLCRHIGVSNFGAATLGALLDQARIRPAVNQIELHPYLQQSNMLSFCEARGVHLTGYAPLGSAGRPAFIRPSGEPVLLEDPTIHAIAGHRGITPAQVLLRWALQRRTAVIPKSVSPARLCENLAAAEGDLAAEDMEAIAALDRGRRYIDGSIWVKPGGPYTLESLWA

SEQ ID NO: 3283 - protein, 371 aa, Alkalilimnicola ehrlichei MLHE-1
MAFNSIDEIIEDLREGRMAVILDDEDRENEGDLVMAASMVRPDDINFMARYGRGLICLTLTRERCEQLRLPLMVQDTEQAQSTNFTVSIEAATGVTTGISAADRARTVQAAVAPHAKPEDLVQPGHIFPLMAQPGGVLTRAGHTEAGCDLARLAGFEPSAVIVEILKEDGTMARRDDLMAFAREHNLKIGTVADLIAYRVRNERSVERVGECDLPTEHGIFHLYAYQDNVDNALHFALVKGRPQPDTPTLVRVHVQNTLSDVFASDGPHCGWPLRAAMRQVAEAGEGVVVVLRRRDDSDDILKRMRAYQVQASQADESEEARSSSDLRTYGLGAQILTDVGVRRMRVLSAPKRMHAISGFGMEVVEYVEPE

SEQ ID NO: 3284 - protein, 325 aa, Leuconostoc mesenteroides subsp. mesenteroides ATCC 8293
MKTTDQLLKYFLKHEGEYLSGETLANRLGVSRAAIWKAVQKLNEDGHQIDSQHRKGYRYKETGVLSVPAIKALIATNWDIQVFDQLDSSNSYAKEALAAGKIVHPTVIIADQQNAAYGRFRRSFVAPEKTGLYLSIALPVMNDRVLEPGLLTTATAVIVRHVIASSLGYQLSFKWVNDLIFNDKKVGGILTEGVLDIESQSLTSLVVGIGLNLIQPINLPDQLDKKVGGIVSDLVFSRNMMIAKLVDEFADMINQYQTGKYLPEYRAHNIVLGHEVVVQYAGQKIHGKAVEISNQGALILVTFAGEKITISSGEITKLNVNGKEY

SEQ ID NO: 3285 - protein, 323 aa, Magnaporthe grisea 70-15
MPATLANKTFKLNNGVEIPAVGFGTFAAEGQPGQTYAATKAALEAGYRHLDCAWFYQNEDEIGNAIADFLKENPSVKREDLFICTKVWNHMHAPEDVKWSLDNSLKALRLDYVDLFLVHWPIAAERTEDRQVKLGPDGKYVINHELTENPEPTWRAMEELYEAKKARAIGVSNWTIDGLKKLFAVAKVKPAVNQIEIHPYLPNEELVRFCLDNDVLPSAYSPLGSQDQVPTTGERVRDDPGLNAVANRSNMTLAQALLGWGVKRGYVVLPKSSTPSRIKSNIEVPDLSEADYQDLWKVANGRKPTRFVDMKDTFGYDLWKESQ

SEQ ID NO: 3286 - protein, 324 aa, Pseudomonas fluorescens PfO-1
MSLIYVTSPIHPEVLQALSSVGEVRLGYGPNAAPYSEIQNEVDAVFLRGGHISAEMIAASPKLRIVARHGAGYDNVDYKAAAELGVWVTNTPGANRRSVVEHVFALLLGISRKVQLATDQTRNNIWAQDRLSLTGIELEGRTLGLIGFGDIGRHVAPVAEAFGMKVLATDPAYDTSFDKRLVDLDTLLTQADVVSLHVPLQEGTENLISRAEIEKMKTGAILINTSRGGVIDEAAVADALRSGKLGGAGIDVLAAENTDMITPFSYNTFPVADLPNLLVTPHVAGQTNESLLRVGMSAVKAISAVLRGAPPLHPVNNPVPKTFN

SEQ ID NO: 3287 - protein, 429 aa, Geobacillus kaustophilus HTA426
MRSYERSKTAYEEAVKLMPGGVNSPVRAFKSVGMTPIFMARGQGAKIYDIDGNEYIDYVLSWGPLILGHANPQVVEALKRVAEQGTSFGAPTLLENELAKLVIERVPSVEIVRMVNSGTEATMSALRLARGYTKRNKIMKFEGSYHGHGDSLLIKAGSGVATLGLPDSPGVPESVAQHTITVPYNDLDSVRYAFERFGEDIAAVIVEPVAGNMGVVPPVPGFLEGLREVTKQYGALLIFDEVMTGFRVDYHCAQGYYGIEPDLTCLGKVIGGGLPVGAYGGKAEIMELVAPSGPVYQAGTLSGNPLAMTAGYETLRQLTPETYEELGRKAARLADGLHQAAEKYDIPHTINRAGSMIGFFFTNEPVVNYETAKTSDLELFAAYYREMANEGIFLPPSQFEGLFLSTAHSDDDIEYTIAAAERVFARLRG

SEQ ID NO: 3288 - protein, 290 aa, Oryza sativa
  misc_feature (135)..(135): Xaa can be any naturally occurring amino acid
  unsure (1)..(290): unsure at all Xaa locations
HEVVEKGSTNALHGQVTIGTLILQDCAVGLLFALLPVLGGASGIFGGVMSMAKLLLVLSVFITVAYMMTWSFVPRFLKLMIQLSSQTNELYQLASVAFCLLLAWCSDYLGLSLELGSFLAGVMISTTDFAHHTLXEQVEPIRNLFAALFLASIGMLIHVKFLWNHVDILLAAVILVIIVKSVVVTVVVKAFGYSIRTAFVVGLSLAQIGEFAFVLLSRASHLHLVGGKMYLLLLGTTALSLVTTPLIFKLIPVVMHLGILMRWFPSESSMQNELALQDKATMLEAYNRSL

SEQ ID NO: 3289 - protein, 476 aa, Gluconobacter oxydans 621H
MTSSSHYRRTRIVATLGPASSSPEMILSLAQAGVNVFRLNFSHGAHEDHGERHAAIRAAEEKIGHPLAILADLQGPKLRVGVFENGPIILEEGKPFRLDLDRTPGTVSRVCLPHPEIISAAKPGSHLLLDDGKLKLRVVKTGEGFLETVVVVGGKLSERKGVNVPDVTLPIPALTEKDRRDFDFALSLGVDFVALSFVQRPEDVQEAREIAAGRAAIVTKLEKPQAMDDLAAIVHLSDAIMVARGDLGVELPPEEVPVAQKRAIAEARKQCRPVIVATQMLESMIESPTPTRAEVSDVSNAVYDGADAVMLSAESAAGKYPVEAVSMMVRIAERVEQDTEWRLRMDRLRPAPDETVQSAIVQAAWQVSRTLHAGAIACRTRSGAGAMRLSRERPHCPIIALTPELWVARRLCVVWGVFPHLINSEQSTQGIEPLAGPVAELARNMGFCKTGDRVLILAGLPSGHSGSTNTLRVITA

SEQ ID NO: 3290 - protein, 470 aa, Schizosaccharomyces pombe
MVSLKKKSKRRTTRLRSRIEKKAAESKRKQKRADKKNPQWKSRIPKDPGIPNSFPYKDKILAEIEEQKRIREEEKLARRASGQVDAAMEEEDAVDENGSLMISKIAEAAQASNPDDEEEFVMEEDNLGEAPLLVDSESYEASVKADTSRKAYDKEFKKVVEASDVILYVLDARDPEGTRSKDVERQVLASSAEEKRLIFVINKIDLVPSEVLNKWVTYLRNFFPTIPMRSASGSGNSNLKHQSASASSTISNLLKSLKSYSAKKKLKSSLTVGVIGYPNVGKSSVINALVNRSANGRSAPCPAGNVAGMTTSLREVKLDNKLRLVDSPGIVFPSSDSKDDLYRLVMLNAVSSTKVDDPVAVASYILQFLSRVPGQLERMFQRYELPPLLNTSDIDTATDFLVNIARKRGRLGRGGIPNLNAAANIVINDWHAGRIEWWAEPEVINEKNSSEVQDTQIVTEWAKEFDLNDF

SEQ ID NO: 3291 - protein, 845 aa, Candida glabrata CBS 138
MSAFPVSSPTRRVDQGMRNIDIMRSPGTPRLNSTGSTLCSSGEFLKLTPVKILEFDSPIAKGLSRSTSELQASKLSTVDGIYKENFTVITKQLEKLLEDLNVIYRDIGYSNTEILTKEKQIFNTISDSIKEFFNQAESEMSKLTINIEIEQDILNKILEIIGDPSGIKTIPDLYIRNAILQQTRKTVPQSPKKPLSLLNKKNILESAREYIYNVYLPELTKFLEKCLDLQHLTNAIGMDLKDISEEEKNILNNLNESDNLEQIYEYLTNGSPKNKISLISEVIKKNKAELLNNPCLRDLSTSKYELISNLLENLKVEYLSRIDKVCTEGQRLEILLKDLRLDARKVIPKKMRQILDHYRNIDSFSIASIETYFEVSKSSLAELHLTYDKYNKIHEEKSNTKHLWMLKCKQLWNLLNTSNDQIKIFVESNSDLSDSTMENIHNELERLEEMKKNLIKELIDNTYKKVEKYWDILQYSEEEKKIFSSRIEEMRHTSNSLQDDEDTLEICETEVKKLEEQYSLYKPVLDLYEEFNSLLSDQAFLEASSKDSSRLLARNSHKILLKEEKTRKRITRHFPRVILELKDRLIEMESKFNKPFLVDGVKVLDIVSVQEKELQSKYPRSRIDTGNRQSLGRVSSAGNGLRVAKPVITNSGRKVISGQRTTHSNRGVINQGKTSIARSSSDLSDMEKAMHRRRTDVNVSTALNRNISNLSQKSRRHNFGYSSTTILSSNNATIKTQPRLSQTRDLKPRQLFPLSVSKQNVQPTKIPILEKKVSFEAMTPGNKENVDYNQEIDRTRKTNNNYASPYQESAKSVYKLSMSPEGKPKLDVEQNAYNISFDENSFFEN

SEQ ID NO: 3292 - protein, 742 aa, Thermobifida fusca YX
MIEPLQPGDPGRIGPYRLVSRLGAGGMGQVFLARSPGGRPVVVKVILPEYANDDEYRIRFAREVEAARRVGGFHTAQVIDADPTADPPWMATAYIPGPSLRKAVTERGPLYGNNLRTLAAGLVEGLAAIHACGLVHRDFKPSNIVLAADGPRVIDFGVARPLDSSVMTQSGAVIGTLAYMSPEQTDGSQVGPASDVFSLGTVLAFAATGRSPFMADSIGEIIARISGPPPELPELPDDLRELVYACWEQNPDLRPTTAELLAQLSTDHTGDDWPPPHLSDLIGSMLPLGATTSPNPSLAIEPPPPSHGPPRPSEPLPDPGDDADEPSAEKPSRTLPEPEPPELEEKPIQVIHEPERPAPTPPRPREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 3293 - protein, 457 aa, Candida glabrata CBS 138
MGQDKHLFVLIHGLWGNYKHMKSLEKVLDATLNGKKSGKDKDYVFFLPKQNATFKTFDGIEIIGYRTLLELCEFMKEFKDGNITKISFVGYSLGGLVARFVVGKMYSECNDIFGNIERCIFMTMATPHLGIQFYNPLGYLHRKLLFSTFTGLGSTILGKSGRELFIANSSNDILVRLSEGKYIEALEEFNHRILFANVKNDRTVAFFTGFIADVDPFLESDNRIKFDFESKIPGKSYSRAKPRIVDLNKLDSNVKKEKTQHNPVKYWSRTLLLLVLVVFLIVPFAFFFNIGGTIYSYVATWRYRKMLKSNEFPKLIKEKAGFSDQLKGYMSDAYSNVMSTVIDDDSQIENEDTPKFVDEDSNSWTNLLSKYTHHGGTEEKWKNKFKKMPLTKERQLIMRNLNQLTWIKIPIYVKFLNSHGGIVARNGISESTAATSVGSVEFAGQLVSYLIHNANNK

SEQ ID NO: 3294 - protein, 230 aa, Buchnera aphidicola str. Sg (Schizaphis graminum)
MKTNKLVLIRHGQSKWNKLNKFTGWHDIELSDNGINEALKAGSLLKKEKFFFDYAHTSMLKRAIHTLRYILDTLDQSWLPVQKSWRLNERHYGALEGLNKDEMISKYGEEQVNLWRRSFEIIPPQIRLNDKRFPGNDIRYSNIDNNELPLGESLELTAKRVIPYWNKFILPQIKKRNRVLIVAHGNSLRALIQFLNKIDNKKILELNIPTATPIILEFNEEYNSIKWYYL

SEQ ID NO: 3295 - protein, 954 aa, Vibrio vulnificus CMCP6
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDSLPQTEAFGALLQYPSTTGEVRDLTDVITQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEVGIRTIARRTHHMTAILAAGLTKSGYELAHNAFFDTITINTGDNTQALYAKAQAADINLRLLDGQIGISFDETTTVADIDALFAIFDVKESVNALSTDIAGNEFAAIPEACRRTSRFLTHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 3296 - protein, 181 aa, Glycine max
  misc_feature (168)..(168): Xaa can be any naturally occurring amino acid
  unsure (1)..(181): unsure at all Xaa locations
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVDYALAQGLKVIACIGETLEQREAGTTMEVVSAQTKAIAEKTSDWTNVVLAYEXPGWAIGNRAGCFP

SEQ ID NO: 3297 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 3298 - protein, 116 aa, Fagopyrum esculentum
MAEEAQVIACHTVQEWNEKFQKAKDSGKLIVIDFTASWCGPCRVITPYVSELAKKFPHVAFFKVDVDDLKDVAEEYKVEAMPSFVILKEGQEVERIVGARKDELLHKIAVHAPITA

SEQ ID NO: 3299 - protein, 300 aa, Polaromonas sp. JS666
MTPANAPAPSPATPSATPYGTLPPAATPSARKPLSLPRLREMHAQGEKITMLTAYDATFAAVADAAGVECILVGDSLGMVCQGLTSTVGVTLETMRHHTECVANGLRRSHATAWLIGDLPFGTYHESKEQALRNAVALMQAGAHMVKLEGGGWTADTVRFLVERGIPVCAHLGLTPQTVHALGGYRVQGKTEEAAATLKREAHELQDAGAAMLVLEMVPAALSAALTQALTHCPTIGIGAGNGTAGQVLVLHDMLGMNLGKMPKFVRNFMDGAPSVRGAMEAYVRAVKDGSFPVNATHAW

SEQ ID NO: 3300 - protein, 463 aa, Schizosaccharomyces pombe
MRVPNEVCFNILSYLEADELRCKSTVCTSWRNFIIPTLWEKVVFQNEAQLNNFFDTLQYSKDVSYYFRYLRKLNCSRVRKFLTDKHLMLMTLATGISRLNLSGCTRISEPLIGKLLYQNLNLVTINFSNIFSLPANILEYISDNCPNLKALNIGNCGLVEDTGMVQIIKRCPYLNRLIIPNCRKLTDVSLQILSEKEDLIELDISGCEGFHNADTLSRLVSRNRGLKELSMDGCTELSHFITFLNLNCELDAMRALSLNNLPDLKDSDIELITCKFSKLNSLFLSKCIGLTDSSLLSLTKLSQSLTTLHLGHCYEITDIGVQCLLKSCKNITYIDFGGCLRLSDIAVSAIAKLPYLQRVGLVKCICLTDLSVILLSGSFSRNLERVHLSYCIGLTAKSVSYLMYNCKTLKHLSVTGINSILCTELRSFSRPIPDGINPSQVPVFCAFTKVEIDLFREFIRNRI

SEQ ID NO: 3301 - protein, 330 aa, Brucella suis 1330
MATFDVLCIGNAIVDILARTDDVFLETNGIIKGAMNLIDAERAELLYSRMGPATEMSGGSAGNTAAGIASLGGRSAYFGKVATDHLGRVFAHDIRAQGVAFDTRPLEKGSPTARSMIFVTPDGERSMNTYLGACVELGPEDVETSKVADARVTYFEGYLWDPPRAKEAIVMASKIAHESGRQMAMTLSDPFCVDRYRDEFLQLMRSRTVDIVFANEDEAKALYKTKSLETAIAAMRMDCRLSVITRSEKGAVVVTPDQTLTVPAIEIDDLVDTTGAGDLYAAGFLYGYTKDRSLEDCARLGSLAAGLIIQQMGPRPQISLEAAASQAGLI

SEQ ID NO: 3302 - protein, 219 aa, Escherichia coli
  misc_feature (1)..(1): Xaa can be any naturally occurring amino acid
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
  unsure (1)..(219): unsure at all Xaa locations
XTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 3303 - protein, 438 aa, Mycobacterium sp. MCS
MGAHHTATEQSARLFADACAVIPGGVNSPVRAFNAVGGTPRFITSANGYWLTDADDNRYVDLVCSWGPMILGHAHPAVVEAVQRVAADGLSFGAPTPSETELASEIISRVAPVERLRMVNSGTEATMSAIRLARGFTGRPKIVKFSGCYHGHSDALLADAGSGVATLGLPSSPGVTGAATADTIVLPYNDVDAVEEIFEQVGDQIAAVITEASPGNMGAVPPEPGFNAALRRITEEHGALLILDEVMTGFRVSRSGWYGLDPVDGDLFTFGKVMSGGLPAAAFGGRAEVMERLAPLGPVYQAGTLSGNPVAMAAGLATLRTADDAVYAALDKNADRLAGLLTDALTDAGVTHRVQRGGNMLSVFFTAEPVGDFATARASETWRFPPFFHALLDAGVYPPPSAFEAWFVSAALDDEAFDRIAAALPGAARAAAEASRPA

SEQ ID NO: 3304 - protein, 468 aa, Pseudomonas putida KT2440
MTQTSPIATDEPHLQRNLTNRHIQLIAIGGAIGTGLFMGSGKTISLAGPSIIFVYMIIGFMLFFVMRAMGELLLSNLNYKSFIDFSADLLGPWAGYFTGWTYWFCWVVTGIADVVAIAAYTQFWFPDLPQWIPALTCVGLLLSLNLVTVKMFGELEFWFALVKIVAILGLVATGLYMVITGFTSPSGRTAQLANLWNDGGMFPHGLMGFFAGFQIAVFAFVGIELVGTTAAEAKNPERTLPRAINSIPIRIIVFYVLALIAIMAVTPWRDVVPGKSPFVELFVLAGLPAAASIINFVVLTSAASSANSGVFSTSRMLYGLSQEGDAPKAFEKLSSRSVPANGLYFSCTCLLLGAVLIYLVPNVVEAFTLVTTVSAVLFMFVWTLILLSYLKYRKDRAALHQASNYKMPGGRFMCYVCLSFFAFILVLLSLEADTRSALVVTPIWFVVLAVTYQLVRSRRHPRTAVRNG

SEQ ID NO: 3305 - protein, 403 aa, Aspergillus nidulans FGSC A4
MGKADRKKSARASASPYQKPSKGDGRSAAAKAGSAIFKFNTDLGQHILKNGAIADNIVDKANVQPSQTVLEVGPGPGILTTRILEKAKKVVAVEFDPRMAAELTKRVQATPMEKKLQIVLGDFIKTDLSKLPPFQVCISNTPYQISSPLIFKLLSMPNPPKMCVLMVQREFALRLLARPGDALYSRLSVNVQFFSKVSHIMKVGRNNFRPPPQVESSVVRIEPKLGKPEISWDEWDGMLRICFVRKNKTLRAGFMATKIRQMIERNWITWAAMHPEKVSQGDVDLLSGKTPFPEGKFANSKDDGDVDMDVDDAGPVVDEDDVGDIFMNGVEGGEKGAAVAQSGPVITVAGQQVPRTSVTRLIQFKIERILDTAGLANHRANKCDENDFLRLLHACNTEGIHFS

SEQ ID NO: 3306 - protein, 554 aa, Desulfitobacterium hafniense Y51
MGSMESSASLRNYFEERVLKQPEGFSFGLWTKNEGLVWLKPACLPEVMEQLWLKVPSRPLLMTHVGNDERSLGHGFVIYLLLHFPGDFTLTLGARGIEKSFPSLTLLCPALNWPEREVRDLLGLHPDGHPDPRPLVLHPGWTGGFYPLRKPCPETPASIGGECPGEALKEVSFNPQPLSFTEAEGEGTFEIPVGPVHAGIIEPGHFRFQTIGETVLHLDAQLFYTHKGIEKLLEGKDLEEGLKIVERVCGVCAVSHALAYCEAVEKLKGMEVPRWILGWRTVLAELERLYNHVGDIGNLCAGVGFALGNVNALQNKEQLQRLNHQLFGHRFLRGNITPGGVKKIPQGEERAYLQRRLAELEQDFEEWLPLIQEHDGFRQRAITTGVLSKQSALDLGVTGPAARASGISQDWRERHAHLLYEELKMEPQVEQEGDVWSRLMVRVREVKQSFALLAELLEGDFLQDTVEQGDFDLNGSGAFSPQPYSFAWGCAESPRGTDVIWLMLDDEGKIYRCRIRSASYANWAAVPLAVQGNIVPDFPLINKSFELCYSCCDR

SEQ ID NO: 3307 - protein, 535 aa, Magnetococcus sp. MC-1
MDILSAIEIQDPAWIAIAFIFGLIFKQFQLAPMIGFLAAGFMLNMLGVSTDSFLNELADLGVTLLLFTIGLKLQLKTLARLETWGTATAHMAISVVAITAVLLLLSLTAIQVFAELDLASALIVAFALSFSSTVFAVKVLEERGAMSSQYGRTAIGILVIQDIAAVIFLAASSGKLPSIWAILLLALIPGRHLLGYILSRSGHRELLPLFGFVAALGGAALFEVVGMKGDLGALIFGVLLANHPRSGELAKHLLGFKDVLLVGFFLTIGLAGLPTWDTALAALLLSLLLPFKGGLFYLLLARFKLRARAATQGGAILTNYSEFGLIVAAISLNVEWLPAEWITILALALSFSFLLASPLNRYTDTLYMSLHDWLIRWEQEKRLPEDEEISISGNRILIIGMGRVGQAAYDEMAHNAEGQILGIDLDKAEVEKNSKEGRRVVPGDATHPEFWSRFSDGHKGVEMILLAMPNHLGNIAAADNLRAHGYKHSLVATALYPDQEAELKRHGITEVYNIYKEVGVGAAAHMWDSIKRVKI

SEQ ID NO: 3308 - protein, 247 aa, Triticum aestivum
MLAVFDSAVAPSPEGLRQPGEAGHGADGLAARFREARPGAVTVDFGGGGAMAYSSHGQSPFLPRLFGVVDDIFCLFQGAIENMAVLKQQYGLSKSATEINLVIEAYRTLRDRGPYPADQVVRDLNGKFAFVLYDRSTSSVFMAADADGGVPFYWGVDSGGHLVVSDDDEAVKNACGKSFAPFPKGFFFTTSGGLQSYEHPLNEVKPVPRVDSKGEVCGTTYAVDEQAKKDTAGIPRVGSAADWSSQY

SEQ ID NO: 3309 - protein, 549 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSTTVTNDNH

SEQ ID NO: 3310 - protein, 265 aa, Medicago truncatula
GNVERQVLVNDYGIGKVIAFEKRIQNLKEVFTVEGYKMFSRGSVETILPPRRNQLYGRLSSSVEADIEKLSNDASNEQKTANDYRSDKRKAEVKLEDLYKKMNPIKVNSCLDYRPLRLCLHAGKDVASKKLTLEDEMRQQATESSSAPLSSVDEIVEEISVLLEGLEQRRYEAEGKADDLKVKFDELCESANTELASLEKSENELIEIERQIDAATEAKDHYENFMKTNVLHDIKEAEEHYLELTKSREANAKPDRPLNWCSSRL

SEQ ID NO: 3311 - protein, 358 aa, Persea americana
  misc_feature (94)..(94): Xaa can be any naturally occurring amino acid
  unsure (1)..(358): unsure at all Xaa locations
MSAFCGKYQDELIANAAYIGTPGKGILAADESTGTIGKRLASINVENVESNRQALRELLFCTPGALECLSGVILFEETLYQKTASGKPFVDVLXERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWTLSFSFGRALQQSTLKTWAGKEENVKKAQSAFLSRCKANSEATLGTYKGDAAKGEGVSESLHVKDYKY

SEQ ID NO: 3312 - protein, 344 aa, Medicago truncatula
MLYAKKERKIIKRQQVYKALRQKLNACHNALEFRRRKFQTNATNLKHQLSWKFNGLLKRKGISGLIKVDYDETTLSIESAVRAQPPLTVVGATDIDMRSGIRIRRRRSAFRHQTSIDTLPSRCFQSPLSSSDSPCCSVLFGTINNTWVPLFRGFVGYSLVTLVCHFCCDSSWFLQICLWTSFKGFWFSGMMVVQPILSRHFGSFWIVIQERQLEQDLYYLHSQSSTICGVSASPDIIHRRLGHPSFDKLKVLVPQLSHLKSLDCESCQLGKHVTASFPSSSNKRSKSPFDIVHSDVWGPSRVMSTLGYRYYVTFIDDFSRCTWITLLKDRSQLFGAFQTFCSEI

SEQ ID NO: 3313 - protein, 545 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSSVQV

SEQ ID NO: 3314 - protein, 563 aa, Crocosphaera watsonii WH 8501
MDAIQTIIPQFDSIDAALADIKAGRAIIVVDDENRENEGDIICAAQFATTNLINFMAVEARGLICLAMNGKRLDELDLPLMVTKNTDSNQTAFTVSIDASPHLGVSTGISAEDRARTIQVAINPNTQPEDLTRPGHVFPLRAKAGGVLKRAGHTEAAVDLARLAGLYPAGVICEIQNPDGSMARLPELLEYAKKHNLKLITIADLISYRLRHDRFVYRETVCQLPSQFGTFQLYAYRNVLDETEHVAIVKGDPSEFKDHPVMVRVHSECLTGDGLGSLRCDCRMQLQTALQMIEKEGSGVVVYLRQEGRGIGLINKLKAYSLQDMGLDTVEANEKLGFPADLRDYGMGAQILNDLGVKKIKLVTNNPRKIAGLKGYGLEVVERVPLLIEPNTYNSSYLSTKAQKLGHLFLRTFLITIAIDWEETPVTITERYEKLQQVRELSRSMQLLLQEEARPVAIALFEQPSLIFHLGFEQVKMVDDNWHRNQNHPYGQAIISILDNLAAWDNIKRLEFLISSGDDPMSGLQGQLKRYPFSLDTKPSQCTLPWKRQTIYSFSDEQWAITA

SEQ ID NO: 3315 - protein, 392 aa, Burkholderia xenovorans LB400
MKYSNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIAAFVRALPAR

SEQ ID NO: 3316 - protein, 500 aa, Rhodopirellula baltica SH 1
MRNQQSTQLLFELSRAGRRAHRLGDLDVPSVNVDELFADEALAETPPPLPELAEGDVVRHFVGLSTLNMSVDTHFYPLGSCTMKYNPKRNERIASLPGFLNVHPLQHESGLQGLLELLYELQGMFAEISGLPGVSMQPAAGAHGELAALLVAAAYFREQGSDRNVVLTADSAHGTNPASAQMAGFKTKTVKSNANGLVDLEDLKAKLDDKTAVFMLTNPNTLGLFDRQIEEINKLVHDAGALIYLDGANMNAILGITRPGDFGADLMHYNPHKTFSGPHGGGGPGAGPICVRDFLAKYLPGPIVTRVENENASGDDDRYTYHLTSPSDDSIGRVRSFFGNTGVLVRAYIYLRTYGGDGLRHVSEDAVLGANYLLSKVKHFLDVPHGDRCMHEFVASATRLKKEKKLSAMDIAKRILDYGFHAPTVYFPLVVDEAVMVEPTETESKQTLDAFVEALFRITEEGEELIHDAPHSTRISRPDDVTAARRPILKWTDAAGESAT

SEQ ID NO: 3317 - protein, 481 aa, Rhodopirellula baltica SH 1
MPLIKNSVPKQVDRMSYLFHTDEDRREMLKSIGANSIDEIINDQVPEAVRMKRPLDLPPACNELALTAEMTRLAARNASADSHVCFLGGGAYDHFIPAAVDEIASRGEYYTSYTPYQAEVSQGNLQVMFEYETLVTQLTGLGVSNASLYDGGSAATEAVLMALSMQRGRNKVITTDVVHPQYRDILVAYLKNIDAELVVVPSDENGHSKPMIDAIDDKTACVLIQHPNFVGQLESVSEIAAAAKEAGALTIQVFDPVSLGRLKRPGDMGVDIAIAEGQSLGNPLAYGGPYLGIMACRDELVRRLPGRIAGQTTDRRGKRCWVLTLQTREQHIRREKATSNICSNQTLLALRATVHLSLLGPEGLKETADHCIAKTAYAKEVIAKSDRFEIVGEGPSLKEFVVRDLGADVDGLLAHARDNGLLAGIDMTPMCVGGAEATDASIALPSRYEQCFLVAVTEKRSRVEIDRWAKVLCEAPAMATV

SEQ ID NO: 3318 - protein, 850 aa, Pseudomonas aeruginosa UCBPP-PA14
MKKVWFQLHWFFGISAGLVLALMGVTGATLSFQDELMRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPADSAIQWRAGDLLEIVPHQAPARIREWLQRHHLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 3319 - protein, 146 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 3320 - protein, 393 aa, Zygnema circumcarinatum
MLITKADPMVVSMGPHHPSMHGVLRLIVTLDGENVADCEPVLGYLHRGMEKIAESRTTLQYLPYVTRWDYLATMFTEAITVNAPERLANIQVPKRASYIRMIMLELSRIASHLLWLGPFMADIGAQTPFFYILREREMIYDLFEAATGMRMMHNYFRIGGVAVDLPYGWVDKCLDFCDYFLPKVNEYERLITRNPIFLKRVEGIGVIGREEAINWGLSGPMLRASGVQWDLRKVDRYECYHELDWQVEWQSGGDCFARYLVRIGEMRESVTIIQQALKAIPGGPYENLEARRMASMAQKNSQWNDFEYQFVSKKPSPTFKLPKQEHYVRVEAPKGELGVFLIGDDSMFPWRWKIRPPGFINLQILPQLLIGMKLADIMTILGSIDIIMGEVDR

SEQ ID NO: 3321 - protein, 246 aa, Arabidopsis thaliana
  misc_feature (141)..(141): Xaa can be any naturally occurring amino acid
  misc_feature (155)..(155): Xaa can be any naturally occurring amino acid
  misc_feature (219)..(219): Xaa can be any naturally occurring amino acid
  misc_feature (222)..(222): Xaa can be any naturally occurring amino acid
  unsure (1)..(246): unsure at all Xaa locations
MVGATVVSKWTPLCVASPPERNSASLNPHCSPARVNFRTALAAFRPQFRLFSRNSASRRRLRASSSAESGIFLPHLVASMEDVEETYIMVKPGWHKRGLVGEIISRFEKKGFKLIGLKMFQCPKELAEEHYKGLSAKSFLXNPIEYITSGPVVCXAWEGVGVVASARKLIGKTRPRDPAPGTVAGDLAVQTGRNIVHGSDSPENGKREIGLWFKEGELXKWXDSALATWLRGVSRQSNYKWPCFLP

SEQ ID NO: 3322 - protein, 481 aa, Buchnera aphidicola str. Sg (Schizaphis graminum)
MLNRVRRTKIVATLGPSTDKANNLEKIILSGANVLRLNFSHGSSEEHKKRAKKAKEIMFKLNCHIALLGDLQGPKIRISKFKKNSIFLKVNDVFILDANLNEKNGNNERVGIDYKKLPNDLNVNDILLLDDGRIQLKVIKIEKCAIFTKVIIGGILSNNKGINKLGGGLSADALTEKDKKDIILASEIDVDYLAVSFPRCADDLIKARELLKKSGSNAQIIAKIERAEAVFDQNAIENIILSSDAIMIARGDLGVEIGDAELVGIQKKLIRTARKLNKVAITATQMMESMILNPLPTRAEVMDVANAVLDGSDAVMLSAETASGKYPSETVISMAKVCKGAEKVPSINVSRHRLNVEFQSIEEAIAMSSMYAANHLKGITAIITMTESGKTALMTSRITSGLPIFALSKHKKTLNLTALYRGVIPIYFDSDKDGVEAANEAIILLCKKKFLFNNDLVIVTQGDIMGKIGKTNTSRILRVTY

SEQ ID NO: 3323 - protein, 217 aa, Escherichia coli CFT073
MNQTLLSSFGTPFERVENALAALREGRGVMVLDDEDRENEGDMIFPAETMTVEQMALTIRHGSGIVCLCITDDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 3324 - protein, 417 aa, Pyrococcus abyssi GE5
MGIRVSDGKIIHDAVHGSMKVPEEILKLVDTPEFQRLRGVKQLGLANLVYPGANHTRFEHSLGTWYLAKKLSQELNLHYEESLLIQLAALLHDIGHGPFSHTFERIYRERLKFQDHMEVSKAVLEGKLEMCEEGGEIPDIINSLGYEPREIGDLIIGKHEKKYLRMIIHGDIDVDQLDYLTRDAHYTGVAHGIIDLERLLMVMKTHNNELVIDEKGIEAVEGMLVARSLMYSRVYFHRTVKIAEGMLIRALEFALDEGQLQDFWRMTDDRLIIELEDLGDYAGEIVRRIRSRRLYKAAVVIGPENLTSEEKKVLAHLYRSYKKRRKIENELAEEVGAKEGDVIIELSIPELILSEPRLKQVEVNVMLSSGKLEPIAKVTPLASAIKRRQTPRWILLIATLPEHVEKIKNVWREIVLE

SEQ ID NO: 3325 - protein, 304 aa, delta proteobacterium MLMS-1
MCSLELDSYLLIKAFLMRPDQAQKILSQHKLAPSKQRGQNFLVQPAVAERIVEVAEIEPTATVVELGVGLGALTRPLAARCAKVIGLELDAGIVNYHRQCGELPANVELRHQDLLQADYPAMAAEQGGKIKIIANLPYSITNPLLFRLLVQRQALDWVVLMIQKEVADRLVAAVGSKEYGVLTALLGACATVERLLAVGPGNFFPRPKVDSVVIRLDFRNFPHVPDDAEFGRLRRVVDAAFNQRRKTLLNSLSAGLPELDRETIAAALAAAELDSGLRAERLTTADFRRLSAKLPPLSAKSPPR

SEQ ID NO: 3326 - protein, 94 aa, Prunus salicina
WPSNYSNPTKPSNCAGSQFNFTKVFPYLRSKLKISWPDVESGNDTKFWEGEWNKHGTCSERILNQMQYFQRSQAMWKSHNITEILKNASIVPHP

SEQ ID NO: 3327 - protein, 922 aa, Oryza sativa
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRALFPPASEEFSSVEHTVYPPICHKEVAKHTIHWMSNHNSPCDIPKPASVDEFVKNGKKKKSFMSSIFRKKGRSGTGSSDKKLLSRRDIVFDRHCATKIESLTLSCLDSPHRQFDTREYRVFVGTWNVAGKPPNSSLNLEDFLQIEGLPDIYVLGFQEIVPLNAGNVLVIEDNEPAAKWLGLIYQALNKPQDQSSGDELSPPETSDSRQGGGSGSRDSIPKSSSGGMLFFQKPSLKMLSKNYRVDSALVKTCTCLTDPSTMQRRAREMREFLYRIEASPPPSLASAAAAADEDGGPDAGGELARSSVNYCLIASKQMVGIFLSVWVRRELVQYIGHLRVDSVGRGIMGRLGNKVLDAVLLCLCSLFGSLDSWRRHGWLSCLQGCIAMSMTLHQTSVCFVCSHLASGEKEGDEVRRNSDVAEIIKSTQFPRICKVPGQRIPDKILDHDRVIWLGDLNYRVALSYDETKTLMGENDWDTLLEKDQLMIERQAGRVFKGWKEGKIYFAPTYKYKQNSDSYAGETAKSKKKRRTPAWCDRILWHGQGIEQLQYIRGESRFSDHRPVCSVFVIEADVDNGSMIRKGYSTLDSRIHFESPIPQRHSFYDDF

SEQ ID NO: 3328 - protein, 358 aa, Triticum aestivum
RRRSIAWHRPDQLAACPAGGSANISCQTEPSPWGSPWDFRKSFCRNSERRPPPVLATSADAWGQPCPDRDPFRQRGAAVLSCAFSKPFADRLLPEAGAGQGLAASWDKDSIPNYAFGCGGSVTGPTSNLPKQGLLGLGRGPMAPADPQVGDMYSGVFSYCLPSYKSYYFSGSLRLGAAGQPRAARYTPMLRNPHRSSLYYVNVTGLSVGRSPVKVPAGSFAFDPSTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNSVVNVVANLQQQNLRVVFDVANSRVGFARESCN

SEQ ID NO: 3329 - protein, 103 aa, Medicago truncatula
MPQDTSNRAVRDTRGLSGGERSFSTLCFALALHEMTEAPFRAMDEFDVFMDPVSRKISMDTLIDFAEAQGSQWILITPNDTSLVKGGNRVKKMQMAAPRAYQM

SEQ ID NO: 3330 - protein, 95 aa, Prunus salicina
LWPSNYSNPTKPSNCNGSQFDDRKVYPQLRTKLKRSWPDVEDGNDTKFWEREWNKHGTCSEGRLNQMQYFERSHNMWMSYNITEILKNASIVPHP

SEQ ID NO: 3331 - protein, 292 aa, Streptomyces coelicolor A3(2)
MTTETTTATATAKIPAPATPYQEDIARYWNNEARPVNLRLGDVDGLYHHHYGIGPVDRAALGDPEHSEYEKKVIAELHRLESAQAEFLMDHLGQAGPDDTLVDAGCGRGGSMVMAHRRFGSRVEGVTLSAAQADFGNRRARELRIDDHVRSRVCNMLDTPFDKGAVTASWNNESTMYVDLHDLFSEHSRFLKVGGRYVTITGCWNPRYGQPSKWVSQINAHFECNIHSRREYLRAMADNRLVPHTIVDLTPDTLPYWELRATSSLVTGIEKAFIESYRDGSFQYVLIAADRV

SEQ ID NO: 3332 - protein, 539 aa, Oryza sativa
MGVISTVLGFSGFGFGFSAGIVIGYYFFIYFQPTDVKDVKVRPLVEYDSISLDGILPEIPLWVKNPDYDRIDWLNRFLEMMWPYLNKAICRTALDIAKPIIEENRKTYKLESIEFESLTLGSLPPTFQGMKVYVTEEQELIMEPSLKWAANPNVTVVVKAYGLKATVQIVDLQVFASPRITLKPLVPTFPCFAKILVSLMEKPHVDFGLKLFGADLMAIPGLYRFVQETIKKQVASMYLWPKTLEVPIMDPSKASKKPVGILLVKVLRAQNLRKKDLLGKSDPYVKLKMSDDKLPSKKTTVKRSNLNPEWNEDFKFVVTDPETQALEINVFDWEQVGKHEKMGMNNILLKELPADETKVMTVNLLKTMDPNDVQNEKSRGQLTLEVTYKPFKEEDMEKEGIDNADVVEKAPDGTPAGGGLLYVVVHEAQDLEGKHHTNPYAKIIFKGEEKKTKVIKKNRDPRWEDEFEFVCEEPPVNDKLHIEVLSKASKKGLIHGKETLGYIDISLADVISNKRINEKYHLIDSKNGQIQIEMQWRTS

SEQ ID NO: 3333 - protein, 277 aa, Mycoplasma mobile 163K
MFQWFPGHMAKALRQIKEKEKFVDFFIIVLDSRAPISTYNKEFDKISPKKPRLFIINKIDYGDVKKYQKLERYFRTENSDVLFTNLKKQNTRSIIIKSVDKLLFKKTEYDKKRGLLNPFTVGMILGLPNTGKSTLINLLANKSKTKVANTPGVTRGQQLVITERFKLFDTPGILFPKIEYELDAIKIAMIGSIKWEIINQKELFFGSYKLLSEYYPEEIEKLGLQPSFDDNQIFISLEQIGKKHNFYLKDKQIDENRTIIFFNNYVKNLKNVTYDRL

SEQ ID NO: 3334 - protein, 341 aa, Medicago truncatula
MGLEGVLLGMGNPLLDISAVVDEDFLKKFDIQLNNAILAEDKHKSMYDEMTAKYNVEYIAGGATQNSIRVAQWLLQVPGATSYIGCIGKDKYGEEMTKNSKQAGVNVHYYEDENTPTGTCAVCVVGGERSLIANLSAANCYKSEHLKKPENWALVEKAKYFYIAGFFLTVSPESIQLVAEHAAANNKVFMMNLSAPFICEFFKDPQEKALPYMDYVFGNETEARTFSKVHGWETDNVEEIAIKISQLPKASGTHKRITVITQGADPVCVAQDGKVTLYPVILLPKEKLVDTNGAGDAFVGGFLSQLVQEKPIEECVRAGCYAANVIIQRSGCTYPEKPDFQ

SEQ ID NO: 3335 - protein, 228 aa, Fusobacterium nucleatum subsp. nucleatum ATCC 25586
MKLVLIRHGESAWNLENRFTGWKDVDLSPKGMEEAKSAGKILKEMNLVFDVAYTSYLKRAIKTLNIVLEEMDELYIPVYKSWRLNERHYGALQGLNKAETAKKYGDEQVHIWRRSFDVAPPSIDKNSEYYPKSDRRYADLADSDIPLGESLKDTIARVLPYWHSDISKSLQEEKNVIVAAHGNSLRALIKYLLNISNEDILNLNLVTGKPMVFEIDKDLKVLSSPELF

SEQ ID NO: 3336 - protein, 832 aa, Arabidopsis thaliana
  misc_feature (263)..(263): Xaa can be any naturally occurring amino acid
  misc_feature (302)..(302): Xaa can be any naturally occurring amino acid
  misc_feature (750)..(750): Xaa can be any naturally occurring amino acid
  unsure (1)..(832): unsure at all Xaa locations
MGCLLILLLTLICFSLRLCLATDVITFSSEFRDSETVVSNHSTFRFGFFSPVNSTGRYAGIWFNNIPVQTVVWVANSNSPINDSSGMVSISKEGNLVVMDGRGQVHWSTNVLVPVAANTFYARLLNTGNLVLLGTTNTGDEILWESFEHPQNIYLPTMSLATDTKTGRSLKLRSWKSPFDPSPGRYSAGLIPLPFPELVVWKDDLLMWRSGPWNGQYFIGLPNMDYRINLFELTLSSDNRGSVSMSYAGNTLLYHFLLDSEGXVFQRDWNVAIQEWKTWLKVPSTKCDTYATCGQFASCRFXIPGSTPPCMCIRGFKPQSYAEWNNGNWTQGCVRKAPLQCESRDNNDGSRKSDGFVRVQKMKVPHNPQRSGANEQDCPESCLKNCSCTAYSFDRGIGCLLWSGNLMDMQEFSGTGVVFYIRLADSEFKKRTNRSIVITVTLLVGAFLFAGTVVLALWKIAKHREKNRNTRLLNERMEALSSNDVGAILVNQYKLKELPLFEFQVLAVATNNFSITNKLGQGGFGAVYKGRLQEGLDIAVKRLSRTSGQGVEEFVNEVVVISKLQHRNLVRLLGFCIEGEERMLVYEFMPENCLDAYLFDPVKQRLLDWKTRFNIIDGICRGLMYLHRDSRLKIIHRDLKASNILLDENLNPKISDFGLARIFQGNEDEVSTVRVVGTYGYMAPEYAMGGLFSEKSDVFSLGVILLEIVSGRRNSSFYNDGQNPNLSAYAWKLWNTGEDIALVDPVIFEXECFENEIRRCVHVGLLCVQDHANDRPSVATVIWMLSSENSNLPEPKQPAFIPRRGTSEVESSGQSDPRASINNVSLTKITGR

SEQ ID NO: 3337 - protein, 390 aa, Rubrobacter xylanophilus DSM 9941
MRAVVYKGPFEVAVENVEDPKIQDPNDVVVRITSTCICGSDLHMYEGRTAAEPGIVFGHENLGIVEEVGPGVVSLRQGDRVVMPFNVACGFCKNCQRGYTGFCLTVNQGFAGGAYGYVAMGPYTGGQAEYLRVPFADFNCLKLPEGDEHEADFALLADIFPTGYHGTELADVQPGETVAVFGAGPVGLMAAYSAMIRGAERVFVVDRVKERLDKAEEIGCIPVNFDEVDPVEYIKEQTPGNRLSTLSVDNDANRGADKGIDAVGYQAHVRGGEREEPAIVLNTLIECVRPTGALGVPGLYVPSDPGAPDDASKKGQLLVSIGRMFEKGLRMGTGQCNVKRYNAYLRDLIIAGRARPSFVVSHEVPLDQAPEAYEKFDKRIEGYTKVILKP

SEQ ID NO: 3338 - protein, 478 aa, Aspergillus nidulans FGSC A4
MNENDENGPSTRLTRAKAAALTTDAPAANGALKKPLQTKKAATGANGTQRKRAALGDVSNVGKADNGETKDAKKATSKTGLTSKATMQSGGVQKLSRSNLSRTAVGAKDNNVKKPATEAKRPGSGSGMGSAMKRTSSQKSLQEKTIQQEEPPRKKVDIEKVVEKQAEAVSVKGDVKAGAQTEELEKPQDFVADLDTEDLDDPLMAAEYVVEIFDYLRELEMETLPNPDYIDHQPDLEWKMRGILVDWLIEVHTRFRLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWDATLAHYAGYTEEEIDEVFRLMVDYLHRPVCHEAFFKKYASKKFLKASIMTRQWAKKYHHLYIDSALTEPYNSIKDNE

SEQ ID NO: 3339 - protein, 213 aa, Agrobacterium tumefaciens str. C58
MTIAKIEDAIEAISRGEMVIVVDDEDRENEGDIIAASDSITPQQIAFMMNHARGLVCVAMPGERLDALDIPLMVSRNTESLKTAFTVSVDYIPGTTTGISAADRAKTVRALVSEGSRPEDFARPGHIFPLRANPEGVLGRTGHTEAAVDLCRLAGKFPSGTICEVANDDGTMARLPQLEIFAERHGLLVVTIKDLVSYLKGEVVEEMVQKQVA

SEQ ID NO: 3340 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 3341 - protein, 409 aa, Shewanella sp. MR-7
MAKHSLDKDKIKILLLEGVHQSAVDVFERAGYTNIEYHKASLGDEALLESIKDAHFVGIRSRTQLTADVLKRAEKLIAIGCFCIGTNQVDLATAELLGIPVFNAPFSNTRSVAELVLGEIIMLMRGIPERNAIAHRGGWMKTAAGSYEVRGKTLGVIGYGHIGTQLGILAETLGMRVVFFDIEDKLPLGNAQQIHSMEQLLAQSDVVSLHVPETAQTKDMISTAEFAAMRKGCIFINASRGTVVDIDALTVALKERHLAGAAIDVFPVEPQSNDDEFISPLRGLDNVLLTPHVGGSTAEAQENIGIEVAGKLAKYSDNGSTVSAVNFPEVSLPMHKGISRLLHIHQNRPGVLIKINKAFSEKGINIAAQYLQTTAEIGYVVMEVDTHQAEEALVELKAIEGTLRTRVLF

SEQ ID NO: 3342 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 3343 - protein, 254 aa, Rickettsia akari str. Hartford
MLQVVVLGCGASIGVPVIGCDCSICASHSKYNKRTRSAIYINDENSQILVDFGFDIRNQLLREKINKLDCAILTHYHSDHVNGIDDLRVFTFMQGKPFKIYTDHDSTANLYTKFDYLFTNKLFKLGRLFTTQSVSFFDKIKINTIEIQFFRQHHGPIDSLGLRIGDFVYSPDVIDFPPESEKFLKDIKIWILDCMDYKSNLNHAGLDKVLEWREKYQPEQILLTNMRHTIDYHEITKMLPNNVKPLYDGYRFTV

SEQ ID NO: 3344 - protein, 362 aa, Debaryomyces maramus
IDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTDHLMKILSERGYTFSTTAEREIVRDIKEKLCYVALDFEQEMQTSSQSSAIEKSYELPDGQVITIGNERFRAPEALFRPADLGLEAAGIDQTTYNSIIKCDVDVRKELYGNIVMSGGTTMFPGIAERMQKEITALAPSSMKIKIIAPPERKYSVWIGGSILASLSTFQQMWISKQEYDESGPSIVH

SEQ ID NO: 3345 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 3346 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 3347 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 3348 - protein, 760 aa, Oryza sativa (japonica cultivar-group)
MLASATIKVFIYICDVNIFDIYQVMAYMISISAQPASRCQTFCGDVEIPYPFGIGAGCAIEPGFELSCNNTADGSMKPFHTNVEFLNISLLHGHSRALNHLSTDCYNYSTKSVEPSTWWLDFTATPYRFSDVHNKFIVIGCNTLSYIYNSYNRTGYTTACASVCGSIEALTNGSCAGVGCCQNAIPKGLTRYDVAMYIVYNDSDSWRFNPCSYAALVETDSFSFNTEYITTKKFNDTYKGRQPLVLDWAIGNVSCVMAENMTSYACQSVNSICVDSKNGPGYLCNCTNGYQGNPYLRDGCKDVNECDQNTGPCPKGATCHNTIGGYHCSCPPGRKLANDSSSCNPDINLIIGVCIGSIVIVIVIFFVRIIFERRKLTDVKKKYFQQHGGLILFDKMKSDQGLAFKVFTQAELEQATNKFEKSQILGHGGHGTVYKGITKDNITVAIKKCALIDDRHKKEFGKEMLILSQINHKNVVKLLGCCLEVDVPMLVYEFIPNGTLFDLIHGKNRTFHIPFSSLLKIVNEAAEGLAFLHSYANPPILHGDVKTSNILLDENYMAKVSDFGASILAPTDEDQFVTMVQGTCGYLDPEYLQTCRLTEKSDVYSFGVVLLEVLTGQMPLKFEGPEIQKSLSSSFLLAMKENKLEEMLDSQIKDHESMELVNGLADIAKKCLDMCSDNRPSMKEVSEELSRLRKLSKHPWIQRDTEIESFLSGPSTSNLETEHSYLSGPSTSNFEIEHSTEYRRKDEEMPINPSTSYFIR

SEQ ID NO: 3349 - protein, 489 aa, Vibrio vulnificus CMCP6
MCKTKIVATLGPASQTREKLTQLIQAGVNVVRLNFSHGSAEEHIARAEMVREIAQELNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVAAMVRIAQGVEHETSCAQGCWDKLHHLCNDAGKSFALSSMISATKVHKDLGVAIVTQHGETPLLMSRCQSQATIWAVSNKPELLRKLAILRGVTPVYLPTLDKRGDIAHQLISLLGADAKQKQISSIMMTQLESVEGVGDMNVCRLLNLNETPITTAIAA

SEQ ID NO: 3350 - protein, 409 aa, Helicobacter hepaticus ATCC 51449
MKQNYTKLKPNFENIFFEQENDKMILNFGPQHPSAHGQLRLILELENEKIIKATPDIGYLHRGIEKMAENMIYNEFMPTTDRLDYIAATSNNYAFALGVEKLIGVDIPLRAQVIRTMLLEINRIISHIFLLGVQGMDVGALSIFLYCFIEREYGLDLMEDYCGARLTHNAIRIGGVPLDLPHNFLESVEKFTHSVPKTLDLVRGLLDKNRIWRIRLENVGYISQDFAKQWSLSGIMARGSGIKWDIRKHNPYELYSELDFEVPIATEGDCYARYQLYIEEIYESLKIIKQLIAMYPSTPKEIMAKDARYISAPKEDIMTQNYSLMQHFVLVTQGMRPPVGEVYVPTESPKGELGFFINSQGAPSPHRLKIRTPSFYHIGVLQELLIGHYFADIPAILASTNVVFGEIDR

SEQ ID NO: 3351 - protein, 272 aa, Bacillus thuringiensis serovar konkukian str. 97-27
MDKQIGFIGCGNMGMAIIGGMLNKKIVSSNKIMCSDLNTTNLENASEKYGISITTDNKKVAKNADILILSIKPDLYASVINEIKEEIKSDVIVVTIAAGKSIKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 3352 - protein, 507 aa, Burkholderia xenovorans LB400
MLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCLGQLGLPVTESLPAHRLAAATGAAATA

SEQ ID NO: 3353 - protein, 266 aa, Coxiella burnetii RSA 493
MIAMNTPDFQRMKKDNKKISMVTCYDYWSACIISQSNVDCILVGDSLAMVMYGHSTTLPATVEIMAQHIQAVSRGAPNKFIIGDMPFCSYRKDLTTSMNAVERLMQAGAQAIKLEGADAHNLKFIHHVVKSGIPVIGHLGLTPQSIYTLGGFKVQGKEPSAAKKLMADAKALAETGCFAVVLECVPSELAELITHSISIPTIGIGAGPATSGQVLVLQDLLGTNNQFQPKYLKKFLNGFELIKKALDDFDQEVKTSTYPHLETHCY

SEQ ID NO: 3354 - protein, 426 aa, Neisseria gonorrhoeae FA 1090
MNRNEILFDRAKAIIPGGVNSPVRAFGSVGGVPRFIKKAEGAYVWDENGTRYTDYVGSWGPAIVGHAHPEVVEAVREAALGGLSFGAPTEGEIAIAEQIAEIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGDEIACVIVEPFVGNMNLVRPTEAFVKALRGLTEKHGAVLIYDEVMTGFRVALGGAQSLHGITPDLTTMGKVIGGGMPLAAFGGRKDIMECISPLGGVYQAGTLSGNPIAVAAGLKTLEIIQREGFYENLTALTQRLANGIAAAKAHGIEFAADSVGGMFGLYFAAHVPRNYADMARSNIDAFKRFFHGMLDRGIAFGPSAYEAGFVSAAHTPELIDETVAVAVEVFKAMAA

SEQ ID NO: 3355 - protein, 513 aa, Desulfovibrio desulfuricans G20
MSSSGPLNPVLLLILDGWGIAPAGKGNAVSAARTPVLDSLMAAPCRSRLQCSGRSVGLPDGFMGNSEVGHMNLGAGRIVYQDMTRIDIAVEERQLSARPAIADMFDALKSSGGTLHLLGLVSDGGVHSHVRHLYALVEAARDACVPVCIHAFMDGRDTAPKSGLQFINDLEEVLVRLGHGRIASVTGRYYAMDRDRHWERNETAWNALVHGQGEFADSAAQAVENAYAAGQTDEFIKPVIVGSAAGIADGDGIFFYNFRADRARQLTRCFIDPSFDAFDRGRVPVLARFATMTSYDASFDVPVAFDKDPLEGTLGEVVSLAGISQFRIAETEKYAHVTYFFNCGREEPFTGEDRLLVPSPRDVATYDLKPEMSVYEVTDSLLAALDKGYGLIVCNLANLDMVGHTGVFSAAVKACEAVDACTGRIIDAFVERGGVVMVTADHGNAEQLLDAQGNPHTAHSMNPVPVALLGAPAAWRLVPEGKLGDVAPTIIDILGLHRPEAMTGQSLLVKESV

SEQ ID NO: 3356 - protein, 95 aa, Prunus salicina
LWPSNYSNPKIPSNCKGALFGARKVYPQLQLNLKISWPDVKSGNETNFWQSEWNKHGTCSERTLNQMQYFERSDEMWNSYNITEILKNASIVPHP

SEQ ID NO: 3357 - protein, 95 aa, Prunus salicina
LWPSNYSNPTMPSNCNGSKFEDRKVSPQLRSKLKRSWPDVESGNDTKFWEGEWNKHGTCSEQTLNQMQYFERSHSMWYSFNITEILRNASIVPHP

SEQ ID NO: 3358 - protein, 95 aa, Prunus salicina
LWPSNYSNPRMPSNCRGSLFETRKLSPELQSKLKRAWPNVETDNDTKLWEHEWNKHGRCSEGTLNQTQYFQRSYSMWRSHNITEILRNASIVPHP

SEQ ID NO: 3359 - protein, 716 aa, Candida albicans SC5314
MAAHPSLWYRDKDSLRIGGVARYTIEYTRLDPTIKRIYFRLKNIEKSSIRAIHLLSGPFILYCHVVPCNYNPRKPFHPENVQKNTEVVFENQIKPNQAFNVSLLLNSNSLKGKDDKGYDIFQWEIEIVSQIVITKKTEVVYDFMIGDDLHFMKKLGQSIIQQTLTSLGTKIDMNEGTKPTIVDKAMDEIHNDSHKIYNTQLKVSKLTTDDIWSNEPKDPKKPVHLVIVTHGIFSNLTADMLYIKDQLELRVKENILVRGYRYNAGRTERGVKKLGTNVANYITDLIENSLYQYDKISFIGHSLGGVVQLYAIKYILMTKGPDYFERMRIKPVNFIGMASPFLGILNEMNFLISWVLDMGTLGKTGRDLTLSKRLPAWSDISIGESKKRDSFKPVLETLPEDPLQKFLTQFEQLVVYANAMNDGIVPLRTSALLYLDYEALGDVSELKKSKHMHVHPELEEADHKIQVNRSRDTVSEVPEEANQMVQDIQDAAKSTDNSQSTESSETMGKNHVISRYKEFLNLNFSEHNSNNHKPKLTKRQRKYKNFSVRGTDYNVFNDVLPEDHSFQSEETNSTQDSQTIVVPPRASAIESAINTLICPIPSNEFLINPESRQHVIFHDKYYQFNKSSQEEGNLNKHSKVEWFASVLLRYHSKWKLEKQKQIADKYHNACGWRKVLVNLPLDAHNNIVVRRRFANGYGWGVVDHLCDLFRVSENKL

SEQ ID NO: 3360 - protein, 95 aa, Prunus salicina
LWPSNYSNPRMPSNCTGSQFKKQNLYPYMQSKLKISWPDVESGNDTKFWEGEWNKHGTCSERTLNLMQYFQRSHAMWKSHNITEILKNASIVPHP

SEQ ID NO: 3361 - protein, 187 aa, Triticum aestivum
  misc_feature (136)..(136): Xaa can be any naturally occurring amino acid
  unsure (1)..(187): unsure at all Xaa locations
MQASRARLFKEYKEVQREKSADPDIQLICDDSNIFKWTAVIKGPSETPFEGGVFQLAFSIPEQYPLLPPQVRFITKIFHPNVHFKTGEICLDILKNAWSPAWTLQSVCRAIIALMAHPEADSPLNCDSDLELKIQXAVTLTSAINMYNNKGIKYPSIDGNLLRSGDIRGYQSMARMYTRLAAMPKKE

SEQ ID NO: 3362 - protein, 478 aa, Sinorhizobium meliloti
MSSKRSVAQETAKVSKSSKIPLALHAARGVKTWTEAVDWLKIRGIEDIECITPDLAGVARGKMMPTSKFTSNTSLALPSAIYRHTISGEYPEETGQFRYDSRDSDIKLVPDLSTLSIVPWESDPTAQVICDIVGSQGEQISYTPRNVLKRVIELYRQKGWKPVVAPEIEFYLVAQNDDPDYPLRPPKGRSGRSILGGQGYSIAGINEFDELIDDIYHFSEKQGLEIDTLIHEEGPAQLEINLRHGDPIELADQVFLFKRTIREAALKHGIYATFMAKPMQGQPGSAMHIHQSVIDIETGRNIFSNPDGSPSQAFFSFIGGMQLYVPRTLSMMAPYVNSYRRLTPDMSAPVNTAWGYDNRTTAFRIPVSDPVARRIENRLPSSDANPYLALAASLGCGYLGIIEGLQATPPTEHTANEGEIELPRGLLEAVSLLESAPALAEVFSAEFIAIYAGVKRGEFETFMQVISPWEREFLLLNV

SEQ ID NO: 3363 - protein, 264 aa, Shewanella sp. MR-7
MSKVTSSTLLKYKQEGRKFTALTAYDASFASAFDGEGIDVLLVGDSLGMVLQGHDDTLPVTTAEIAYHTRCVRRGIERSLLIADMPFMSYATPEQAMENATALMQAGANMVKLEGGHWLLETVTKLTERGIPVCAHLGLTPQSVHVFGGFKVQGRDAENAQRILDEAKALEAAGAQLLVVECIPESLATAITQALTIPVIGIGAGATTDGQILVMHDVLGISSGYIPRFSKNYLKQTGEIRSAVRAYIEEVANGTFPSSEHTFS

SEQ ID NO: 3364 - protein, 353 aa, Leptospira interrogans serovar Lai str. 56601
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDIAIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 3365 - protein, 537 aa, Arabidopsis thaliana
MGKNEKTSLGRALVKHHNHMIQETKEKGKSYKDQHKKVLESVTEVSDIDAIIEQAEEAERLFAIHHDSATPVPINMDTGSSSSGITAKEWKEQRMREEALHASSLQVPRRPHWTPKMNVEKLDANEKQAFLTWRRKLASLEENEKLVLTPFEKNLDIWRQLWRVLERSDLIVMVVDARDPLFYRCPDLEAYAQEIDEHKKTMLLVNKADLLPSYVREKWAEYFSRNNILFVFWSAKAATATLEGKPLKEQWRAPDTTQKTDNPAVKVYGRDDLLDRLKLEALEIVKMRKSRGVSATSTESHCEQVVVGFVGYPNVGKSSTINALVGQKRTGVTSTPGKTKHFQTLIISEDLMLCDCPGLVFPSFSSSRYEMVASGVLPIDRMTEHLEAIKVVAELVPRHAIEDVYNISLPKPKSYEPQSRPPLASELLRTYCLSRGYVASSGLPDETRAARQILKDYIEGKLPHFAMPPEITRDDENETADDTLGAETREGSQTEKKGEEAPSLGLDQVLDDLSSFDLANGLVSSKTKQHKKSHRKQ

SEQ ID NO: 3366 - protein, 451 aa, Neisseria gonorrhoeae
RFVDLRFTDTKGKQHHFTVPARIVLEGPEEWFENGQAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 3367 - protein, 1008 aa, Synechococcus sp. WH 5701
MSVESSSDSAVAGAPREFSPFLQRHLGPSAAEQARMLERLGCADLEGFVAEVVPADILIPASAAEQDLPEGVGEAEALAELRRISSLNQVRRSLIGLGYYGTATPALIQRHVLENPSWYTAYTPYQAEIAQGRLEALLNFQTLISELTALPIANASLLDEATAAAEAMSLSAGACRRSEARRFLVDEQVFPQTLEVLRTRAEPLGILIETFDPATASAASSSAAKAASGDQFFGSDVFGVLLQLPGSRGRLLDPSAVIAAAHQVGAMVTVAIDPLAQVLLAPVGALGADIAIGSSQRFGVPLGFGGPHAAFFATTEAHKRQIPGRLVGRSLDAEGRPALRLALQTREQHIRRDKATSNICTAQVLLAVMAGFYAVHHGPEGLSAIARQVLRLRAALALGLTRLGFQLEPGPSFGTLSVLTAEAAPLLERAEVAGFNLRPLMAPGGPLEGVALSLDERSDAAELDQLLALFAAGAACADVPSTAALLAELADDQELLAGLPLREGPWLRQEAFQRYRSESELLRYIQRLASRDLSLVHGMIPLGSCTMKLNAAAELAPVSWSEFADLHPMAPPSQARGYARLIADLESWLAAITGFAGVSLQPNAGSQGEYAGLLVIRAWHRSRGDGHRDICLIPTSAHGTNPASAVMAGLRVVPVACDAKGNIDLEDLEAKAQTHAASLAGVMVTYPSTHGVFEPGIRRLCDVIHRHRGQVYLDGANLNAQVGLAKPGLYGADVCHLNLHKTFCIPHGGGGPGVGPIGVAAHLVPFLPGQVQGIGAVAAARWGSAGILPISWMYIRMMGGAGLRRASAVALLAANVIAERLEPHYPVLFRGPGGRVAHECILDLRPLKRSAGLEVDDLAKRLMDYGFHAPTVSWPVAGTVMVEPTESESLAEIDRFCEALIAIRAEAAAIEAGQVDPLDNPLKRAPHTLAAVTADDWGRPYSRQQAAFPAGEGQYATKFWPAVARIDNAYGDRNLVCTCPSVEELAAVSLGSVPEGVATAPALAGHGR

SEQ ID NO: 3368 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 3369 - protein, 468 aa, Gluconobacter oxydans 621H
MQNRNAHGRLSGHALTNFIATISATGGLLFGYDTGIISSALLQLRNQFHLDTLGAEIVTSAIILGALIGCLGAGSISDRIGRRRTVMIAAALFLLGTVVVSSAQSVAVLIIARLILGLAIGAASQIVPIYIAEVSPPERRGRLVVGFQLAVVFGITSSFVTGYLLRDSSWRLMFGIGMLPALILFVGMAFLPNSPRWLALNGQIEEARAVLRRVRLSDEAADRELEEIIENHDVQAPWSELAKPWVRPALTASVGIALLCQFTGINAVMYYAPTIFADAGFGQDSALLTSVAVGVGMVFATVFGGWAVDTWGRRTLLLRMLPGAVVALAVLGTTFAMHLTGGIGAWITVAAVMAYTIFNTGSLSVAIWLVGAEVYPLSCRGKGMSLVAGSHWGADLLISLTTLSLVQMLGAGWTFWLFAGVNAFAFWFVLRYVPETKGQSLEELERRLRNGTFAPVDRAVARSEARAR

SEQ ID NO: 3370 - protein, 160 aa, Candida albicans SC5314
MSNYHLIILVHGVWGNSSHLAYVEKQIHENIHSYDGTILYTHKTGSHSGYLTYDGIDVNGKRISDEVWEQTKLIEQEKGGKVTKFSVVGYSLGGLISRYCIGYLSSQGYFDNIEPINFTTFCTPHVGVSVPQSHNFSARLYNRIAPLFLADTGSQFFLRD

SEQ ID NO: 3371 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 3372 - protein, 189 aa, Larix laricina
MASSIMALSSTAAVAAVAAPSKTGNSNVVSAFTGLKSMAQFPSSKTMSNAGAEWEQKTTSNGSRVRCMQVWPPYANKKFETLSYLPRLTPEQLVKEVEYLLKNKWVPCLEFEEDGEIKRVYGNSPGYYDGRYWVMWKLPMFGCTEASQVLNEVNECAKAYPNAFIRVIGFDNVRQVQCISFIVHKPEYN

SEQ ID NO: 3373 - protein, 181 aa, Nicotiana sylvestris
MAFLIMSSAAAVATGTNAAQASMIAPFTGLKSATSFPVSRKQNLDITSIASNGGRVQCMQVWPPINKKKYETLSYLPDLSEEQLLREVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 3374 - protein, 332 aa, Ralstonia solanacearum
MTIKIGINGFGRIGRMVFRAAIANFKDIEVVAINDLLEPDYLAYMLKYDSVHGRFDGEVSVDGNTLVVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKAASYDEICAEMKAQSQGALKGVLGYTEDKVVATDFRGDARTSIFDAEAGIALDGTFIKVVSWYDNEWGYSNKVLEMARVVAK

SEQ ID NO: 3375 - protein, 329 aa, Sulfitobacter sp. EE-36
MTQYEVVGIGNAVVDVISHADDAFLQDNGIEKGIMQLIERDRAENLYATMQDRLQTPGGSVANTIAGIGALGLPTAFIGRVNDDELGQFYAKAMTDIGIDFVNAPVSGGENPTSRCMIFVTPDGERSLNTYLGISTGLTSDDVPQAVASRAKLMFLEGYLFDHDAGKTAFREAARAATAGGGMAGIAISDPFCVERHRDDFLALIENDLGYVIGNEAEIRALWETDDLEDALTRTAAICDTVVCTRSGDGVTLIRKGERVDVPVTKVTPVDATGAGDQFAAGFLYGMATGRDLETCGKMGNICAAEVISHIGPRPQTSMMELFKEKGLV

SEQ ID NO: 3376 - protein, 426 aa, Thiobacillus denitrificans ATCC 25259
MFCLEFTHWEIAVTADKKPRLRTIQKSTKLDNVCYDIRGPVMARARQMEEEGQRIIKLNIGNPAPFGFEAPEEIVQDVILNLPNASGYSDSKGLFAARKAIMHETQRKGIAGVTIDDIIVGNGVSELIVMAMQALLNNGDEVLVPAPDYPLWTAAVSLGGGKPRHYLCDEGAGWLPDLDDIRAKITPSTRAIVIINPNNPTGALYPTELLREILEIARQHQLIVYADEIYDKVLFDGVVHTSIASLADDLLIVTFNGLSKNYRACGYRSGWLVVSGDKRHAKDYLEGLNMLASMRLCSNVPGQHAIQTALGGYQSINDLVAPSGRLTRQRDLAHELLTLIPGVSCVKPKAAMYLFPRLDPKLYPIHDDQKFILNLLEEERVLVVQGTGFNWPRPDHLRVVFLPHEEDLTEAIGRMSRFLDRQRAHR

SEQ ID NO: 3377 - protein, 145 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 3378 - protein, 162 aa, Zea mays
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTMAVFVLVVAKLPNMHKVRIFGINGDI

SEQ ID NO: 3379 - protein, 228 aa, Staphylococcus aureus subsp. aureus COL
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYQILRKIESYADIKVERRVNEDVAFITDNGNYILDCKLPKGIDPYKFHEYLIHLTGVFETGYFLDMADQVIVGTQEGVKILEK

SEQ ID NO: 3380 - protein, 378 aa, Burkholderia xenovorans LB400
MKALVYEGPRKVTVKEMPDAKIERPTDVLVKITTTNICGSDLHMYEGRTNMETGRILGHENLGVVVEVGAGVERIKVGDRVCLPFNIGCGFCKNCERGLTGFCLTTNPGMAGAAYGFAGMGPYSGGQAEYLRVPFGDFNCLVLPPDAEEKENDYVMLSDIFPTGYHATVLAGVEPGDSVVIYGAGPVGLMAALSASIKGASKIMVVDSHPDRLKLAEKIGAIPVDDTDGSSAERILEMTGGEGADRGCECVGYQCSCKGHEVPNLTMNNLIKAVRPTGGIGVVGVFVAEDPKAGDELAKKGQLALDFGQLWMKGQHIATGQANVKAYNRKLRDLIAAGKARPSQIISHELPLDKAPDGYKHFDERDDGWTKVVLKPAA

SEQ ID NO: 3381 - protein, 405 aa, Burkholderia mallei ATCC 23344
MVPHRTRIYVAATVDTKGAEAHFVKDRIADAGLAAVVVDLSTRVPGRAADIGADAVAAHNPDGAAAVFCGDRGRAIAAMAVAFEHYIKSRDDVAALIGIGGSGGTALVTPAMQALPIGMPKLMISTMASGDVSAYIGSSDIAMLYSVADIAGLNRISRQVLANGAHMIAGAVRDMQPPHADLKPALGLTMFGVTTPCIQAVTSRLDARFDCIVFHATGKGGPAMEKLADSGLLDGVLDLTTTEVCDLLMGGVLACGADRFDLIARSRVPYVGSCGALDMVNFGHIDTVPPRYAQRLLYKHNPQVTLMRTTPDENRRIGEWIGAKLNACDGPVRFLIPEGGVSALDAPGQAFWNPQADEALFDALEATVVQTERRRLVRVPAHINDARFADAAVEHFLSLHAAHRN

SEQ ID NO: 3382 - protein, 982 aa, Ralstonia solanacearum
MNAPHPASAALTQTLAARPTLAELEARDAFAERHIGPSPDEQAAMLATLGYASRAALIDAVIPPAIRRQDGMPLGEFTQPLTEEAALAKLRGIAGQNRVVRSLIGQGYYGTHTPGVILRNILENPAWYTAYTPYQPEISQGRLEAMLNFQQMVMDLTAMDIANASMLDEATAAAEAMTLLQRVGKHPSNVFFVADDVLPQTLDVVRTRAEPIGVQVVTGPAADAAKHNAFGVLLQYPGTGGALLGGLSTYQALTDAVHAAGGLVVAAADLLALTLLAAPGEWGADVVIGNTQRFGVPFGFGGPHAGYMAVRDAFKRSMPGRLVGVTVDAQGNPAYRLALQTREQHIRREKATSNICTAQVLLGVMASMYAVYHGPQGLKRIAQRVHRLTATLAAGLRQIGYTLEAGAFFDTLTVATGPRTANLHIAAQAHGFNLRQIDDGRLGVSLDETVTRAEVVALWEIFAHAAHAGAPDFDQVEAGIADAFPASLARQSAYLTHPVFNAHHSEHEMLRYLRSLADKDLALDRTMIPLGSCTMKLNATAEMLPVTWPEFANIHPFAPADQTVGYREMIDQLEQMLCAATGYAAVSLQPNAGSQGEYAGLLIIHAYHASRGESHRDVCLIPSSAHGTNPASAQMAGMKVVVVACDERGNVDLADLEKKAAEHSANLAAIMITYPSTHGVFEEGVKRVCEIVHSHGGQVYVDGANMNAMVGTAAPGHFGGDVSHLNLHKTFCIPHGGGGPGVGPVAVGAHLAPFLPGRAASGEDASQNIGAVSAAPFGSASILPISWMYIAMMGAAGLTAATEAAILSANYVARRLSPYYPVLYTGAHGLVAHECILDIRPLQKESGISNEDIAKRLMDFGFHAPTMSFPVPGTLMIEPTESEPKVELDRFIDAMIAIRGEVDQVISGAFDREDNPLKHAPHTAQVVMADDWSHRYTREQAAYPVASLRTRKYWPPVGRADNVYGDRNLFCACVPMSEYAQD

SEQ ID NO: 3383 - protein, 160 aa, Brassica napus
FQIEEFSNLSVPLPAVLQEYVDHGSKIFKFYVIGDKVFYAVRDSMPNARFLKPSSGGEALTFNSLKTLPVATNEQRPQTGAEDGKLLDADLVEEAAKFLKGLLGLTVFGFDVVVQEGTGDHVIVDLNYLPSFKEVPDSEAVPAFWDAVRQAYESTRGNAN

SEQ ID NO: 3384 - protein, 555 aa, Escherichia coli K12
MNVNSSSNRGEAILAALKTQFPGAVLDEERQTPEQVTITVKINLLPDVVQYLYYQHDGWLPVLFGNDERTLNGHYAVYYALSMEGAEKCWIVVKALVDADSREFPSVTPRVPAAVWGEREIRDMYGLIPVGLPDQRRLVLPDDWPEDMHPLRKDAMDYRLRPEPTTDSETYPFINEGNSDARVIPVGPLHITSDEPGHFRLFVDGEQIVDADYRLFYVHRGMEKLAETRMGYNEVTFLSDRVCGICGFAHSVAYTNSVENALGIEVPQRAHTIRSILLEVERLHSHLLNLGLSCHFVGFDTGFMQFFRVREKSMTMAELLIGSRKTYGLNLIGGVRRDILKEQRLQTLKLVREMRADVSELVEMLLATPNMEQRTQGIGILDRQIARDLRFDHPYADYGNIPKTLFTFTGGDVFSRVMVRVKETFDSLAMLEFALDNMPDTPLLTEGFSYKPHAFALGFVEAPRGEDVHWSMLGDNQKLFRWRCRAATYANWPVLRYMLRGNTVSDAPLIIGSLDPCYSCTDRVTLVDVRKRQSKTVPYKEIERYGIDRNRSPLK

SEQ ID NO: 3385 - protein, 208 aa, Lycopersicon esculentum
NSARAQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYVGASNLSEGASESLHVKDYKY

SEQ ID NO: 3386 - protein, 181 aa, Saccharomyces cerevisiae
MRQLTEEETKVVFEKLAGYIGRNISFLVDNKELPHVFRLQKDRVYYVPDHVAKLATSVARPNLMSLGICLGKFTKTGKFRLHITSLTVLAKHAKYKIWIKPNGEMPFLYGNHVLKAHVGKMSDDIPEHAGVIVFAMNDVPLGFGVSAKSTSESRNMQPTGIVAFRQADIGEYLRDEDTLFT

SEQ ID NO: 3387 - protein, 451 aa, Neisseria gonorrhoeae
RFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 3388 - protein, 417 aa, Zea mays
FVIAVDDENGDNEGDLVMAATLVDQKSVAFMIRNGSGIISVGMEEEDLTRLMIPMMSPITEIEDITAAASTVTVDARVGISTGVSAADRAKTILTLASSDSKPSDLRRPGHIFPLKYRNGGVLKRAGHTEASVDLVALAGLRPVSVLSTVMDPRDGSMAGVTVLQQMAMEHDIPIVSIADLIRYRRKREKLVELIAVSRLPTKWGLFRAYCYQSRLDGTEHIAVVKECLIEGDTSSIWHVAKAIHKLEFAFGVIPNVRAKGVASTKAAELLNSMQLEDPVNMDDMGIPEINTVILLDREVDMVTPMCSQLTYEGLLDEKKVDCCIHLSDSTRSTVDKLLESTPLGDIKVLLVPPRYSCTSSTMPPANVATNGPCTTVLPLAPPPALAPLPSLDFYAGHVAAMLDESFGMSSTSTMMD

SEQ ID NO: 3389 - protein, 490 aa, Xanthomonas campestris pv. campestris str. 8004
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLCGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 3390 - protein, 464 aa, Lycopersicon esculentum
MATCGIDWKSVLPNCFKGNNVRSEAKVMENSKQMNSDHHRLAFSDISTDSRSVLISLDDLSSNAVIGSNLHVFTYEELKLITSDFSSANFLGKGGFGPVHKGFIDDKIKPGLDAQPVAVKLLDLDGNQGHQEWLTEVVFLGQLRHHHLVKLIGYCWEEEQRLLVYEYMARGNLEDQLFSRYSSCLPWLTRIKIMVGAAKGLAFLHGEEKPVIYRDFKASNILLDSDYRAKLSDFGLAKDGPEGDDTHVSTRVMGTHGYAAPEYIMTGHLTSKSDVYSFGVVLLELITGRRAMDKKRPLKERILVDWARPMLRDPHKLDRIMDPRLEGQYSTQGAKKVAALAYQCLSHHPRSRPTMSNIVKILEPVLDMKDIPMGPFVYVVPSSKPDKGTEIGELKTKVNDENKAGVRENEVDNAGENREDGNAKQRRVGHRYKHRLKTDASVYSDTHLYHKTVKHERTNKLNSY

SEQ ID NO: 3391 - protein, 479 aa, Streptomyces coelicolor A3(2)
MPASRVKSPHLLVAESGADREGHGLKRTMGLFQLVCFGVGAIVGTGIFVGLSDSVAEAGPAVVVSFVLAAITCVFTAFAFAELGGAIPVSGSSYSFAYAGLGERTAFLVGWCLLLEYGVSVSAVAVGWSQYVNELLDTVLGVQLPHALSAGPGDGGAVNLPAVVVIALASVLLMRGVRESARATAAMAVLKLAVLLAFCAIGFYAFQDGNLTPFSPAGLGGIGAGTTAAFFSYIGFDAITTAGEEAKNPRRDIPVAILVCIGLVTLLYCAVAVAAIGAVGGDQVGNRPAALSYVVDRVTGSAIGGGVVAFGAVVAIASVVLAVMYGQTRILMSMSRDGLIPRVFEKVSPRTATPVAGTLIVGVVFALPAAFAPLDAVVNLCTIGTLATMAAVNVSVITLRRREPGLARTFRVPLYPATPLLGVGFCLYLMYETGGATWLQFAVFLAVGLLVYSAYGRRHSRLARTAVSADDAERVPQEA

SEQ ID NO: 3392 - protein, 1489 aa, Candida glabrata CBS 138
MSVLIPHQQQRLRASSAAKKAAWNAMNKTVNIVSPHNNVNYVKKPSPKTNSNHLDRVIKSVNDATKRLSEAESINSNNTKSSKRKSRDTVGPWKLGKTLGKGSSGRVRLAKNIENGTLAAIKIVPKRTYNRRMRDQKMKTAGGVSSGTDSKDSSNREDPIKNGTDSALNPYGIEREIVIMKLISHPNVMGLLEVWENKSELYLVLEYVDGGELFDYLVSKGKLSEPEAVHYFTQIIQGVSYCHSFNICHRDLKPENLLLDKKNKVIKIADFGMAALELPNKLLETSCGSPHYASPEIVMGKPYHGGPSDVWSCGIILFALLTGHLPFNDDNIKKLLLKVQAGRFQLPPYLTNDAKDLITRILVTNPEKRLTINEILNHPLIKKYRNPPAHIRKLNLLGRGKSNSDLHVLEYNTPATVCLNSEEDIDQSILKSLQILWHGTPRQRLVERLLVEGATEEKLFYSLLFQYKLKHSKPISATKLQKKIEDVVLENESTKTESKDSSNEPGIDNNNDTSDFTQDGNSSEMVNELHTSAPMLEQKSQFSQHSLKSKETVPISDLPPLPPVIPTFAASSSKAFRRSKSNLSSYLKRPKLENARSRTSLFNSSSNTSITSSSISELNTRPRGNIPLSPSNITLTSLVSSRSLHNSASKKSLKNLQKRTLQNSESKRSLYSQTSISKRSLNLNDYLIGGPSNSAELPPLPKLDSNNEFEMLCDKILNTSALDNILEEEEEDITPSKNTTQTNDVHNEDTIIRKEMHDFEINVNNHQPEFKRQPSDFSVNGPDTSIFSIEPMPEGLGISKKPVRVQPTFNFIIDEDKVDDSIKVKQVSGTGPSNNVLKDISNQINNGKGIENSKLHPTSNNNYKNIRNVTAPEGNFTSKTFSLDPRRNVSQPPKESLFHSLLNNKSSKNAEENTQFESKSKQYNFMNKTAHSEFEKERLNAHRDADRSNDQNVYNETSVLAQSSTIHESPLLSIPSTLLNTSMTFKNLVDMLQENKLDDINETVAKESSAPLRKKSTKLSLAPHSNLVSDLNKRTSGYNTLASVDRSSSDLSYAIDLPTNTNIAEIVYLSGNNKQSSEKNIFMLSNDNNETELFHTDENKTSIKSAVNIFEDPPSDSTSLQTSSSESDSIPKVQRKAVSIETLNASNIITPAADVRVSLYGNNVSNSNTMPRETTEELISRFKLTPEKPQHQVQKRFSSLTQTGRNTDSIALSQSMISMFKDAEENGNNKSVKVLDQVEEENASKLTPTSPKNRVTMLFDDYEAQQNITSDQSNKSSKVIEIPNDSPIKVKVQKASTIFEKEIISAAEADENDHLRIPYESKSKKEIAQVHQQEQKEQQVRKPTESQEKAVQKTTKPSWFSKLIHGFKTTGGSGHTKLIREHSTKMTFEEVHMITVKEFGNNGIDYQLRTLDKKGDREKVEYDCKFVKGNFEFKIKIFNSGFPHQNTIITVKKKGKINSKETTDLFQRFNANIENLIKSAERNIESNPK

SEQ ID NO: 3393 - protein, 250 aa, Zea mays
MYKLGRGNRDKVQQFMTITGASEKVALQALKASDWHLEGAFDFFYSQPQVSVVNTRHLEDIFNRYKEPDADMIMVEGISQFCGDLQVDPQDIVMLVISWHMKAATMCEFTRQEFIGGLQSIGVDSIEKFRGKLPSLRAELKDDNKFRDIYNFAFTWAREKGQKSLSLETAIGMWQLLFAERNWPLLDHWCQFLQVRHNKAISRDTWSQLLEFVKTTDPQLSNYDDEGACPSLINEFVENLTENGLVQRKK

SEQ ID NO: 3394 - protein, 425 aa, Mycobacterium tuberculosis H37Rv
MTRLDSVERAVADIAAGKAVIVIDDEDRENEGDLIFAPEKATPEMVAFMVRYTSGYLCVPLDGAISDRLGLFPMYAVNQDKHGTAYTVTVDARNGIGTGISASDRATTIGLLADPTSVSDDFTPPGHVVPLRAKDGGVLRRPGHTETPVDLSRMAGLQPAGAICEIVSQKDEGSMAHTDELRVFADEHGLALITIADLIEWRRKHEKHIERVAEARIPTRHGEFRAIGYTSIYEDVEHVALVRGEIAGPNADGDDVLVRVHSECLTGDVFGSRRCDCGPQLDAALAMVAREGRGVVLYMRGHEGRGIGLMHKLQAYQLQDAGADTVDANLKLGLPADARDYGIGAQILVDLGVRSMRLLTNNPAKRVGLDGYGLHIIGRVPLPVRANAENIRCLMTKRDKLGHDLAGLDDFHESVHLPGEFGGAL

SEQ ID NO: 3395 - protein, 275 aa, Rubrobacter xylanophilus DSM 9941
MGTPGERAVGEHYGREGLEERISAALRSAGADPLAPSVEELHAVDQLHTRGVRATLELAELAGASPGERVLDVGGGLGGPARILASRFGCRVVVLDVTEEFCRVGALLTARAGLGERVLFRHGSALEIPFPDASFDLAWTQHSTMNIPDKDRLYREIHRVLKPGGRLAMHEILAGPSGPPRRFPLPWAASPALSHLLPPNRMRASLSRAGLRELAWSDVTPQTAEWLKTRSSGRPSGPPPEAFANLLLSIREGRATAVQALLERPEAQLDGNGSR

SEQ ID NO: 3396 - protein, 262 aa, Francisella tularensis subsp. holarctica
MQYKTKAKKSLGQNFLQDENIIRKIVQLANIKKHDIVVEIGPGLGALTRYLLSSSNNVSVVEFDASVIDTLIANCQKYGTPHIYNQDFLKFDISSLENSSNQKIKLIGNLPYNISSPILFKVIKDSDKIVDAHFMLQKEVVERIVSLPNSKSYGRLSVILQYHFDCSMILKIPPEVFYPQPKVDSAILRLKPKNSKELLKNYNFFEEIVKQSFAQRRKTLHNNLKSILKERKIDPSTLPVDTNLRAENLSVGDFVSLANFLS

SEQ ID NO: 3397 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 3398 - protein, 134 aa, Nostoc punctiforme PCC 73102
MTPNENNTQSNINELPPHSGTRYWGEVEVIEEGDTYRISRVEIKPRHGIKPQIHYHRNEHWVVVSGVAKVTCGDAEILLNRNESTYVPAATLHKVENPGHIPLVILEIQNGEYLGEDDTERPYDLNLVKSVTEG

SEQ ID NO: 3399 - protein, 435 aa, Helicobacter hepaticus ATCC 51449
MDILQSINDFNEAKQVIPGGVNSPVRAFGSVGGTPRFIAKGKGAYIYDEDDNEYIDFVQSWGPLIFGHANEVIESALSLAIKDGLSFGAPTEKETTLVKQIIALSGSAEKMRLVNSGTEATMSALRLARAYSNKDDIIKFEGCYHGHSDSLLVSAGSGCATFGTPSSPGVPNDITKHTLVARYNDIESVRACFEQSKNVACVIIEALAGNMGFVPADKKFMQDLRALCDEYNALLIIDEVMSGFRAGLKGAIGLYDVQADLVTYGKVIGGGMPLAAFGGRADIMDMLSPVGGVYQAGTLSGNPIAVSAGLATLLQIKANPTLYEHLEVLAKRLIKGLKEAAQSYEIPLQVDCRGSMFGFFFNQKEVKNFDDAKCSDTAMFARFHQKMLDKGVYFACSQFETGFICSAMNEMIIDEVIMKAKAVFGEITHEIESRI

SEQ ID NO: 3400 - protein, 447 aa, Bacillus cereus G9241
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDVLLQKNIIGGYDLGRDYKEHENHMLVAVTELRTKEEIDTLVNEMGAIQ

SEQ ID NO: 3401 - protein, 322 aa, Sesbania rostrata
MAEKKIPEVLLNSGHKMPVIGMGTSVESRPSNDVLASIFVDAIQVGYRHFDSASVYGTEEAIGMAVSKAIEQGLIKSRDEVFITSKPWNTDAHHDLIVPALKTTLKKLGMEYVDLYLIHWPVRLRHDLENPVIFSKEDLLPFDIEGTWKAMEECYRLGLAKSIGICNYGTKKLTKLLEIATIPPAVNQVEMNPSWQQGNLREFCKQKGIHVSAWSPLGAYKIFWGSGAVMENQILQDIATAKGKTIAQVALRWVYQQGSSAMAKSFNKERMKQNLEIFDFELSEEELEKIKQIPQRRQYTGDMWLSENGSCKTLEELWDGDV

SEQ ID NO: 3402 - protein, 384 aa, Bacillus anthracis str. A2012
  misc_feature (365)..(365): Xaa can be any naturally occurring amino acid
  misc_feature (374)..(374): Xaa can be any naturally occurring amino acid
  unsure (1)..(384): unsure at all Xaa locations
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEXVINYDAAKXQTYILCGLLS

SEQ ID NO: 3403 - protein, 343 aa, Bacillus halodurans C-125
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 3404 - protein, 383 aa, Synechococcus sp. RS9917
MALKPSLTLAISARAQALKEAGRDICSLSAGEPDFDTPEFIVEATLKALRDGITRYGPAAGDPQLRDAIAGKLSNENRVPTDAAQVLVTNGGKQAIYNLFQVLLNPGDQVLIPAPYWLSYPEMARLAGAEPVVVPSSAATGFQLDLEALEAVLTPRSRLLVLNTPSNPTGRVMQRTELEVLAAWLRRHPDLLVMCDEIYEFLLAEDESHHSLAALAPDLAERIFIVNGFAKGWAMTGWRLGYLAGRVEVIKAAAALQSQSTSNVCSFAQRGALAALEGSRSCVSAMAASYTERRQQMIAGLQAIDGLTLVPPRGAFYAFPQLPDDTIESVEFCRLALEEEGLALVPGEPFGDRRCVRLSCAVARETIADGLERLQRLLDRLRS

SEQ ID NO: 3405 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 3406 - protein, 475 aa, Pseudomonas aeruginosa PAO1
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 3407 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 3408 - protein, 378 aa, Schizosaccharomyces pombe 972h-
MSSTALLPPNTDQVLSRRLHGKAAEKKTGLAAIASKDVDEQSRKLQEYFEFWDRNHENESEEDRARRIDGYKSVVNSYYDLATDLYEYGWSQSFHFSRFYKGEAFAQSIARHEHYLAYRMGIKPGSRVLDVGCGVGGPAREITEFTGCNLVGLNNNDYQISRCNNYAVKRNLDKKQVFVKGDFMHMPFEDNTFDYVYAIEATVHAPSLEGVYGEIFRVLKPGGVFGVYEWVMSDDYDSSIPKHREIAYNIEVGDGIPQMVRKCDAVEAIKKVGFNLLEEDDLTDHDNPDLPWYYPLTGDITKCQNIWDVFTVFRTSRLGKLVTRYSVQFLEKIGVAAKGTSKVGDTLAIAQKGLIEGGETHLFTPMFLMIAKKPETDA

SEQ ID NO: 3409 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAAFKADHEFLLRGGVFSKDWIDSYIAFKEEDVRRIRMAPHPLEF

SEQ ID NO: 3410 - protein, 305 aa, Saccharopolyspora erythraea
SVKQKSALQDLVDFAKWHVWTRVRPSSRARLAYALFADDHEATTEGAYINLGYWKPGCAGLEEANQELANQLAEAAGISEGDEVLDVGFGLGAQDFFWLETRKPARIVGVDLTPSHVRIASERAERENVQDRLQFKEGSATDLPFGAETFDRVTSLESALHYEPRTDFFKGAFEVLKPGGVLAIGDIIPLDLREPGSDGPPKLAPQRSGSLSGGIPVENWVPRETYAKQLREAGFVDVEVKSVRDNVMEPWLDYWLRKLQDESFKKSVSRLFYSQVKRSLTSDSGMKGELPALDFVIASARKPGA

SEQ ID NO: 3411 - protein, 320 aa, Oryza sativa
MSGRRDDSAKMAKLKELLHRSENRICADCSAPDPKWASANIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQVFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 3412 - protein, 329 aa, Burkholderia xenovorans LB400
MAKQFGATSTTDDVLSGKRLDGKRILVTGVSAGLGVETARALASHGATVVGAARDLEKAERAITSARQEAVAGGGSIELIELDLASLASVRACSDKLLAEGKPFDIVIANAGVMATPQGKTADGFETQFGTNHLGHFVLVNRLARLLHDGGRVVMLASSGHRFANVDLDDPGFERTPYDPFVAYGRSKTANILFAVAFDQRHRARGVRAAAVHPGGIQTELGRHMGEEQLATMVETINKQLASEGKPPFQFKTVPQGAATSVWTAAVASAEEIGGRYCENCHVSEVVPDDTVITPVSEGVRRYALDLANAEALWRKSEQMVGETFPASA

SEQ ID NO: 3413 - protein, 195 aa, Triticum aestivum
MSGGGRKPVGDDAEVEALLRAAQDAVLLKLQANSHLVSSSFSAASNPLALDEGPGPLDDDLARRLDALRSRPPAPKRPGAAPAPTAGGMDEMEARFAALKGAAVCPEKETRVRLEDLGGESDEEDEVEKVMRWAMDAARLDVATAGSGASNAEEKEEGDKSSTSSEDEEERLELEEKRKEMMSKKNQAKSRWFFF

SEQ ID NO: 3414 - protein, 127 aa, Rubrobacter xylanophilus DSM 9941
MSEEMNSAGQGPPSVKVDKPWGKFEQYTHNLPCTVKIITVAPGGTLSRQYHHKRDELWVVLDPGARVELDDQILHPEPEEKVFIPRQTVHRLSCEGERPVRILEISFGEFDEEDIVRLEDVYGRVGP

SEQ ID NO: 3415 - protein, 286 aa, Oryza sativa
  misc_feature (186)..(186): Xaa can be any naturally occurring amino acid
  unsure (1)..(286): unsure at all Xaa locations
MAAASVLLLLPSPFLRPSSPAHRARCGIATTTTTSTSGRRGLFLFASRCRPGPRRRAASAAVPPEHGLSQPQPQARAVGSYEAALGDAKDALYAALEGMNRGIFGMTSEKRSEIHALVELLESKNPTPEPTDKLQDKVDGCWRLVYSTISILGKKRTKLGLRDFISLGDFFQMIDVKEHHLLYTQXEKAVNVIKFSARALKILSGQLTIEASYKITTKTKVDITLDSSTITPDQLMNIFQKNYDMLLAIFNPEGWLEITYVDESLRIGRDDKANIFVLERADPSEV

SEQ ID NO: 3416 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 3417 - protein, 109 aa, Arabidopsis thaliana
  misc_feature (24)..(24): Xaa can be any naturally occurring amino acid
  unsure (1)..(109): unsure at all Xaa locations
MDPADPTSILFTMIRTLEPDFASXIIGYLLLQDVGNTDLMRLALGPQTLLQSVCLKAKSALGLSSNGSSSASSPLNPISRPINIHRHSLSHSAPGNGFSKNPLSPSFAT

SEQ ID NO: 3418 - protein, 298 aa, Cryptococcus neoformans var. neoformans JEC21
MSATQLPEIMDAILFKHPYKVAVEQVPTPKLQTEGDVIIKVHLAGLCGSDLHLYRAKEDAGKDYTMGHEVVGTIVQKGKEVNSFNVGDIVAVPFTISCGKCYYCSTSHTARCTSSALFGTPSLPGCQATYVRVPLAASCLLLKPPQLPEELMLLMADILPTGYSAAWNAWRLLDRGGERGGKGEKKDICVVVGCGPVGLCAITSAQTLFSKVFAVDPTPARRELAIKHGATALVPGELQSAVMAATEGRGADAVLEVVGNQGAFDTALSIVRPYGAVSSVGVHAGELKIDGGLLYDKK

SEQ ID NO: 3419 - protein, 228 aa, Malus x domestica
MGITGMIYMVTIVFSLIVLLLSSSAARYDYFQFTQQYQLAACNSKPIPCKDPPDKLFTVHGLWPSDSNGHDPVNCSKSTVDAQKLGNLTTQLEIIWPNVYNRTDHISFWDKQWNKHGTCGHPTIMNDIHYFQTVIKMYITQKQNVSKILSRAKIEPEGKPRKQVDIVNAIRKGTNDKEPKLKCQKNNQVTELVEVTLCSNRNLTGFINCPRHIPNGSRYSCPTKNILY

SEQ ID NO: 3420 - protein, 533 aa, Clostridium tetani E88
MDKAKILIVDKIDTKGIELLESEPNFEVDIKMGLEREKLLNIIENYDGLIIRSDTNIDIELMNMAKKLKVVGRAGNGVDNIDIPEATKRGIIVANTPDSNTISACELTIGLLLAQSRNIAKTDRFLKEGNWDRDSFMGTELFNKTLGIIGLGRIGSLVATRMNAFDMKVIAYDPYISDERFKRFNVEKKDTLEDLLKESDFITIHTPRTEETINIISEKELELMKDGVRIVNAARGKLISEKALCKGLKKGKIASVGIDVHEHEPRYSADLYEYENVVVTPHIGATTIEAQQNVGVTIAKQVINGIKGDIVPNAVNLPTIHRDELKEIKPYIDLAEKLGKIYYQLNKGAIKLVDITYWGDIGCQDTEMVTIAFIKGLLEPVMADKINYINAMIKAEEGGIGVNSKKICNHHNNYSNLITIKITNNTGDTSFTLSGTISNRNEGKLVEIMEYEVDVKPTECMVFLQNYDVPGVIGHVGTFLGTNGVNVATMQVGRKLKGDKALMLLNVDDKVTQDTLLGLQKHDDILWAKFVQL

SEQ ID NO: 3421 - protein, 566 aa, Burkholderia vietnamiensis G4
MTKAARSATAEQRAGAGKRKRAPARADTTPRAAAAAGDAVVQHHEIQNKAMPGASTGTLPGTAAAGLADSGSRSVSPSASTLIQMRSFMQRATKIVATIGPASSSPEILLQMMQAGLDVVRLNFSHGTADDHRQRAEMVREAARKVGREIAIMADLQGPKIRVGKFENGKTTLAPGQAFILDAGCELGNDERVGLDYKELPRDLKPGDLLLLNDGLIVLTVERVLGEEIHTIVKVGGELSNNKGINRQGGGLSAPALTAKDMEDIRTAMSLGADLVAVSFPKNATDMEMARQLANIAGAPYGIKPKMIAKIERAEAIPALQSILDASDGIMVARGDLAVEVGNAAVPALQKRMIRMARESNKLVITATQMMESMIHAPVPTRAEVSDVANAVLDGTDAVMLSAETAAGKYPVVTIETMAAVCVEAEKSEHVELDKDFLDRTFTRIDQSIAMGALFTAYHLGAKAIVALTESGATALWMSRHYTHVPIFALTPRVGSERTMALYRNVTPLHVDFNSDRDAALQAALEMIVKQGYVQHGDMVVLTVGEPMGQAGGTNTLKIVRVGEHY

SEQ ID NO: 3422 - protein, 423 aa, Cryptococcus neoformans var. neoformans JEC21
MSVDTPTSEKLDQAASVFDKDPTTAERLYKEILQDDSQPGNEDLLRDKEVALIKLGTLYRDSSMLDKLSQLITDSRTFMSHIAKAKTTKLVRTLLDLFPQDSKDMQMKVIQENIDWARTEKRVFLRQSLEIKLINVLLDAEKYQEALTITQTLLKELKKFDDKIILTEVYLLESRAAHHMHNHALAKTALTSARTTANSVYCPPTLQAQLDLQSGVIMAEDKDYKTAYSYFFEAFEGFCQSAERDNRALSALKYMLLCKIMIGSPNDVFSLLSLKSAAPYIGKDVDAMKAIATALEERSLDLFKTALQNYSDQLQKDEIIRSHLSYLYDTLLEQNLIRVIEPYSAVELSWIASEVGQSLQVIEDKLSQMILDQKFCGILNERMGTLEVHDDYSNEGICSMALGTLKHISDVVNGLNDKAAQMV

SEQ ID NO: 3423 - protein, 346 aa, Zea mays
  misc_feature (182)..(182): Xaa can be any naturally occurring amino acid
  misc_feature (198)..(198): Xaa can be any naturally occurring amino acid
  unsure (1)..(346): unsure at all Xaa locations
MSKSGALDLASGLGGKIDKEQVKSAVDEYEKYHGYYGGKEESRKSNYTDMVNKYYDLATSFYEYGWGESFHFAHRWNGESLRESIKRHEHFLALQLELKPGMKVLDVGCGIGGPLREIARFSSTSVTGLNNNDYQITRGKALNRSVGLGATCDFVKADFMKMPFSDNTFDAVYAIEATCHAXPDPVGCYKEIYRVLKXPGQCFAVYEWCITDHYDPNNATHKRIKDEIELGNGLPDIRSTRQCLQAVKDAGFEVVWDKDLAEDSPLPWYLPLDPSRFSLSSFRLTSVGRMITRTMVKALEYVGLAPQGSERVSNFLEKAAEGLVEGGKKEIFTPMYFFLVRKPLLE

SEQ ID NO: 3424 - protein, 390 aa, Helicobacter pylori 26695
MLYSSKIQSLSESATIAISTLAKELKSQGKDILSFSAGEPDFDTPQAIKDAAIKALNDGFTKYTPVAGIPELLKAIAFKLKKENNLDYEPNEILVSNGAKQSLFNAIQALIEEGDEVIIPVPFWVTYPELVKYSGGVSQFIQTDEKSHFKITPKQLKDALSPKTKMLILTTPSNPTGMLYSKAELEVLGEVLKDTKVWVLSDEIYEKLVYKGEFVSCAAVSEEMKKRTITISGLSKSVAMTGWRMGYAASKDKKLVKLMNNLQSQCTSNINSITQMASIVALEGLVDKEIETMRQAFERRCDLAHAKINAIGGLNALKPDGAFYLFIHIGSLCGGDSMRFCHELLEKEGVALVPGKAFGLEGYVRLSFACSEEQIEKGIERIARFVKSKG

SEQ ID NO: 3425 - protein, 258 aa, Streptomyces avermitilis MA-4680
MTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 3426 - protein, 389 aa, Coxiella burnetii RSA 493
MFEHDIVFSIFLIFAGAAVLSTFALMTRQSMLVAYMLLGILLGPWGLKLIANIDMLRTVSDVGIVFLLFLLGLNLPPQKLITMFTKIKWVALISSIVFAATGYGVAYFFNYPVVECLVIGGAMMFSSTIIGIKLLPTTILHHQHTGEVMISVLLLQDLIAIAVLFLLHGAGRQGKILVDIALVLLGFPAILIFAYLFDRFVLFPLFSKFNRIKEYLFLLAIAWCLSMAQLAASLGLSGEVGAFIAGVSLASRPVSVYISESLKPVRDFFLVLFFFSVGATFDLQFLPGVIIPALILLVLLMAIKPVIYRLLLRWVGESKQVSWEVGIRLAQISEFSLIIAYMALSNHLIANKAASLIETITILSFIVSSYWVVMKYPTPLAISDRLRRD

SEQ ID NO: 3427 - protein, 141 aa, Vibrio vulnificus CMCP6
MALERTFSIIKPDAVERNLIGEIYHRIEKAGLRIIAAKMVHLNDEQASGFYAEHEGKEFFPALKEFMTSGPIMVQVLEGENAIARYRELMGKTNPEEAACGTIRADYALSMRHNSVHGSDSPASAAREIAFFFPESEICPR

SEQ ID NO: 3428 - protein, 69 aa, Triticum aestivum
MIWVDRLGFDLHVHSEEGIFAVRIPFSRQVSDQKAVKSSFNMMAHHAWEVDKSYATPEFEKVQFLKKVT

SEQ ID NO: 3429 - protein, 451 aa, Neisseria gonorrhoeae
RFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 3430 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKVDHEFLLRGGVFSKDWIDSYIAFKEEDVRRIRMAPHPLEF

SEQ ID NO: 3431 - protein, 157 aa, Zea mays
MANLYVKAAPPPDMNRNTEWFMYPGVWTTYILILFFGWLVVLSLSGCSPGMAWTVVNLAHFVVTYHSFHWMKGTPFADDQGVYNGLTWWEQMDNGQQLTRNRKFLTVVPVVLYLIASHTTDYRHPWLFLNTLAVMVLVVAKFPNMHKVRIFGINGDK

SEQ ID NO: 3432 - protein, 339 aa, Brassica napus
IFWCCFCWHHAYLQSTLCYREACIYRGRVKAQVSTEAPVKVAKESKKQEEGIVVNKFKPKDPYTGRCLLNTRITGDDAPGETWHIVFTTEGEVPYREGQSIGIIPEGIDKNGKPHKLRLYSIASSAIGDFGDSKTVSLCVKRLVYTNESGEIVKGVCSNFLCDLKPGDEAKITGPVGKEMLMPKDPNATIIMLGTGTGIAPFRSFLWKMFFEEHEDYKFNGLAWLFLGVPTSSSLLYKEEFEKMKEKNPENFRLDFAVSREQTNDKGEKMYIQTRMAEYAEELWELLKKDNTFVYMCGLKGMEKGIDEIMVSLAAKDGIDWLEYKKQLKKSEQWNVEVY

SEQ ID NO: 3433 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVLFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 3434 - protein, 267 aa, Bacillus cereus E33L
MLTKHRILFIGAGRMAEAIFSGLLKTSKEYIEEIIISNRSNVEKLDQLRARYNVSTTTDWKQHVTSVDTIVLAMPPSAHEELLAELSPLLSNQLVVTVAAGIGPSYLEERLPEGTPVAWIMPNTAAEIGKSISLYTMGQFVNETDQETLQLLLGGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 3435 - protein, 194 aa, Triticum aestivum
  misc_feature (25)..(25): Xaa can be any naturally occurring amino acid
  misc_feature (45)..(45): Xaa can be any naturally occurring amino acid
  misc_feature (71)..(71): Xaa can be any naturally occurring amino acid
  misc_feature (75)..(75): Xaa can be any naturally occurring amino acid
  misc_feature (132)..(132): Xaa can be any naturally occurring amino acid
  misc_feature (160)..(160): Xaa can be any naturally occurring amino acid
  unsure (1)..(194): unsure at all Xaa locations
HVPSPQQVSLDLRSEILHALQKDYXLAYRYVFHAFEAFFLCDHSXPIFSLISCSVCNRTLYHADDAHETIXDDAXRPYTGPDGDATTAVMDAYSTRSLQYFEIALLNYYDLLCEDPIVHSCLSSLYHTLMQXHALHVIRGYSTLETEHVAQMIAVPAYHXVQDIVSPESLDKNYAGLLELYAVCLFSGAAMIRR

SEQ ID NO: 3436 - protein, 277 aa, Bacillus cereus E33L
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDIFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSADDTKAIQALNEDRRVGPDPDNFNF

SEQ ID NO: 3437 - protein, 274 aa, Haloarcula marismortui ATCC 43049
MDDIQIQGTSVPALGLGTWQLTGQSCRETVETALGMGYRHIDTAQAYGNERQVGLGMDAAAVDREDVFLTTKLDGSNRDERSVRRSTRESLNKLGTDYLDLLLIHWPNTPWMASLSETLGAMNDVVEEGLVRHIGVSNFSPSLLDRARDISSAPIFTDQVQYHPYWDQRKLLDYCRIHDVLLTAYSPLARGGVLDDPALVQIGNKYGKSPAQVALRWLVQQDGVAAIPKASSREHLEANLAVFDFELTDAEMERIRDPSKVKTGVQFVRSQLPF

SEQ ID NO: 3438 - protein, 546 aa, Mycobacterium tuberculosis H37Rv
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTMDVVPNHTSSAHPWFQAALADLPGSPARDRYFFRDGRGPDGSLPPNNWESVFGGPAWTRVREPDGNPGQWYLHLFDTEQPDLNWDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 3439 - protein, 338 aa, Aspergillus oryzae
MALSNTKPKVLLLGKIIHAHTTWQSLSDIAELVEPTATNRAEFIQECKDGKLDGVVAAYRTFDSVSITGLVDEEVVNALPSSLKYLAHCGAGYDQVDVHACSARSPPIRVSNVPTAVDDATADVNMFLIIGALRNFNTGMLALREGKWRGQPLPALGHDPEGKVLGILGMGGIGRNLKKKADAFGMKVIYHNRRQLTEELAGGADYVTFDELLAKSDVISLNLPLNKNTRHIIGKPEFDKMKDGVVIVNTARGAVIDEAALVDALDSGKVYSAGLDVFEEEPKIHPGLVRNPNVMLVPHMGTWTVETQTAMEEWAMENVRLSIETGKLKSPVPEQVDL

SEQ ID NO: 3440 - protein, 401 aa, Lactobacillus plantarum WCFS1
MYMELSRKVMQVQPSATLKISATAKQMMADGVDVINLGIGEPDFQTPDNIKQAAIDSIQNGQASFYTPATGLPALKQAISQRIEADHHYHFDPNQIVVTDGAKMALFTLFQVILNPDDEVLLPVPYWVSYSEQVKLAGGVPVEVSTDEQLRFTTADLEAQRTPKTKALVLNSPQNPSGLVFSRAELTAIVNWAVEHDVLVIADEIYEKLLYNGNEFTSVLELDDANMDHVVLINGVSKAYSMTGWRIGYAAGPQTIMAKMGVVLGHAASNPAAVSQYAAIEAFSGDQSSVETMRQGFEARLNELYPLIERLPGFKMPAGKPAGAFYLFPDITEALRLTGYADAPAFVTAVLLEAHVGLVPGEAFGMPGCLRLSYATDIDSLREAHRRLQKFMTEKIAEQAK

SEQ ID NO: 3441 - protein, 725 aa, Oryza sativa
MASAILLSIAIMAQLSSISAQPAPGCQSHCGDMEIPYPFGIGTECAIEPGFVIYCNKTADGSMKPFLINVEVLNISLLHGQTRALNALSTYCYNDVTKSMESSRWSLDFSTWPYRFSNLHNKFVVIGCNTLSYIYNGEYTTACASVCAKAPTNDSCDGVGCCQNNIAKGLNSYNVTFFTVYNDSSNLQSNPCSYAALVETDTFRFKTEYVTTMKFNETYNGQQPVVLDWAIGKVGCKEANMTSYACRSKHSECVDSINGPGYLCNCTLGYHGNPYITDGCIDVNECEQNQSPCPKGATCRNTEGWYHCSCPVGRKLAKETNTCNPDISLIIGVSIGSIVLVIIIFFVRIIFERRKLTDVKKKYIQEHGGLLLFEKMKSDQGLAFKVFTQAELEQATNKFEKSQILGHGGHGTVYKGITKDNITVAIKKCALIDDRHKKEFGKEMLILSQINHKNIVKLLGCCLEVDVPMLVYEFIPNGTLFDLIHGKNRTLHIPFSSLLRIVNEAAEGLAFLHSYANPPILHGDVKTSNILLDENYMAKVSDFGASILAPNDEAQFVTMVQGTCGYLDPEYLQTCQLTEKSDVYSFGVVILEILTGQMPLKLEGSELQKSLSSSFLLAMKENNLEAMLDSQIKGHESMELLSGLAELAKQCLDMCSENRPSMKDVAEEISRLRKLSKHPWIQRDSETEGYLSGPSTSNFEIEQSTEYTRKDEQMPINPSTSYFIR

SEQ ID NO: 3442 - protein, 361 aa, Rhodococcus sp. RHA1
MPQQVRGVIARSKGAPVEIATVNIPDPGPGEVVVDIAACGVCHTDLTYRDGGINDEFPFLLGHEASGIVESVGEGVTSVAVGDFVVLNWRAVCGQCRACKRGRPQYCFDTHNAAQKMTLEDGTELTPALGIGAFADKTLVHAGQCTKVDPSADPAVVGLLGCGVMAGLGAAVNTGNVSRGDTVAVIGCGGVGDAAIMGARLAGAVKIIAIDRDDKKLEWAKDLGATHTINGGQVDAVSAVQELTGGFGADVVIDAVGRPETWKQAFYARDLAGTVVLVGVPTPDMTLEMPLIDFFSRGGSLKSSWYGDCLPERDFPVLVDLYQQGRLPLDKFVTERIKIDEVEAAFHSMHAGEVLRSVVVL

SEQ ID NO: 3443 - protein, 445 aa, Brassica napus
MKGVQNIYHHSYTFSFLLVFLVLILFHPALSIYVNTLSSSESLTISSNRTLVSPGGVFELGFFKTLERSRWYLGIWYKKVPWKTYAWVANRDNPLSNSIGTLKISGNNLVLLGQSNNTVWSTNITRGNVRSPVIAELLPNGNFVMRHSNNKDSSGFLWQSFDFPTDTLLPDMKLGYDLKTGRNRFLTSWKSSDDPSSGNFAYKLDLRRGLPEFILINTFLNQSVETQRSGPWNGMEFSGIPEVQGLNYMVYNYTENSEEIAYSFHMTNQSIYSRLTISELTLDRFTWIPPSWGWSLFWTLPMDVCDPLYLCGSYSYCDLITSPNCNCIRGFVPKNPQQWDLRDGTQGCVRTTQMSCSGDGFLRLNNMNLPDTKTATVDRTIDLKKCEERCLSDCNCTSFAIADVRNGGLGCVFWTGELVAIRKYAVGGQDLYVRLNAADLGTCTG

SEQ ID NO: 3444 - protein, 487 aa, Arabidopsis thaliana
MVKQQDWSVTTCVLLFLFLASQIHCRSGIHVSKRLEGSKQGDGKSGDTSFNVLRRVLSPKEKDLIKKLPGQPSGVSFRQYGGYVPVNEPSSRFLYYYFVEAIKPNTSTPLVIWFNGGPACSSLGGAFLELGPFRVHSGGRKLFRNPYSWNNEANVLFLESPVTTGFSYSSNPIDLEELGEKGDKATAEDNYIFLMNWLERFPEYKGRDIYIAGQSYAGHYVPQLAQIIIHRNKKTLVNLRGILIGNPSLLTSIQDPYGYEFMLSHGLMSQQQMDNYNQFCLRDDLYDNDKCALSVKTIDDAKKHLDTYNIYAPVCLNSTLSRISKKCTTVLEVDPCSKDYLKAYLNRKKVQKAIHANTTKLPYEWTSCNNELTENWSENDRDTPMIPILHELMGEGVRVMIYNGDVDLEIPFASTLAVVKEMNLTVVKEFRPWFTGGQLGGFTEDYKGNLTFVTVKGAGHSVPTDQPIHALNIFTSFIRNTPLPHTA

SEQ ID NO: 3445 - protein, 1031 aa, Oryza sativa (japonica cultivar-group)
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 3446 - protein, 589 aa, Saccharomyces cerevisiae
MTISSAHPETEPKWWKEATIYQIYPASFKDSNNDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQPSDPFTMNGPRIHEFHQEMNKFIRNRVKDGREIMTVGEMQHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 3447 - protein, 416 aa, Azoarcus sp. EbN1
MNAPVEHAIAKQHLIDPEICIRCNTCEETCPIDAITHDNLNYVVNFDICNGCLACVPPCPTGAIDSWRNVERAKPYSLEEQFKWDVLPDTTELDNVDAPFAVARPDDELPAEVQHITEVATAGQGGPALAPWSASHPYVNLYAPTRPITATVTGNYRLTDADASSDIHHVVLDFGSTPFPVLEGQSIGIIPPGTDDKGRPHLLRMYSVASPRNGERPHYNNLALTVKRVTEDHEGKAARGVASNYVCDLKKGDKVQVTGPYGSTYLMPNHPASSIMMICTGTGSAPMRAMTERRRRRIAQNEGGELVLFFGARAPSELPYFGPLQKLPKDFIDINFAFSRVPGEPKKYVQDSIRERADKVFRMLNDDNCYIYICGLKGMESGVLEAFRDICRANGADWEALQPKLLANARFHVETY

SEQ ID NO: 3448 - protein, 559 aa, Bacillus halodurans C-125
MYQEWWRKAVVYQIYPKSFNDTTGNGVGDLEGIIQKLDYLKTLGVDVIWLTPIYASPQKDNGYDISDYYSIHPEYGTMEDFERLLTEVHDRKMKVIMDIVVNHTSTEHEWFKQSAQSKDNPYRDFYIWKDPVYGLEPNNWQSKFGGSAWKFDSKTDQYYLHLFDVSQADLNWENEEVRNRVYEMMDFWFTKGVDGFRLDVINLISKDQAFPNDDGSVPPGDGRRFYTDGPRAHEFMNEMNRKVFSKYDAMTVGEMSSTTLEHCIQYTRPENKELSMTFNFHHLKVDYPNGEKWAIGDMDFFALKEILSKWQVGMHKGGGWNALFWCNHDQPRVVSRYGNDGKYHEKSAKMLATTIHMMQGTPYIYQGEEFGMTDPKFDRIDQYRDVETLNYYDILKEQGLSEEEVMEIIKRKSRDNSRTPVQWDDSPHAGFTSGTPWIDVASNYRSINAKKALADKQSIFYHYKKLIELRKTYDIVTYGDYELLLPEDPRVFAYVRRYQDETLLVVNHFFAGEVTIQVPEDVTAEKHQVDVLLANYHDPSREFQQLVLRPYESVVYYMK

SEQ ID NO: 3449 - protein, 549 aa, Saccharomyces cerevisiae
MRRSPSRSNNNFAVPNCSTNSNSSQQQLTTPSDDLNSNEPNDPDDSRSLPTIKKFNNKHSINNYNTLASAGKNNNNKRASNDNLLIPGENAHKQKIYTKDENLKSLYLDIDVSVAKALSSSATAPKLINTARTSSTTTATTSNNILTSPSYRESNYSSPSSYSFSSYYSSATSASSSTSSFLKSSGLSSRVKSPSSSVKAGSFGAPSSPTSGIPNPKSSKKPIFLRRYSHDTSSNEGLDIDVAIEKLLQVGESREITKTSKKKNFPFHSWEIQLICYHAREIFLNQPTLLRLQAPIKVVGDVHGQFNDLLRILKLSGVPSDTNYLFLGDYVDRGKNSLETILLLLCYKIKYKDNFFMLRGNHESANVTKMYGFYDECKRRLSSKVWKMFVDVFNTLPLAAIIQDKIFCVHGGISPDLHDMKQIEKVARPTDIPESGLVTDLLWSDPDPQVTDWSENDRGVSYTFSKRNVLDFCAKFKFDLILRGHMVVEDGYEFFARKKFVTIFSAPNYCGEFHNWGAVMSVTTGMMCSFELLKPRALKNKKKLYKTKV

SEQ ID NO: 3450 - protein, 281 aa, Clostridium perfringens SM101
MAINWFPGHMVKTKREIQNNLKLVDAVIEIRDARIPKSSKNPDIDTLCAGKPRVILLNKSDLTDPKVTKAWKDSLTNDETIVLEVNALKGEGLNAIKPALLKLLKEKHDRLKAKGLAKITTRAMVVGIPNVGKSTFINKMAKNNIAKTGDRPGVTKNKQWIKTKLGIELMDTPGVLWPKFEDEIVGLNLAFTGAIKDEIMDTEELALKLVERLQETNPEELMTRYKLTELHENPLDNLDAIARKRGAIMAGNQIDYNRIAGIILDEFRGGKIGKISLEKPE

SEQ ID NO: 3451 - protein, 327 aa, Candida glabrata CBS 138
MTWDPSELPYYNPQVDDRVAVVTGGNSGIGWFTVLHLYMHGFRVYVCGRNSHKVSRAMDDIIEEAVRRHNLYLKGLHDQKPTRYLGSLQYLHTDLTDLKCVDRAAAKILRMENHLDVLVNNAGVMAVPYEITKDGFEIQMQTNYIAHFLLTMRLLPLLRCSHGRVVTLSSLGHHIIFKYSKLDETWNYFPNFVFTWFRYAMTKVASIQYTKMLAIKNPDILFVSVHPGLVMNTNLFSFWTRLPLVGIFFWLLFQVVGFMFGVSNEQGAYSTLRCSLSQELTTTNDNGKYFTTGGKESRSSYVANNLDDAASTWIWTMKQLRNRGFDI

SEQ ID NO: 3452 - protein, 337 aa, Phaeosphaeria avenaria f. sp. triticae
MVVKVGINGFGRIGRIVFRNAIEHNDVEIVAVNDPFIEPHYAAYMLKYDSQHGQFKGDIKVDGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAIKAAADGPLNGILGYTEDEIVSTDLNGDTRSSIFDAKAGISLNKNFVKLVSWYDNEWGYSRRVLDLLVYIAKVDGNA

SEQ ID NO: 3453 - protein, 166 aa, Triticum aestivum
  misc_feature (62)..(62): Xaa can be any naturally occurring amino acid
  misc_feature (70)..(70): Xaa can be any naturally occurring amino acid
  misc_feature (73)..(73): Xaa can be any naturally occurring amino acid
  misc_feature (91)..(91): Xaa can be any naturally occurring amino acid
  misc_feature (108)..(108): Xaa can be any naturally occurring amino acid
  misc_feature (115)..(115): Xaa can be any naturally occurring amino acid
  misc_feature (124)..(124): Xaa can be any naturally occurring amino acid
  misc_feature (129)..(129): Xaa can be any naturally occurring amino acid
  misc_feature (132)..(132): Xaa can be any naturally occurring amino acid
  unsure (1)..(166): unsure at all Xaa locations
MAPTVMASSATSVAPFQGLKSTAGLPVSRRSNGASLGSVSNGGRIRCMQVWPIEGIKKFETXSYLPPLNXGGXLSKQVDYLIAPSWVPCLXFNKVGFIFREHNASPGXYYDGRYXTMLKLPKFXCTDAXKMXNKVEESKKDTLTLCPIGSQGQVQARLKHAARIRG

SEQ ID NO: 3454 - protein, 250 aa, Treponema denticola ATCC 35405
MKKFYIAANWKMNMNRAEAKQLATEMKAGLKDGKNKYMIAPSFTLLQDVASVLKGSNILLGAQNMGLEEKGAHTGEVSVLQLLDVGVQAVILGHSERRHIYKETDDLINKKVKLALKHGLEVILCVGELLEEREAGHAEAVCERQIKKGLAEVSAKDLDKVTIAYEPVWAIGTGKNASPEDADAIHSSIRKTLAALYGEKAAKNMIIQYGGSMKPENAAGLLKKHNIDGGLIGGAGLKTETFLPIALFSE

SEQ ID NO: 3455 - protein, 442 aa, Arabidopsis thaliana
MSGNNELNALKGPQSSLPWPFGMASASFAPSHMAPPNFQPQFQLSQDQGISAPGRRFPHKPPIGGPPAVPPSMELTPASRKKKHKLPDKSSLQERVAAVLPESALYTQLLEFESRVDAALFRKKVDIQDSLKNPPSIQKTLRIYVFNTFSNQIPGPDPPTWTLRIFGRVLDPDHTGGLVQNSNPLYPKFSSFFKTLKISLDQSLYPENHLIEWKRDRSPAPLEGFEIKRIGCQEFAATILLEMNYVPEKFKTSPALMQVLGIEVDTRPRIIAAIWHYVKVRKLQNPNDPSFFNCDAALHSVFGEEKMKFTMLSHKISQHLSPPPPIQLVHKIKLSGNNPAISACYDVLVDIPAPVQTELSNLLANPEKNKEIEACDEAICGAIRKIHEHRRRRAFFLGFSQSPVEFTNALMESQTKDLKLVAGEASRNAEKEGRSEFFNQPW

SEQ ID NO: 3456 - protein, 373 aa, Haloarcula marismortui ATCC 43049
MTAFSRRVEQVSISGIREVFEAAGEDAINLGLGQPDFPTPEHAREAAVEAIQAGKVDAYTSNKGTEELREAIAAKHERDNDLEVDPGDIIATSGGSEALHIALEAHVDAGQEVIFPDPGFVSYDALTHLAGGTPRPVPLREDLTMAPETVEEAITDDTAAFVVNSPANPTGAVQSPEDMREFARIADEHDVLCISDEVYEHQVFEGEHRSPAEFSETGNVVIVNACSKAYSMTGWRLGWVTGATDRIERMLRVHQYAQACASAPAQYAAEAALTGPQEPVAEMREAFKERRDVLLDGLNEMGLDCPTPKGAFYAMPKVPDGWVDEVIDRGVVVVPGDAFGEHGAGYARISYATDMETLEEAIDIMADATAALR

SEQ ID NO: 3457 - protein, 252 aa, Arabidopsis thaliana
SSTISLQSISMTTLNNLSYSKQFHRSSLLGFSKSFQNFGISSNGPGSSSPTSFTPKKKLTPTRALSQNLGNTENPRPSKVQELSVYEINDLDRHSPKILKNAFSFRFGLGDLVPFTNKLYTGDLKKRVGITAGLCVVIEHVPEKNGDRFEATYSFYFGDYGHLSVQGPYLTYEDSFLAITGGAGIFEGAYGQVKLQQLVYPTKLFYTFYLKGLANDLPLELIGTPVPPSKDVEPAPEAKALKPSGVVSNFTN

SEQ ID NO: 3458 - protein, 358 aa, Arabidopsis thaliana
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 3459 - protein, 100 aa, Arabidopsis thaliana
  misc_feature (62)..(62): Xaa can be any naturally occurring amino acid
  unsure (1)..(100): unsure at all Xaa locations
EKQHEEGKDQSMFSTTDVVTYPAQATMVTPFTGSKRYGYLPVTRKVNNHITCITSNIGRVKXIESWTPIKKNKVETLYNLPDLNDGELAKEECFVTGNKW

SEQ ID NO: 3460 - protein, 389 aa, Pyrococcus furiosus DSM 3638
MALSDKLDLVNPSEIRKLFDLAAGMKDVISLGIGEPDFDTPAHIKEYAKEGLDKGLTHYGPNVGLPELREAIAEKLKKQNGIEADPNSEIMVLVGANQAFLMSLATFLKDGEEVLIPSPMFVSYAPAVILAGGKPVEVPTYEDNEFRINVDDLKKHVSEKTRALIINSPNNPTGAVLTKKDLEEIADFANEHDLMIISDEVYEHFIYDGAKHYSIAALDGMFGRTITVNGFSKTFAMTGWRLGFVVAPSWVIEKMVKFQMYNATCPVTFIQYAAAKALRDERSWKAVEEMRKEYERRRNLVWKRLNEMGLPTVEPKGAFYIFPRIKDTGLSSKEFSELMLMEAKVAVVPGSAFGRAGEGYIRISYATAYEKLEEAMNRMEKVLKEKKLI

SEQ ID NO: 3461 - protein, 658 aa, Thellungiella halophila
MSKCLENFLRQAFEDNSLAGAIGLGGSGGTSLISSAFRSLPIGIPKVIVSTVASGQTEPYVGTSDLVLIPSVVDVSGINSVSRAVFSNAGASFAGMVLGRLEMLRSSPFENAKCTVGITMFGVTTPCVNAIQESLTRQGYETLVFHATGVGGRAMESLVEQGFIQGVMDITTTEVADHVVGGVMACDSSRFDVIIEKGIPLVLSVGALDMVNFGSKDTIPSHFQTRKIHVHNEQVSLIRTTVEENKKFAKFIADKLNESTSKVRVCLPEKGVSALDAPGKPFCDPEASGALINELQRLIQASEDRQVNIYSHHINDPEFAEALVASFLEICPKTYAQSKPSETASTKPSTGEPKDGHVSKMRSRPERIPYSPKDFPNAKPDTVERTQTILGRLRDQIEKGIPIIGGGAGTGISAKFEEAGGIDLIVIYNSGRFRMAGRGSLAGLLPFADANAVVLEMANEVLPVVKAVPVLAGVCATDPFRRMDYFLKQLESIGFVGVQNFPTVGLFDGNFRQNLEETGMGYGLEVEMISKAHKMGLLTTPYAFNPKEGEEMAKAGADIIVAHMGLTTSGTIGAQTAVSMEESVVRVQAIADAARRFNPDIIVLCHGGPISGPEEAEFVLKRTKGCVHGFYGASSMERLPVELAITSTVKRYKSIAIK

SEQ ID NO: 3462 - protein, 651 aa, Magnetococcus sp. MC-1
MYEQVSHSLLNEIMLELDPEILKQNQMRYFYTRLGANFYAIHSIAKVLYGNRNDFNEQMKRLVETMARQYIARPAQYRESDLEREKDHTWFLHQQWVGMALYSDGFANDLQGLNTKLSYLQELGINMIHIMPLLDCPPNKSDGGYAIRDFRKIDSRAGTLEDITTLADSMHTRGMLLTLDVVLNHTSDEHEWARRAREGDSDYQNYFYVFKDRSMPDLFEESMVEIFPQTAPGNFTWSEEMGRWVMTSFNSYQWDLNYSNPSVLIEILDIILYWANLGADIMRLDAVAFLWKKIGSTCQNQREAHLILQLLKDCCQVTAPGVLFIAEAIVSPLEITKYFGEDAINAKECEIAYNATLMALLWDAIATKKAELLYRGIKSLPDKLERATWLNYIRCHDDIGLGFDDTDIRQAGYEPFAHRRFLVDYFTGGYTDSPARGRPFGQNDKTGDARISGTLASLAGLESALYEGNEEAVHTSIQMILLLHSVILSFGGIPLLYYGDELGTLNDYSYEQQESKREDSRWIHRPTIDWDKAELRNQPGSVEYRLFNALKKMIAVRKEIPAFADFNNREMLDLGNPHLLAYARFDFMHASAKVLVICNFDLKPQYVELEQLRQLGFLKSHNLRDASTGESPQRFNDQLAIPAYGFYWLME

SEQ ID NO: 3463 - protein, 997 aa, Arabidopsis thaliana
  misc_feature (167)..(167): Xaa can be any naturally occurring amino acid
  misc_feature (170)..(170): Xaa can be any naturally occurring amino acid
  misc_feature (206)..(206): Xaa can be any naturally occurring amino acid
  misc_feature (217)..(217): Xaa can be any naturally occurring amino acid
  misc_feature (235)..(235): Xaa can be any naturally occurring amino acid
  misc_feature (354)..(354): Xaa can be any naturally occurring amino acid
  misc_feature (360)..(360): Xaa can be any naturally occurring amino acid
  misc_feature (375)..(375): Xaa can be any naturally occurring amino acid
  misc_feature (391)..(391): Xaa can be any naturally occurring amino acid
  unsure (1)..(997): unsure at all Xaa locations
MKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLSXIRXKNASKNKRLGKIPPSYGSWPVIEYNNLRYGTTELVXGWIMTKVTSLXSLWLAFVLSVSRTLHPKXRFDGANCGLTGEISPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGYRYKXNSVFSXNVISDEIWLLIYFNXPLSTVCALVRFSRVFXSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGHTSPRLPLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 3464 - protein, 225 aa, Malus transitoria
MSRMVYVVTMVFLLIVLILSSSTVGYDYFQFTQQYQLAVCNSNRTLCKDPPDKLFTVHGLWPSSMVGPDPSKCPIKNIRKREKLLEPQLEIIWPNVFDRTKNNLFWDKEWMKHGSCGYPTIDNENHYFETVIKMYITKKQNVSEILSKAKIEPDGKKRTLLDIENAIRNGADNKKPKLKCQKKGRMTELVEVTLCSDKSGEHFIDCPHPFEPISPHFCPTNNIKY

SEQ ID NO: 3465 - protein, 417 aa, Gluconobacter oxydans 621H
MKPSLKAAIEAIRAGGMVVMVDDENRENEGDLVMAAQFATPEAINFMVREARGLVCLPLEAEQVDRLGLPPMVTRNRDPRGTAFTVSIEAATGVTTGISAADRARTIVVAANPDATPDDVVSPGHIFPLRAHPEGVLGRNGHTEGSIDIARLAGLEPAGVICEIMADDGSMMRLPELRKYAAKHNMPVVSIADLQDWCREHGRGPVAGHDLICTPVPAAGEMVAESALPSIFGGHDLRIHAFRAVDGVEHVALVKGDPSKGVPLVRLHSECVTGDALGSLRCDCGAQLREALERISASESGVLVYLRGHEGRGIGLANKIRAYELQDHGMDTVEANEALGLPADAREWDAAADLLRHLGVSSLRLLTNNPDKESNLVRFGFDVKSSERLEIEANPFNRAYLATKRTRMGHFLQEQPA

SEQ ID NO: 3466 - protein, 513 aa, Rubrobacter xylanophilus DSM 9941
MELQVRFPLGASGPLGCASEIAARHPSYRVEGGGDGARVSVRLELPGDWRLLDDFSTLLRGEEVSYAADGTPVPGEELLRGLRCFLRKQRSGKTAREWCTPASLGDRQLFPCRQIRVYDNDHLTPNSWYAFGSVGGDGAFRVDKEALTERVLEDLGPCVRCPLLDLEAVAETVAALPDRIDPAREAGWRYREGGGGWKVTKAGAAGPSPEEAAAEESRREGLLERLARSVRGGGVPVVGGPVGSRNVPDTGYGDVGGMDETIALVREAVELPITHPEIFQRLGIRPHKGILFHGPPGTGKTLLARAVARESGAHFIAVSGPEILNKYWGQSEARLRGIFAEARAKAPSIILFDEIDSFASARDAMSESFEATLVSQLLSLMDGLNSLGRVCVIATTNRPEALDPALRRPGRFDHEIEIGLPDAGARLHILQIHTRRMPTDPDLDLEQIARLTGGYSGADLEALCREAALACMRRTLNLRDFERRITPRQLAALSVTTYDFRTAMKRVGASIRR

SEQ ID NO: 3467 - protein, 365 aa, Burkholderia vietnamiensis G4
MSTPAPHTAPSMKAAVWHGRNDIRVEEVPVPGHPPAGWVQIRVHWCGICGSDLHEYVAGPVFIPVDAPHPLTGLKGQCILGHEFSGEIAALGAGVTGFALGERVTADACQHCGTCWYCRHGMYNICENLAFTGLMNNGAFAEYVNVPAELLYKLPDNFPTEAGALIEPLAVGMYAVKKAGNIVGQTVVVVGAGTIGLCTIMCAKAAGAGRVIALEMSAARKQKALEVGATVVIDPKASDAIAEVKALTGGYGADVSFECIGHTATAKLAIDVIRKAGKSVMVGIFEEPTSFNFFDIVSTEKEVIGSLAYNGEFADVIRFIADGRIDVQPLITGRIALGDIVARGFEELVNHKDRNVKIIVQPVAA

SEQ ID NO: 3468 - protein, 551 aa, Myxococcus xanthus DK 1622
MDLDPLWYKKALIYELHLRAFHDSNGDGHGDIPGLIEKLPYLQDLGINCLWLLPHYPSPLRDDGYDIADFYGVHPDYGTLADFQRLVDEAHKRDIRVITELVVNHTSDQHPWFQEARSDPNSPKRNWYVWSDTDEQYKGARIIFLDTERSNWTWDPVAKQYFWHRFFSHQPDLNYDNPEVQEAMLDVMRFWLNMGVDGFRCDAVPYLFEREGTNCENLPETHAFLKRLRKTIDSEYKGKMLLAEANQWPADVRVYFGDGDEFHMGFHFPVMPRLYMAVRREDRTPIVEIMQQTPDIPDNCQWAIFLRNHDELTLEMVTDEDRDYMYREYATDPRMRINLGIRRRLAPLMDNGRRRIELMHSLLFTLPGTPVLYYGDEIGMGDNIYLGDRNGVRTPMQWTGDRNAGFSRADYARLYAPVIADPVYGYQSINVEAQERVKSSLLHWVKRMIRIRQRYPVFSLGNLRFLQTDNRKVLAFIREWEGQTVLVVCNLSRFAQPAVLDMREWEGAVPVELIGETPFPRVSELPYQLSMGPFMFLWFRLDRPQQVRSLE

SEQ ID NO: 3469 - protein, 252 aa, Prunus caroliniana
AHYKSEADVGNAIAEAIRSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETYPYFQRESLVKFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 3470 - protein, 181 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEVQAKVGFIFREHNAVSRGTYDGPLLAQWWERLPYGWEWPPNAHIGWNQTGGGDGRFHERDVSPLNMRYVSREIYSAHVPIQTLGESNGRVH

SEQ ID NO: 3471 - protein, 931 aa, Ashbya gossypii ATCC 10895
MTSIPHRHTYYGGGATPPAATGPLSGSRGHAAGRSKKKQVTFGPYIIGPTLGEGEFGKVKLGWSKARLDGDSRNVAIKLIRRDTVPKNSEKEIKIYRELNALKLLSHPNIVRLEEVLQNSKYIGIVLQYASGGEFYKYIQKKRRLKEPPACRLFAQLISGVHYIHYKGLAHRDLKLENLLLDEHENLIITDFGFVNEFHKNDLMRTSCGSPCYAAPELVVSSKPYSAQKADVWSCGVILYAMLAGYLPWDDDPENPEGEDIAKLYQYITHTSLKFPEYIKPIPRDLLKRILVSNPEVRLTVADIEQHAWLQPHAQFLMWSPSDWDAKAKAETNNLFRQPSAVHAGVLRPQSSCSISSANSKGDNRGSLIMDSTLNPQPVPPQEFQSHIIMKPTSPSNGLRKMSPVRRHARSNSAASIALQAVVDAERDYFNSPSIHSLHHDSLSQNTTPPSSAGRVPTYAITRSATHHNGISSSLMNRNSVIIEVSPQKGSVPPVMIPGNRESLNGQESGGIAMADMSQRPTIVKDKTSSHMVPQAGRKQRPTSYQPCSTTAFAQSPDLVSGAGALVPIMGKQQRVSTASNPTFVDVGRSGSTRRLPGPNNQLLETPFEADRQIDDNPVVDDATIKSDDMLPSTLEIVAYDNECGTSPGSNGQHRRYSAIVMSEIYEQEEGERISCELSSPNKMGSARPDCSTARISINTPNMGLQNRECIVSSSSPESDASSKQKSGKTDKKDKRFSLLSFYSFYNNSKSSIDSSTDAVQPTGLVLDVVKHPNISRTSSQKKNPAPAGNGTQAIPRRHNTLPREAQRTPVALSYVYASLDVTPNAGTPELADVPSPINLVKMAEQPHGTKQHDPSTPTRSATVHGKSQRLSNNTPKGPIYEDPKPKRKTNKVSLMVSSINPSQAPQPPRQKEPSTARKVLDFFKRRSLRI

SEQ ID NO: 3472 - protein, 255 aa, Leuconostoc mesenteroides subsp. mesenteroides ATCC 8293
MNYGFIGAGNMATAMIKGLIYAGIDSKNIYVSSPHSAAKLAANLHIQAADSETIAKKCDIVIIAFLPNQLRTLGNSLNLDGKIVISVLAQVTIADLDEVFPTAFNVRSLPNINSAIGKGSTALAFSKRLNEGQIEVVQNYWHLLGTTSVLDEQHFAIFSAIAGSGPAFVLKFIDALTQAGINNGLDGESAAAIAASTVAGTTETLQKSNSDAVTLMNNVASPGGSTRAGLDNFEQNDFDTIVNSAINATVNHKHT

SEQ ID NO: 3473 - protein, 250 aa, Desulfovibrio vulgaris subsp. vulgaris str. Hildenborough
MARLILLRHGQSAWNLENRFTGWTDVDLSPAGEAEALAAARLIRDEGLDFSVCHTSMLTRAIRTLHLVQQELDRLWTPVRKHWRLNERHYGALQGLDKRETAARHGEDQVFVWRRSYDVPPPVIAPDDPKHPVHDPRYADVPPDVLPCGESLEATVARVLPYWYDAIAPDLMAGRDVLVAAHGNSLRALVMHLDGLDREDVSRLDIPTGLPRLYELDAALRPVSYRYLGDPAEAEERARAVAAQGRLEKN

SEQ ID NO: 3474 - protein, 229 aa, Pyrococcus furiosus DSM 3638
MNVEEMKKAVARAALEFIEDDMVVGLGTGSTTAYFIRYLGEMIEKGKVEDIYGVPPPIKQKFLRMESGVPVLSLDQVDAIDIAVDGADEVDPNLNLIKGRGAALTMEKIIEYRAGTFIVLVDESKLVDYLCQKMPVPIEVIPAAWKAILEELSIFNAKAELRMGVKKDGPVVTENGNFIIDAKFPRIDDPLDMEIELNTIPGVVENGIFADIADIVLVGTKEGVKRLER

SEQ ID NO: 3475 - protein, 251 aa, Saccharophagus degradans 2-40
MGVKSKIVIGNWKMNGSAELVESFTRTMLDNQAAYAGIRVVLCPPFTLLQAMADALEGGPILLGAQNVSEFEQGAHTGEISAPMLASMGTKMVIIGHSERRASRGENDRIIAAKVKQALSVGMLPVLCVGETAEEKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 3476 - protein, 302 aa, Methanococcus maripaludis S2
MDKIGKITAVGHIALDYIFNVDKFPELNTSMQIPTAKKYYGGAACNVAAEIANLGVKSEILSCVGTDFKASGYGEYLEKLGVSTKNVYVSEEEETPKAWIFTDPQNNQITYFLWGAAKHYPEIEVPEFDSEIVHLATGDPNYNLKCAQKASSKGIFVSFDPGQDLTLYSKENMENIIENVDFLFMNNHEFQRTLDLLNISEKELISRVKVLIVTYGKQGSIIYSEDEAIKVPAILTQAKDPTGAGDSYRAGFLTAYLKGHDLKNCGLAGSCVASFVVEQVGCQTNLPSWEMVIERLNENNLL

SEQ ID NO: 3477 - protein, 518 aa, Magnetococcus sp. MC-1
MQTHRPKPMTLVILDGWGLRDTQENNAIANASTPHMDDWLANRPHAQVRTSGRDVGLPDGQMGNSEVGHLNLGAGRVVYQEFTRVSCAIEDGSFMHNQVLLDAIRAANEAGGAVHLYGLLSPGGVHSHQDQILAAVQCAKQNGASEIYIHALLDGRDTPPQSAMEYMTRFEEGLQKLGAGRVATVCGRYFTMDRDKRWERVERGYRLMALGEGTPFDSACEAIQAAYDAQQTDEFVEPAVMVEQGQPIGMINDGDTLICMNFRADRVREISHVFTDTTFEPFVRDGLPKLSAYVCLTQYDVSLQNVQIAYPPVALTNILGQVMAQHGLTQLRAAETEKYAHVTYFFNGGQEQPGEGEDRLLVASPKVATYDMQPAMSAAELTDRVIEKIQSTPYDLVVVNYANPDMVGHTGVYEAAVQAIETVDTQLGRLTDAIVQMGGEVLITADHGNADQMVDEQGTAHTAHTLNPAPLIYLGRDAQLHDGRLSDVAPTLLALMGLPQPLEMDGVSLVQFTQPAVA

SEQ ID NO: 3478 - protein, 334 aa, Haemophilus influenzae R2846
MKTLSEFIVERQAEYPNAKGELSGILSSIRLLAKIIHRDINKAGLTNILGQSGVENVQGESQMKLDLFAHNTMKAALMAREEVAGFASEEEESFIAFDTERGRNAKYIILTDPLDGSSNIDVNVSVGTIFSIYRRVSPIGTPVTLEDFLQPGNKQVAAGYIVYGSSTMLVYTTGNGVNGFTYDPSIGTFCLSHENMQMPKTGRIYSINEGQYLKFPQGVKKYIKYCQEEDKATNRPYASRYIGSLVADFHRNLLKGGIYIYPSATNYPNGKLRLLYEGNPIAFLAEQACGVATDGYRRILDIQPTELHQRVPLFVGSEDMVKKAQEMMEEFKEE

SEQ ID NO: 3479 - protein, 156 aa, Zea mays
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 3480 - protein, 531 aa, Oryza sativa
  misc_feature (123)..(123): Xaa can be any naturally occurring amino acid
  unsure (1)..(531): unsure at all Xaa locations
MDRVLLSSQLSSQTVVNTRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGXDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 3481 - protein, 221 aa, Alkalilimnicola ehrlichei MLHE-1
MMSADQGKRMAAEAAMEYVEENTVIGVGTGSTVNFFIDALADMKARIDGTVSSSEASTARLRQYGIPVLDLNEVGTMPIYVDGADESNRFLQLIKGGGGALTREKIVAAAAERFVCVADESKLVDVLGEFPLPVEVIPMARSYVARELVKLGGRPQLRSGFTTDNGNVILDVRGLKIMEPIKLEQQINNIPGVVTNGLFALRPADVLLLGTAEGVRKLTAE

SEQ ID NO: 3482 - protein, 174 aa, Zea mays
  misc_feature (89)..(89): Xaa can be any naturally occurring amino acid
  unsure (1)..(174): unsure at all Xaa locations
PTAPTYHIITYEPRVLSQSPQSDSTFFMIKPDGVQRGLIGEIISRFEKKGFYLKALKLVNVDRSFAEMHYDDLSSKAFFQGLVDYIISXGPVQLMGRVEGNERRYTCCPLRSLWPSCTLSSEPVSIRVDFDVDIVRNDIHGTDIIASDIKDIALRVPDGPVDWHSSHHPCIYDN

SEQ ID NO: 3483 - protein, 343 aa, Mycobacterium sp. MCS
MRAAIYHGREDVRIEELPDPSPRAGEVVIEVARAGICGTDLHEYIAGPMHAAPGVVIGHEYSGTVVGVGSGVREFTEGDRVCGVGVFGCGECGFCKQGAEALCGAVGFIGFAVNGALARYASLPTKALFRIPDEISLAEAAVVEPIASAYHAVRRSGLAAGGTVFIAGAGPIGLALVQFSLAKGATQVIVNEVSATRRVAAHRVGATRVIDPLAEDAVEVVRTLTNGNGVDISFDAAGVQPALDAALGVLRPRGRLMVVAIWEAPAGIDINRSVMREADIGFSFCYEAQRQVPAILDLLATGAINLGELITDEIPLDAVVSQGLEELRVNRDAHVKILIDPSA

SEQ ID NO: 3484 - protein, 152 aa, Medicago truncatula
MDASTKTTKKGAGGRKGGGPRKKSVTRSIRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPILLPKKTERANTGGKEPKTTKAGKSPKKA

SEQ ID NO: 3485 - protein, 454 aa, Haemophilus influenzae R2846
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGKMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVVDALKVVRS

SEQ ID NO: 3486 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNPGTGICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 3487 - protein, 991 aa, Lycopersicon pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 3488 - protein, 221 aa, Escherichia coli
DLLDADYMAYMLKYDFTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 3489 - protein, 422 aa, Clostridium tetani E88
MNNLEIFKESEKYMPGGVNSPVRAFSNASINPPIIKKGLGSRIVDEEGKEYIDFVASWGPMILGHNDPEVVEAIQNTVEDAISFGAPTELELKLAKHMVETLDNIDMVRMVNSGTEATMSAIKLARGYTRRDRIIKFAGCYHGHFDGFLVEAGSGVLTERIPGSPGVPKGSIENTLIAEYNHIDTVEALFEKYPEEIAAIIIEPIAGNMGTIPAKTEFLQRLREICTKYGALLIFDEVMTGFRVAYKGAQSRYGVKPDLTTYAKIMGGGLPSGAYGGRRDIMEKLSPIGPVYQAGTMSGNPVVMAAGYTTLRKLYNNPSYYEHMEKIGAELQKGIEIVAKEKGLPVVVNRCGAMLTPFFSKRDKVADYEDAKSSDTELYGRFFEHMIKSGIYIAPSQFEAMFIGVKHDIYEVERFLEAMRKF

SEQ ID NO: 3490 - protein, 261 aa, Escherichia coli O157:H7
MKTLATIGDNCVDIYPQLNKAFSGGNAVNVAVYCTRYGIKPGCITWVGDDDYGTKLKQDLASMGVDISHVHTKHGVTAQTQVELHDNDRVFGDYTEGVMADFALSEEDYAWLAQYDIVHAAIWGHAEDAFPQLHAAGKLTAFDVSDKWDSPLWQTLVPHLDFAFASAPQEDEALRLKMKAIVARGAGVVIVTLGENGSIAWDGVQFWRQAPEQVTVIDTMGAGDSFIAGFLCGWSAGMTLPQAMAQGTACAAQTIQYHGAW

SEQ ID NO: 3491 - protein, 492 aa, Pinus pinaster
MMSASFKCPVSLSGVENICNGDKAIPGINSRTLFTGSSFLQRHHSANKIFFRTCGKKGSCCLFNIRAMAETDSGNGVPQLDISLSPRVAALKPSKTMAITDLATALKQAGVPVIGLAAGEPDFNTPDAVAEAGIKAIQDGYTRYTPNAGTMEIRTAICHKLKEENGLSYTPDQILVSNGAKQCIMAAAVLAVCSPGDEVIIPAPFWVSYTEMARLADATPVIIPTLLSDDFLLNPEVFSSKLNENSRLLILCSPSNPTGSVYPRELLEEIAKIVAKHPKLLVLSDEIYEHIMYPPAKHTSFASLPGMWERTLTVNGFSKAFAMTGWRLGYLAGPKHFVTACGRIQSQSTSGASSISQKAGVAALALGYAGSEAVSTMVKAYRERRDFLVQRLQAMEGVKLPVPQGAFYLFPDFSSYYGTEVEDFGVINGSEALCRFFLEKAQVALVPGDAFGNDDCIRISYAASLDTLRTAINNIEKSLLLLRPAAAASKAS

SEQ ID NO: 3492 - protein, 470 aa, Helicobacter pylori 26695
MKIKNILLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDLQAYENAIKKAIDLAQKGFLVTFGVSIDKPNTEFGYIESPNGLDVKRFIEKPSLDKAIEFQKSGGFYFNSGMFVFQAGVFLDELKKHAPTILKGCERAFESLENAYFFEKKIARLSEKSMQDLEDMSIDIALMQQSHKIKMVELNAKWSDLGNFNALFEEAANEPKENVSLNQTPVFAKESENNLVFSHKVSALLGVENLAVIDTKDALLIAHKDKAKDLKALVNEVETNNQELLQTHTKVYRPWGSYEVLHESGCYKVKILEVKPNARLSLQKHFHRSEHWVVISGMASVELDHQLFELQANESTYIPKNTLHRLANYGKIPLIIIEVQVGEYVGEDDIVRIDDDFNRQNQNA

SEQ ID NO: 3493 - protein, 277 aa, Cryptococcus neoformans var. neoformans JEC21
MSPPSVTLTVPPHSPARSRSVSQPIPEDAALDTLSPPRLKSSRSATLRSLSSNSVARGPVPFSQNHAHSNSPSPQFRANKGRARSSSLVTVTEVGGDDPDNVVDRLGAGNNENAAWVNAPGAWLIHPVLIFCGKLLIDAIPGMTQDVSWTIVNLSYITFSFIMFHHVTGLPFESTMTTSGAYDDLTLWEQIDSGAQYTPAKKWLTSVPIGLFLISTHYTRYDYVLFALNFAALIFVLFPKLPVLHRLRFHFAVNSDVPQTPVQSRPPSPTRRTAGGR

SEQ ID NO: 3494 - protein, 237 aa, Leuconostoc mesenteroides subsp. mesenteroides ATCC 8293
MAKLVLIRHGQSEWNALNLFNGWIDTKLSEKGIAQAKEAGDLLAAEGIQFDQAYTSVLTRAIQTLHLALEEAGQLFIPEAKSWRLNERHYGALQGQNKAEAAEKWGDEQVHIWRRSYDVLPPLLDSYDETMTVQGNTYPAFDRRYADVPEGELPLGENLKITLERVLPFWESDISKDLKAGKNVVIAAHGNSLRALVKHLENISDDDILNVEIANGQPLVYDLADDLSVVSKKTLTK

SEQ ID NO: 3495 - protein, 308 aa, Synechococcus sp. WH 5701
MTWTTASIPDQSGRIALITGANSGLGLESARALASHGATVVLACRSRRRGEEARAELLPAAVAGLEVLELDLADLASVRAGARWMQEQYGRLDLLLNNAGVMGPPRQLTRDGFELQFGTNHLGHFALTTALLPLMEGRADARVVTVTSGAQYFGKLAFDDLQSERRYDRWAAYSQSKLANVTFALELQQRLAAAGSTVSSLAAHPGLARTNLQPASVASSGSRFESLAYRLMDPLFQSAAMGALPQLYAATAPEARGGEHYGPDQWGGMRGGPTQVRIAPAALDPQIRQRLWEVSEQLVGQAAPAEAA

SEQ ID NO: 3496 - protein, 478 aa, Rickettsia akari str. Hartford
MKFMNLLKNITGKNYINGEFVEFGKQISIINPSTLKEIATVPNLELSEINSAINNTVQTFASWSQSSFEERIAILRKWYNLVIENIDELSHILTLEQGKVLSESKKEILYGASFIDWYTYVIHNIHGTIKPGSSKAHKIVTQYEPVGPSAAITPWNFPNAMITRKVIPAIAAGCSVILKPSSLTPLSALILTKFASDAGLPAGVFNVITGDSDIIGQSFCEDFRLRKLSFTGSTNVGKILYQNAANTLKRLSLELGGNAPFIITADNKLEKVARDLVVAKTRNSGQSCTSPNRIFIEESIYEKFIEILKAKFTQLKAGDGFDKESDVGPLISSAAIEKIQKLLTDAQSKEAQLICGGKAVDNFIEPTIIIDCLDNMDIFRTEIFGPVVACYKFKDLDEVIERANNTEYGLQGYVYSNNISTAQMIATRLDFGMVSINNPLPGNAKAPFAGRKASGFGVVGSFEGIFEYLNTKYINLQN

SEQ ID NO: 3497 - protein, 80 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (49)..(49): Xaa can be any naturally occurring amino acid
  misc_feature (51)..(52): Xaa can be any naturally occurring amino acid
  misc_feature (59)..(59): Xaa can be any naturally occurring amino acid
  misc_feature (61)..(61): Xaa can be any naturally occurring amino acid
  misc_feature (64)..(64): Xaa can be any naturally occurring amino acid
  unsure (1)..(80): unsure at all Xaa locations
MAYSMLSSAXXXTSPXQXTMDAPFTGXLKPSSAFPVTRKVNNDITSIAXSXXGRVSCMXVXPPXGKNKFETLSYLPDLTE

SEQ ID NO: 3498 - protein, 385 aa, Crocosphaera watsonii WH 8501
MILLTAFSEESQQSLSQEIVSVVLKGGIFLLFIAFLTRYILPKLLHALAYSTELLLIFAISWAITLAAMGDSLGFSKEVGAFVAGVSLASTSYRATIGARLVSLRDFLLLFFFIDLGIHVNVSYLGAEIISAVVLSLFVLVGKTVMIMALMSIMGYGKHTSTVTNLSLSQISEFSLIIAALGLDLGHIDENVLGLITLVGLITMGVSTYMIMGSHIIYEKLLPIVSHFDKLIPHRHQKLGNLDEVDVYGVDIILFGLGRYGGSLIRALQGSDLQVLGVDFNPELVRQWRNKGLLAFYGDAEDPEFAATLPLNQAKWVISTLPGERIGLTLLHTLEYQKYQGKIALTSHTEREMEILKNAGSDLVLLPFRDAAYEAARVLVTDFNE

SEQ ID NO: 3499 - protein, 181 aa, Apium graveolens var. dulce
GNSIAYKNVIGARRASWRIISSIEQKEESRGNDAHVATIREYRSKIENELSSICDGILKLLDSKLIGAASNGDSKVFYLKMKGDYYRYLAEFKIAAERKEAAENTLNAYKAAQDIANAELAPTHPIRLGLALNFSVFYYEILSSPDRACNLAKQAFDEAIAELDTLGEESYKDSTLIKSLV

SEQ ID NO: 3500 - protein, 445 aa, Escherichia coli O157:H7
MGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 3501 - protein, 398 aa, Mycobacterium tuberculosis CDC1551
MGPQHPSTHGVLRLILEIEGETVVEARCGIGYLHTGIEKNLEYRYWTQGVTFVTRMDYLSPFFNETAYCLGVEKLLGITDEIPERVNVIRVLMMELNRISSHLVALATGGMELGAMTPMFVGFRAREIVLTLFEKITGLRMNSAYIRPGGVAQDLPPNAATEIAEALKQLRQPLREMGELLNENAIWKARTQGVGYLDLTGCMALGITGPILRSTGLPHDLRKSEPYCGYQHYEFDVITDDSCDAYGRYMIRVKEMWESMKIVEQCLDKLRPGPTMISDRKLAWPADLQVGPDGLGNSPKHIAKIMGSSMEALIHHFKLVTEGIRVPAGQVYVAVESPRGELGVHMVSDGGTRPYRVHYRDPSFTNLQSVAAMCEGGMVADLIAAVASIDPVMGGVDR

SEQ ID NO: 3502 - protein, 97 aa, Medicago truncatula
MAWRGQLSKNIKELRLLMCQSSPASSSARAFVEKNYKELKTLNPKLPILIRECSGVEPQLWARYDLGVEKGIKLEGMTEPQILKALEDLVKAGQSKA

SEQ ID NO: 3503 - protein, 143 aa, Clostridium perfringens SM101
MRLEKSLVLIKPDAVERNLIGKILEVYEGAGLKIKAMEMKQINKDFAEKHYEEHRDKQFFNSLIKYITRSPLVALILEGEDAIDKIRSLNGATNPEKAEFGTIRRRFALSGTENSVHASDSIESAEKEIKLWFPKVFYEEICG

SEQ ID NO: 3504 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIEGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 3505 - protein, 270 aa, Helicobacter hepaticus ATCC 51449
MQTLTLNNGVKMPILGLGTYSLTGKAGQKAMSEAIEVGYRLFDSAQMYNNEAELGAAINAAVKGGIKREEFFIQTKLLESSSEDLAKKSIEKSLKTLGLDYIDSLLIHMPYSQSKAMYRAMESFYKQGILRVIGISNFGAKAYSEFVKSCEVIPAINQCETHLLLQQKPLREAMKSKKTLLQSWSPFIAGKGSILENPTLKSIAQKYNKTPAQVVLRFLIEQGISVIPKTSKRARMQENLNVFDFSLSAQDTQILKELDTNKSAFSWTNY

SEQ ID NO: 3506 - protein, 306 aa, Saccharopolyspora erythraea
MSVKQKSALQDLVDFAKWHVWTRVRPSSRARLAYALFADDHEATTEGAYINLGYWKPGCAGLEEANQELANQLAEAAGISEGDEVLDVGFGLGAQDFFWLETRKPARIVGVDLTPSHVRIASERAERENVQDRLQFKEGSATDLPFGAETFDRVTSLESALHYEPRTDFFKGAFEVLKPGGVLAIGDIIPLDLREPGSDGPPKLAPQRSGSLSGGIPVENWVPRETYAKQLREAGFVDVEVKSVRDNVMEPWLDYWLRKLQDESFKKSVSRLFYSQVKRSLTSDSGMKGELPALDFVIASARKPGA

SEQ ID NO: 3507 - protein, 315 aa, Haemophilus influenzae R2846
MKIVFLDSTAIPKHILIPRPSFEHTWTEYDHTSSAETIERARDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKNLINVETLSKMKKGAFLINTGRGPLIDELALVDALKTGHLGGAALDVMVKEPPEKDNPLILAAKTMPNLIITPHIAWASDSAVTTLVGKVMQNIEEFVQQLNQK

SEQ ID NO: 3508 - protein, 510 aa, Arabidopsis thaliana
MAYVGLVEVFIALLVFFFFHFLIHKKSHQITPRNWPVLGMLPGVLVMLHRINDYVAEILEVSNLTFAFKGPWFSGMNMLITADPSNIQHVFSSNFSNYDKGPEFKEMFDFLGNGIFTADSKLWEDMRKSALVVLSHQGFQSFSLRTITCKIKNGLVPVLDHFAEANTVFDLQDVFQRLAFDVTLTLVTGCDSSSLSIEMPKNEYAKAMDDAEEVVVYRHVKPVVLWKLQNWIGLGEEKKMKEANAAFDRSCAKYISAKREEIISHHSNIGGEAHAEDLLSVYMNLDISKYELLNPNDDNFLKDIIKSFMLAGRDAIATTLTWFFWLLSKNPEAVTKIRQEINTNLPGSGMSLDADKLNKMVYLHGALCESLRLYAPIPFERKTPIKQDVLPSGHMVDKNWKILFSVYALGRMRSVWGQDASEFKPERWISERNGGLKHEPSFKFFVFNSGPRNCLGKNLSFLQMKTVAVEIIRNYDIKVVEGHKIEPASSIILHMKHGLKVTVSKRGLVS

SEQ ID NO: 3509 - protein, 272 aa, Desulfotalea psychrophila LSv54
MTTENIGFIGGGQMAEALIKGLTQSGSYPAENIYVLDPSPERKDFLTATYNINTIEDCGAAFATCQKIFLAVKPQVMSLVLQNCQGIINEDHLLITIAAGLPISSYVKTLALPRLKIIRVMPNTPALVGQSASALTASPYVSQEELDKVQNIFNQIGTTTVLEECHLDAVTGLSGSGPAYVFSFIEALIDAGVAEGLNRQVSTNLALQTVAGSVELLRQNGEHPAVERARVSSPGGTTIAASKILERSGFQAIIMDAVAAATEKSKELGKGK

SEQ ID NO: 3510 - protein, 66 aa, Escherichia coli
PEYRQGVVTDNGNVILDVHGMEILDPIAMENAINAIPGVVTVGLFANRGADVALIGTPDGVKTIVK

SEQ ID NO: 3511 - protein, 464 aa, Magnetospirillum magnetotacticum MS-1
MSGPIPVILSGGAGTRLWPLSRELMPKQLLKLTGERTLLQETALRLGAPPVVVCNFEHRFIVAEQLREEGIEPRAVVIEPVGRNTAPAAAVAALMLAESDPDALMLLMPSDHLIADTGAFRRAVDIAVPLARQGCMVTFGITPTGPNTGYGYIKRGAALDGGFMVERFVEKPDLATAESYVASGKYTWNSGIFLLPVGLFLAELDRFAPGIKTGSAEALAKGQRDLFFFRLDETTFAAIEGRSIDYAVMEPSDKVAVVPVDMGWSDIGSWSALWQESPRNADGNVILGDVLAVDSTDCYLRSQDHLVATVGVSNLVVIATDDAVLVADKSRDQEVKAVVEALKREGRPEATQGTRGWRPWGWYKTIEQGERFKVKQIHVDPGAKLSLQKHWHRSEHWVVVKGTALVTCGDTSFVLRENESTFIPAGTNHRLENPGKVPLRLIEVQSGEYVGEDDIVRVEDDYGR

SEQ ID NO: 3512 - protein, 256 aa, Shigella boydii
RFGQNFLNDQFVIDSIVSAINPQKGQAMVEIGPGLAALTEPVGERLDQLMVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENAP

SEQ ID NO: 3513 - protein, 555 aa, Clostridium perfringens str. 13
MKDFKKSVVYQIYPKSFKDSNGDGLGDLRGVIEKLDYLKTLGVDYIWMTPFYVSPQKDNGYDIADYYKIDPRYGTMEDFEELVKEAKSRNIDIMLDMVFNHTSTEHEWFKRALKGEEKYKNYYIFKEGKKGEPPTNWISKFGGNAWEYVEELGEYYLHLFDVSQADLNWDNKELREEIYKVVNFWIDKGVKGFRLDVINLISKPEKFENDYEGDGRRFYTDGHRIHEYLKELNERTFGKDVEIVTVGEMSSTTIENCIKYSNPKEKELSMVFNFHHLKVDYKDGQKWSLMDFDFIELKKLFNNWQRGMIKGGGWNAVFWCNHDQPRVNSRFGDVKKYFNESSKMLATSIHMMSGTPYVYQGEEIGMTNPGFESIEEYRDVESINYFNILKEEGIDKKEIMEILKSKSRDNSRTPVQWNEEKNAGFTTGTPWINIANNYREINVERALENKDSVFYHYKKLIELRKNEDVIAYGDYIPLLEDHPKVYAYERNYNGEKLLVINNFYGEECLVDLSKEIEGLENYNKSILISNYKDSTLDLLNLKLRPYESIVYKLEK

SEQ ID NO: 3514 - protein, 381 aa, Clostridium perfringens str. 13
MVIVIDDEGRENEGDLVMAGELVTGEKINFMATYGKGLICAPVSESIAENLGLNPMVSHNTDNHETAFTVSIDYKDTTTGISAFERAHTIKELINEESKAEYFRRPGHVFPLIAKNGGVLKRDGHTEAAIDLAKLAGLKEVGVICEIMKDDGTMARTDELLEFAKIHNMKIITIEDLIAYRTERDNFVYRVVETNMPTKYGDFKAIGFIDKLTGEHHVALVKGEIKSEEPVLLRVHSECLTGDVFGSRRCDCGEQFHSAMEKINEEGKGILLYMRQEGRGIGLINKLKAYKLQDEGLDTVEANIALGFPEDLRDYGVGAQILKDLGVREIRLMTNNPKKITGLEGYGLKIVERVPIEIKCNEENEFYLKTKKEKMHHLIMQ

SEQ ID NO: 3515 - protein, 95 aa, Brassica napus
RAAILEWLEVQISGATDLEFSPGDVLDTMDRSQAALEEESWLEEYNRDEKRYNVGKGTHLVLKRAEKARALVSRMPVMAEALMAKVLAWDNERCA

SEQ ID NO: 3516 - protein, 427 aa, Azoarcus sp. EbN1
MTSRNETLFQRAQKSIPGGVNSPVRAFRSVGGTPRFISRAEGARVWDADGKAYVDYVGSWGPAIAGHAHPAIVEAVREAALAGLSFGAPSEAEVDIAELICELMPSIEMVRLVSSGTEATMSAIRLARGFTGRDAIVKFEGCYHGHADSLLVKAGSGLLTFGNPSSGGVPADFAKHTIVLDYNDLQQVEDAFRARGGEIAAVIVEAIAGNMNLVKPLPGFLEGLRRLCTEYGVVLIFDEVMTGFRVGPQGVQGLYGIMPDLTTLGKVIGGGMPVGAFGGRRDIMEKIAPLGSVYQAGTLSGSPVAVAAGLASLKLLREPGFYENLGARTTQLVTGLAAAANDAGVTFSADSVGGMFGVYFSAAVPKSFADVMASDRDAFNRFFHAMLDAGHYFAPSAFEAGFVSAAHTAADIDETIAAAREVFARLG

SEQ ID NO: 3517 - protein, 468 aa, Synechococcus sp. WH 5701
MSEAVVYQIFPDRFRRSGRVAAQDGLELMPWGSDPALQGFQGGDLYGVIEALDHLQGLGITCLSLNPVFASAANHRYHANDYLQVDPLLGGNDALEALIEAVHQRGMRLILDGVFNHCGRGFWAFHHLLENGQTSPYRHWFHVERWPLQPYPAAGQSCGYHCWWNDPALPKFRHDHPPVRRHLLDVARTWIAAGADGWRLDVPDEVPGDFWDEFRQTVRAENPEAWIVGEIWGDARPWLGGERFDGVMNYPLTWSILGYFGAENVPGELKLPALPEPPYQPLDRAGFEQRISEVLARYRPAVNRCMLNLLDGHDTPRALHVLGGDEAALRLCQLFLFLLPGAPCVYYGTEMGLDGGPEPGCREAYPWDVPSGALADWLRELAALRRRLPALRSDALSFAESPHDDLVLLRRGEGRERVWVAINRGDEPLPLTPPSPAMTPLWASAPAAAGSTTSLAARSALILADPTP

SEQ ID NO: 3518 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 3519 - protein, 116 aa, Zea mays
  misc_feature (23)..(23): Xaa can be any naturally occurring amino acid
  misc_feature (51)..(51): Xaa can be any naturally occurring amino acid
  misc_feature (63)..(63): Xaa can be any naturally occurring amino acid
  misc_feature (88)..(88): Xaa can be any naturally occurring amino acid
  unsure (1)..(116): unsure at all Xaa locations
SCRTCCRKYKDVLVKDAGYIGTXGKGILAADECTGTIGKRLSSINVDNVDXNSPALRELLLCXPGALQYISGVILLEQTLRQKTKDGXPYRCVLKDGGDLRCIQSGQGTTEVVASD

SEQ ID NO: 3520 - protein, 553 aa, Synechococcus sp. WH 5701
MSIEKDHWWNGCVIYQLMPRSFADANGDGIGDLDGITSQLPYLQWLGVDAIWLTPIYPSPLRDGGYDITDFTAIHPDLGNLDDLARLLDQAHRHGIRVLLDLVLNHTSVLHPWFQRARWSPAGSSERDFYVWRDDDRGYPEAQVLFRHFESSNWQWDSVARQYYLHRFLHHQPDLNYDNPAVAEAMLEVVDFWVERGVDGFRLDAVPFLHEREGTRCEGLPETHAFLKRLRARVDSSGRDLLLIAEAIQPVKESAPYLADDELHAAFDFALTAQLFAAVARGRCDKLRNCLQHAQEMVPGCRWALPLRNHDELWLGDGHLVEDEVVQAVMTGFPEAREHWLNWGINRRLAPLLNGDPRPNTLLHGLLYSLPGLPCLYYGDELGMGDWPGLRDRDANRTPMAWTSERNGGFSTAPDPLLVLPPITSPGYDYRVVNVEVQKQLSGSLLNWHHRMLTSRRLLPALRQGSFELLESAHPSVLCYARHSDGMTVVVAANLAATGASSRLDLGQWQGSRMRDTLWGCEFPPASEAWFVYLPAYGFFWWLVGEDSSDANS

SEQ ID NO: 3521 - protein, 174 aa, Hordeum vulgare subsp. vulgare
MAPTVMASSATSVAPFQGLKSTAGLPVSRRSNASSASVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCQESGKA

SEQ ID NO: 3522 - protein, 418 aa, Synechococcus sp. WH 5701
MTDLARYAADHGLRHFLFSFSDLFGVQRAKLVPASAVNQLARDGAGFAGFAAWLAMTPADPDVLGLPDPASLAVLPWQRSVAWVATDLQVEGRPLEQSPRWVLRRQLERATQLGYSFRTGVEAEFFLLQPGGTAIADVHDTQSKPCYDQLALMRQFELIGGLLEAMEELGWGPYQADHEDANGQFEINWTFADALVTADRHALFRVMAQSMAEPLGARVSFGPKPFPQLTGSGAHLHHSLWDDSGRNLFHDPRGELGLSRLAYHFLGGLLEHAPALCAITNPTAESYARLGGQTTNSGATWSPGWISYGGNNRSHMVRIPDDQRLELRLADSAANPYLLPAAVLAAGLDGLERQLDPGPRNDANLYTDPPAPGTATPLPATLKEALAAFAADTVLREALGESFCQAYESLRARHSASL

SEQ ID NO: 3523 - protein, 248 aa, Glycine max
  misc_feature (69)..(69): Xaa can be any naturally occurring amino acid
  misc_feature (96)..(96): Xaa can be any naturally occurring amino acid
  unsure (1)..(248): unsure at all Xaa locations
MSGAVLVAVAAAIGNLLQGWDNATIAGSILYIKREFQLQSEPTVEGLIVAMSLIGATVVTTCSGALSEXLGRRPMLIISSMLYFVSSLVMLWSPNXFISSLLSLLDLLDGLGIGLAVTLGTLFTISETAPSEIRGLLNTLPQFTGSAGMFFSYCMGFGMSLMKAPSWRIMLGVLSIPSLIYFALTLLFLPESPRWLVSKGRMLEAKKVLQRLRGREDVSGEMALLVEGLGVGGDTAIEDYIIGPANEL

SEQ ID NO: 3524 - protein, 257 aa, Leptospira interrogans serovar Copenhageni str. Fiocruz L1-130
MKYTIGIAGCGNMGGAIYFSLKERYPTQVLGYDPYIISNQKIELISSWDEFVSKSDLILVCVKPGKVIELLRQIKVPKKIISVAAGIHIDTILKNLPTGSNVVRVMPNLPLLVSEGAIGFFGDEELYETVSEIFQPLGHSVKLGSETLMDAVTGLSGSGPAYVFKFIQALAEGGVLSGLGYQEALDLSIQTVIGSAQLLRKEREKDPTTHPEVWKNKVTSPGGTTIAGLVELEKNGFSNAVLEAVKAAANRSKELGV

SEQ ID NO: 3525 - protein, 256 aa, Shigella boydii
RFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHTTMPYPVKDIRVLSRITTEAFNQRRKTIRNSLGNLFSAEVLTEMGIDPAMRAENISVAQYCQMANYLAENAP

SEQ ID NO: 3526 - protein, 1101 aa, Bradyrhizobium sp. BTAi1
MNLMSSLDAPNLQTATDGDGLWYKDAIIYQLHVKAFADSNNDGIGDFVGLTEKLDYLQDLGVTALWLLPFYPSPGRDDGYDIADYGSINPDFGTMKDFKRFIQEAQRRGLRVITELVVNHTSDQHHWFKRARRSPPGSSARNWYVWSDTDQKYLGTRIIFTDTEKSNWTWDPEAGQFYWHRFFSHQPDLNFDNPRVVSAIIQVMKRWLDAGVDGFRLDAIPYLCERDGTNNENLPETHAIIKRLRVELDNYAKDKLLLAEANQWPEDVQEYFGQGDECHMAYHFPLMPRIYMAIAQEDRFPITDILRQTPDIPATCQWALFLRNHDELTLEMVTDVERDYLWSTYANDPRARINVGIRRRLAPLMDNDRRKIELMNSLLMSFPGTPIIYYGDEIGMGDNIYLGDRNGVRTPMQWTPDRNGGFSRADPARLYAPMIMDPVYGYEAVNVEAQSRSLSSLLNATKKLISVRKSTPAFGRGTMSFIRPANRSVLAYVRQYKDEVILCVANLSRSAQATELDLSAFKDRVPIEMLGRSRFPAIGELPYMITLAPYGFYWFQLREREKSEPVVQRAVPEFETLVVPVGSTWVSLARTRSLFERDVLPGHLARTRWYPERSADAIHPTLTSAIPFCDIGDNRPWLIFFKAAERNDELRYLLPMWIDWVRFDRERYNPQAFAAVRQGAREGTVLDAATSPIFLALLLRNLRQSLTVEEDGLRLEFRPTSKFPDRPISESEQVRIIETDRCSSKAVVNNDYFIKIHRELEAGVHPEIDVGHFLTETVGFANVPPLLGSVEFIQDDERRTIGSVHGFIENQGDGWTVTLAYLDRYIDDQRVFTAQGDERQNEERSPYLRYMTQAGRRVGELHAALASRNDIADFAPEPTTADSLDHWIDRLRAQANRVLARLIERRDHFKDPERGLIDQVLARRGELSERLSHLIPHHVGGCDIRLHGDFHLGQILIVKDDIFIIDFDGDEEQPLAERRRKAPPAKDIAGFLRSIDCSVRVALDHALQAAPDDHSKLTTALADWRDQASAAFLAGYREIKAAQGLWPDDPHTAEALLSFFLLEKALGALEYDLAHRPDWLRVALGNLLRVLSVPAPASESS

SEQ ID NO: 3527 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 3528 - protein, 186 aa, Triticum aestivum
  misc_feature (57)..(57): Xaa can be any naturally occurring amino acid
  misc_feature (84)..(84): Xaa can be any naturally occurring amino acid
  misc_feature (98)..(98): Xaa can be any naturally occurring amino acid
  misc_feature (117)..(117): Xaa can be any naturally occurring amino acid
  misc_feature (132)..(132): Xaa can be any naturally occurring amino acid
  unsure (1)..(186): unsure at all Xaa locations
MAARARAVAATSRNSSILLAAAVALALLVSSASAQSGCTTALVGLYPCMNYIKRQRXTRPTKSCCSAARLSPCSPSPQCLCTRXSGGDSSSLGGVTIXKTRALRVAPTPCNVQTPPXASKCNGAGSGSAPWXPVAKTPTSPAVQAPAGLGSKTTPSAYLQGNGGSSLHGPAGLGPPRPAAAVYAVS

SEQ ID NO: 3529 - protein, 463 aa, Chromobacterium violaceum ATCC 12472
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 3530 - protein, 264 aa, Hypocrea jecorina
MGHEDAVYLAKLAEQAERYEEMVENMKIVASEDRDLTVEERNLLSVAYKNVIGARRASWRIVTSIEQKEESKGNSSQVALIKEYRQKIEAELAKICDDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAGQVEAPPKEDTPAEAAAPAEEPKAE

SEQ ID NO: 3531 - protein, 272 aa, Hypocrea jecorina
MATERESKTFLARLCEQAERYDEMVTYMKEVAQLGGELSVDERNLLSVAYKNVVGTRRASWRIISSIEQKEESKGSDKHVATIKEYRSKIELELEKVCEDVLNVLDTSLIPNAATGESKVFYHKMKGDYHRYLAEFASGEKRKVAATAAHEAYKNATDVAQTELTPTHPIRLGLALNFSVFYYEILNSPDRACHLAKQAFDDAIAELDSLSEESYRDSTLIMQLLRDNLTLWTSSDSGEAEQAGEAKKDEGEAAKPAEEEPKAEEPAPEATS

SEQ ID NO: 3532 - protein, 407 aa, Haloarcula marismortui ATCC 43049
MTTIKDSVHDHIEVQGVAAALLDTPPVQRLRHISQLGTVTLVYPSANHTRFEHSLGVYHLADRVLSHLGIEGQQAERVRAAALLHDVGHSPYSHNVEALIHRRTGKYHDDVDELLGDGPVARVLTEHGLNPDRVAGLVAGEGELGQLVSGELDVDRMDYLVRDAHHTGVPYGTIDHERLVRELCFVDGELVLDEGNVQTAESLLLARALMNPTVYQHHVARIAKSMLRRGTEELLAATDTTAETLRRWDDNDLLVALRQCDATAAYARRLSQRDLYKRAVWAEWQAVPDEVLAADHDAVGAMEQAIADEANVDSDAVVLDIPPEPSMTESSSRVLVNGGVRRLGEQSTLVNAIRAAQRDQWRLGVYAPDAESERVGAAAIRELGLDLDGARVRDVRTGIHATLDEFN

SEQ ID NO: 3533 - protein, 339 aa, Pycnoporus coccineus
MPGQVPVGINGFGRIGRIVLRNALLHGDINVVAVNDPFIDLEYMVYMFKYDSVHGRFKGSVEAKDGKLWVEGKPISVFQEKDPANIPWGSVGAQYIVESTGVFTTTEKASAHLKGGAKKVVISAPSADAPMFVCGVNLDAYDPKYTVISNASCTTNCLAPLAKIINDKFGIVEGLMTTVHATTATQRTVDGPSHKDWRGGRAVGNNIIPSSTGAAKAVGKVIPSLNGKLTGLAFRVPTIDVSVVDLVVRLEKPAKYEDIKNAVKEAANGNMQGIMAYTEDKVVSTDFTGSDASSIFDAEAGIALNDHFVKLISWYDNEWGYSKRVCDLLAYAAKRDGAI

SEQ ID NO: 3534 - protein, 303 aa, Glycine max
MAATSTSLFSSNLHSLNSQPFSSSLSFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 3535 - protein, 534 aa, Glycine max
MVRNESSNKEKDKDLDQFLFDRNDDDLVDEEQQEIEGVKYESESSSDGDDANRRAQPDSFSSQQWPQSYKETTDSYTIAAAPNFESVLRGPSFIYSSFDNRSKSNLDIDGKTPFLSAAEGIRQSTWWEKASVQRLVSGELPIGYGCSFTQTIFNGINVMAGVGLLSTPYTVNQAGWMSMAVMLLFAVMCCYTATLLRYCFENREEIITYPDIGEAAFGRYGRIAVSIILYTELYSYCVEFITLEGDNLTSLFPGTSLDLGGFQLDSMHLFGVLTALIILPTVWLKDLRIISYLSAGGVIATVLIIICVFCVGTIDGVGFHHTGQLVKWNGIPFAIGVYGFCFAGHSVFPNIYQSMADKKQFTKALIICFVLSNLLYGGTAIMGYLMFGDGTLSQITLNMPPGTFASKVALWTTVINPLTKYALLMNPLARSLEELLPDRISSSYWCFILLRTTLVASTVCVAFLVPFFGLVMALIGSLFSILVSAIMPSLCFLKIIGKKATRTQVVLSVAIAAFGVICGILGTYSSLLSIADSY

SEQ ID NO: 3536 - protein, 721 aa, Myxococcus xanthus DK 1622
MLGVGSATGSCAGRRGLCRGHAPGDESGMRLRSWWWVLVLLTVSCAGRRSSSEDLGGRDARSELFRARGDAAIETKQWALAAGYFASARHTEDSPTARWGQVWAEKRASSLEWAKQFEGSVLALAFSPDGRLLASGGYDAVVRVWDVAAGAQVAELKGHEAELHAVAFSPDGRWLAAAGRPGALWLWDWKQGRRVALLSGHTDVVRGLAFSPDGEWLASGGLDRTVRVWRIRDGAEVLRFTHDDIVIAVAFSPDGGRLVSSSMDRTARVWELTARRELHRLTGHGDKVESCAFSADGERVMTASADRAIRFWDARTGALLDVQRNTGALSAVAIDAGFQQLVQAGWEGRVQRVDVRGGGEVLERLDAHRTFVMAVALSPDGRTFASGGMDGVLKVWSRPEVPPDVLLRELPAWPEVLTSVGPDAFVSGGEDGLRSWSVSAGGELHSRLEAPDAVGAVAVSADRRLLAVGTLKGEVRVRDVRSGNQLMVIPAARESIRALAFSPDGALLAAGVAQDVVLWAVPSATQVARLTGHTGKAWALAFDATGQRLASGAADHTVRIWDVARGTVIRVLEAGDRVRAVTFLASGELLTAGMRQPIRLWSPDDGRVLTSMDSLTVGVLSLAMAPQGAFVASGGVGGEMKVWRLPDGALMGEVPGLQGFVSAVTFSSDGAWLAAAASDRTFHLLGFDAFALPPPVEPDLTRILRRHGLAWDDLRGAFTLH

SEQ ID NO: 3537 - protein, 274 aa, Candidatus Blochmannia floridanus
MLKCNKCCCVTQYSYVLCESRILDQLEEGRVVVLDTIPSTNQYILDNFKHVKLGDVYVTDYQTQGRGRYGKSWITPNKQSLCLSVYWKLYRNLFSIVELSLIVSFTVADVLKKMGVPKIKIKWPNDLYVGDKKLAGILIEVITNSKDVFHLAIGIGINMSICIRTKLKIKMSKNWIDLKDIGVNLDHNVLVATLVKKLRKTLSRFNDNQNILRMNYWQSLNYLYGKSIELFSNNNIDYGTGTVLGISSNGALLVVDAVGKVCHFRNENLSIRVL

SEQ ID NO: 3538 - protein, 146 aa, Brassica napus
MNNLTKEEEAGLAVLENLTSNVKQIHDEVLKEILTCDVNTEYLRSFLHGSSDKDLFKKNVPIGTYEDFKPYIERVANGESSEIISGRPITGFAQTSGTSGGKQRLIPLNNKYVENARFLSDLRYLVLSKHIEGHNEGKGLRLLFRK

SEQ ID NO: 3539 - protein, 218 aa, Colwellia psychrerythraea 34H
MTQDEMKNAAAIKALEFIENDTIVGVGTGSTVNFFIEALASMKDKIAGAVSSSEESTKRLKAHGIEVFDLNSVDVLDVYVDGADEITRHMSMIKGGGAALTREKIVAAVAKKFICIADDSKQVKVLGNFPLPVEVIPMARSYVARELVKLGGDPVYRQGVTTDNGNVILDVYNLEILDPKALETQINAIVGVVTNGLFALRGADILVLGSKDGIQVIQ

SEQ ID NO: 3540 - protein, 498 aa, Polaromonas sp. JS666
MRAVPTFAQLCGIRDAARQQALEHTSGLITASDLELVRFAWCDLHGVTRGKTLVAGAAAKAMQEGVGLVSTLVLKDTSDRSTAFKVFERGGPAGLPGFEFASNLLLLADPSSFRQLPWTPATGWVQGQLWFQNGQPVELDTRRVLQQALAGLARAGYGMKCGLEVEFHIYKITEEGTRDQLDPNQAGWPGLPPQVSLVHPGYNMLTEGWYDLAEEPLRIVQHTAQALGLPLLSLEIELGPSQVEAVFEATDALTAADNMVLFRNAVKQALRRAGYHASFMCRPPFANIMSSGWHLHQSLVDSETGRNVFQREAPAPGSTAADARHTLSETGEHYLAGLLAHARGMAVFCTPTINGFGRYRPNALAPQAVLWGRDNRGAMLRVVGQCGDGATRIENRIGEPAANPYLYLASQIHAGLDGITRRLKAPPATDAPYGASGTLLPTSLGEALEALQTDPILVKAFGSAFVDYLVRVKRSELDRYAQAEDKDDWQRREYFSRI

SEQ ID NO: 3541 - protein, 56 aa, Arabidopsis thaliana
TVASSMLSSATMVASQAHATMVAPFNARKSSAAFAATLNAISEITSITSRGGRVKL

SEQ ID NO: 3542 - protein, 274 aa, Azoarcus sp. EbN1
MTERMKISFLGGGNMATALIGGLAERGFASADIQAVDLQADSRARLAERFGIRTAPAVDDEVLACDVVVLAVKPQQMKAAVAPLTGRLARQVVVSIAAGLRLADVGRWLGGYHRLVRAMPNTPALIGAGITGLYADPSVDAAGRESAERILGAVGSTVWIADEAQMDAVTAVSGSGPAYVFHFIEALEAAAVSLGFDAATARQLALDTVLGAAKLAAGADEAPAVLRERVTSKGGTTEAALASMASSGVFDAIVRAVHAANVRGRELGEQLGKD

SEQ ID NO: 3543 - protein, 340 aa, Burkholderia sp. 383
MSTESALQATIQALVQDGKGLLAADESGPTIAKRFKTIAVESTEENRRAWRTLLLSTPGLGEFVSGVILYEETLGQCADDGTPLPELAARQQIVPGIKVDAGKIPLALAPGDEITQGLDGLAARLDGYQRQGARFAKWRAVYNVSATLPGHAAIQANAEALARYAAICQEAGVVPIVEPEVLMDGDHSIGRCAQVTDAVLHAVFDALHRHRVVLAHMLLKPSMVVAGSTHTAQPAPAEVAEATVRLLRSAVPAEVPGIFFLSGGQTPEEATAHLDAMNRVAGRPWLLSFSYGRALQEPPLAAWQGQAANVRAAQDALLLRARLNGAACRGQYDAAMERTP

SEQ ID NO: 3544 - protein, 406 aa, Pyrococcus furiosus DSM 3638
AHHHHHHGSIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 3545 - protein, 121 aa, Triticum aestivum
MVAQAFTVDLDKPLVFQVGHLEEQYQDWVHQPIVSKEGPRFFANDVLEFLTRTKWWAVPLIWLPVVCWCLNTSIQMGHTVPQVALMVVAGIFIWTLVEYVLHRYLFHIVPAALGTRVPVGP

SEQ ID NO: 3546 - protein, 520 aa, Burkholderia pseudomallei K96243
MSPHPNSDNSTAQSNPPQLRRSLKARHLTMIAIGGSIGTGLFVASGASISQAGPGGAMLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVIAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLIPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSSLYPYGPIFAFALCIVIALGQDYQAFLANRIDWIGVLATYVGIPLFLVVWLGYRLVHKTRVVRYEDMDIASWVAEHERAAAHEAREAAAVRVPSSPEAAS

SEQ ID NO: 3547 - protein, 314 aa, Chromobacterium violaceum ATCC 12472
MLRHLSDGRFHSGEDIAQALGCSRTLVWQAVRTIESELGLTVFSVRGQGYKLAQPFGWLDVAAIRAGLSPAAAEAFTLAVAERTDSTNSQLMARAGNGGLHGLVLACELQTAGRGRLGRRWQARLGSGLTFSLLWRFERGLAELAGLSLAIGVALGRALRTLGAPVELKWPNDVLLEGRKLAGILIEVSGDALGPAAAVVGIGLNVADPGAVDQPVAALEQAGVAPDRNRVLSAMLNELERVLSDFDRDGFAPLRDEWWRLCAHRDAPVRLSFSHGEPVDGVACGVAENGALLAQTAQGTRSFHIGEVSLRERQ

SEQ ID NO: 3548 - protein, 544 aa, Leptospira interrogans serovar Copenhageni str. Fiocruz L1-130
MDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 3549 - protein, 396 aa, Hevea brasiliensis
MASASLLKSSPVLDRSEFVKGQSLRQPSASIIRCHPASSSALTILAGSYADELVKTAKTVASPGRGILAMDESNATCGKRLASIGLENTEANRQAYRTLLVTAPGLGQYISGAILFEETLYQSTTDGKKMVDVLIEQNIVPGIKVDKGLVPLPGSNNESWCQGLDGLASRTAAYYQQGARFAKWRTVVSIPNGPSALAVKEAAWGLARYAAISQDNGLVPIVEPEILLDGEHGIDRTFEVALKVWAEVFYYLAENNVLFEGILLKPSMVTPGAECKDKATPQQVSDYTLKLLKRRIPPAIPGIMFLSGGQSEVEATLNLNAMNQGPNPWHVSFSYARALQNTCLKTWAGRPENVKAAQEVLLVRAKANSLAQLGKYTGEGESEEAKKGMFVKGYVY

SEQ ID NO: 3550 - protein, 328 aa, Thermosynechococcus elongatus BP-1
MSHLGLILVITVVALVLLGLALYLLFPRKYESARSVAESYDNWTKDGILEFYWGEHIHLGHYGLPPRPKDFRQAKVDFVHEMVRWAGLDRLPPGTTVLDVGCGIGGSSRILARDYGFHVTGITISPEQVRRARELTPAELNVRFQLDDALALSFPDASFDVVWSIEAGPHMPDKQQFAKELLRVLKPGGILVVADWNQRDDRQQPLNFWERLIMRQLLDQWAHPAFASIEGFAEALAATGLVAGEVMTADWTQETLPSWLDSIWQGIVRPEGLIRFGLPGLVKSLREVPTFLLMRIAFGMGLCRFGMFRAVRAEIPAVSLEPAPQVNC

SEQ ID NO: 3551 - protein, 184 aa, Arabidopsis thaliana
  misc_feature (38)..(38): Xaa can be any naturally occurring amino acid
  misc_feature (82)..(82): Xaa can be any naturally occurring amino acid
  misc_feature (95)..(95): Xaa can be any naturally occurring amino acid
  misc_feature (154)..(154): Xaa can be any naturally occurring amino acid
  unsure (1)..(184): unsure at all Xaa locations
MASSMLSSTAVATSPVQDTMVRLHCTGLKSSASFPVTXRKANNYFTSITRNGGKDICMKVCTPVGKNKCETLSYLPDLTDVXELAKEVDYLLRNXRIPCVEFELEHGFVYREHCNTPVYYDGRYWTMCKLPLVGCTDSAQVLKEAEECKKEYPXVFIMIIGFDNARIVQCIRFIVQKPPRFPKA

SEQ ID NO: 3552 - protein, 378 aa, Triticum aestivum
  misc_feature (316)..(316): Xaa can be any naturally occurring amino acid
  misc_feature (336)..(336): Xaa can be any naturally occurring amino acid
  misc_feature (344)..(344): Xaa can be any naturally occurring amino acid
  misc_feature (353)..(353): Xaa can be any naturally occurring amino acid
  unsure (1)..(378): unsure at all Xaa locations
RSDTCELVARFCYGLTIELSPANIVHLRCAAEYLEMTEETAQDNLIHQAEMFFNQVVLRSWKDSLEALKTCDVLPHAEDLHIAKRCVESLAAKASIDPDLFGWPVSEHGAMHSPGGSVLWNGISTGAKLGNFSSDWWYDDASSLSFPTYKRLISTMESRGAKEEIVAGSLTYYAKKCLPGLNRRQSMGPVPLTSAAATLSEEEQRHLLEDIDRMLPLQRGLISTNVLLWLLRTAMILKVNRACISNLEKRVGMQLDEATLEDLLLPNFSYTMDTLYNVECVRRILDHFLAMGQTMGGGSPCLNDVMGSPSLARITXVAKLIDGYLAEIGPNITLSXPKFESLAXCLAEIARPXNYGLYRAISFLGRAIWLRESRGGFW

SEQ ID NO: 3553 - protein, 189 aa, Arabidopsis thaliana
  misc_feature (107)..(107): Xaa can be any naturally occurring amino acid
  unsure (1)..(189): unsure at all Xaa locations
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVXTRGARVTLTRDTYDWTGTWTNVGSFPLCSGLHPTSGQSVEGKLEEVQRRGTPMPLFRIIGFDNTRQVQCISFIAYKPPSFTG

SEQ ID NO: 3554 - protein, 94 aa, Prunus mume
PSNYSNPTMPSNCNGSQFNFTKVSPQLRADLERSWPDVESGNDTRFWEGEWNKHGTCSEQTLNQMQYFQRSYAMWRSYNISQILKNASIVPHPT

SEQ ID NO: 3555 - protein, 458 aa, Pseudomonas syringae pv. tomato str. DC3000
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRQGVPWMTVLVMGVTLLGGVLLNYLIPKDVFLLIASLATFATVWVWLMILLTQVAMRRSMSREEVTQLKFAVPFWPYGPAAAIAFMLFIFGVLGYFPDNRAALIVGAIWIALLLIAYGLWVKPKALNKTH

SEQ ID NO: 3556 - protein, 232 aa, Bifidobacterium longum NCC2705
MDKAQQDALKKAAGIEAAKLVENGMIAGLGTGSTVKFLVDELGRRHQEEGLEFTGVTTSRRTQAQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 3557 - protein, 471 aa, Pseudomonas putida KT2440
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDSRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGTTNTLRIETLI

SEQ ID NO: 3558 - protein, 547 aa, Thermosynechococcus elongatus BP-1
MPVFDSIESALEALRRGEVIVVVDDENRENEGDLIGAAERVTPAMINFMAVHARGLICLAMEGDRLDELDLPLMVTTNTDSNQTAFTVSVDAGARWGVTTGISAEDRARTIQALIDPSTQPQDLRRPGHVFPLRSRPGGVLKRAGHTEAAVDLTRLAGLYPAGVICEIQNPDGTMSRLPQLMEYARTHQLKIISIADLISYRLQHERFVRREAVAKLPTEFGEFQIYGYRNSLDQSEHVAIVKGDPATFGEQPVLVRVHSECLTGDALGSLRCDCRMQLQAALKMINAAGRGVVVYLRQEGRGIGLVNKLRAYSLQDLGMDTVEANEHLGFPADLRNYGVGAQILNDLGVKQIRLITNNPRKIAGLKGYGLEVVDRVPLLIEATPYNTPYLTTKAEKLGHLLLQTYLITVAFRWQGSQLAAGDRYERLEKLRHLAAGVHLLVREEARPVAQAIFGHPDLIVHFGFDQPHVADRQWYKQPEHPYVLAVQTLLRQFCQWPTLKGFEFLVATGTDPMLNLPMDLDRQAYTQQSPSEWRPHLIYSWSAAAG

SEQ ID NO: 3559 - protein, 250 aa, Lactobacillus reuteri
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYKYFVSKWVNREYRQLFTKNQFHQAMKHAKVNNLSTITYEQVLSIFNSYLLFNGRKQLPIF

SEQ ID NO: 3560 - protein, 119 aa, Plantago major
MATSSEEGQVYSVHSVEEFKDHLEKSKEAKKLVVIDFTASWCGPCRFIAPILAELAKKTPHVMFLKVDVDELKAISVEYEVEAMPTFVFLKDGKPIDRLVGAKKEDLLAKITTHGTVVA

SEQ ID NO: 3561 - protein, 334 aa, Magnaporthe grisea 70-15
MSANLEAQAAAEATLQGFLWRQREAPKPLPAGTSAKGQTSIITGSNTGLGLEASRQLLRLGLSHLVMGVRSKERGEAAAEQLRAEFPDAKISVWIVDMASYDSIRAFAAKCGAELERIDSVILNAAVQTPQFSLVEATGHELTMQTNYLSTAFLSLLLVPVLKAKKKEGAAPPVLSIVGSDTSYMTTLLSMNPALPACDKPENYSQFQAYARAKLLLVFFVAKLAEHVDPADVIINYPNPGLTKGTEIGRSATTLSKVTFAAMQYLLARELDVGASVYLDAVFNYGAKGHGSFISDWTIKPYPPVWYTEEGKQLRTSLWEETLNELKPAGAPLP

SEQ ID NO: 3562 - protein, 348 aa, Pseudomonas sp. TW3
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINAAEESVYKTVRSLLGERGVDVAIDYSGQAAALKELIQSITHGGELRLMGVPSHDILLNLEEWLFKGLIVRGLHGRRLYETWERSTSLLVTGRVDLSSLVSHRLPLSAAEDAFEMALNGQSLKILFEPNGSCI

SEQ ID NO: 3563 - protein, 268 aa, Pneumocystis carinii
MTSRENLVYLAKLAEQAERYEEMVESMKKVASSDQELTVEERNLLSVAYKNVIGARRASWRIVSSIEQKEENKGNLSQAGLIKEYRSKIESELTSICNDILAVLDAHLIASASTGESKVFYYKMKGDYYRYLAEFAVGDKRKAPSDASLAAYKEASDIAGTDLPPTHPIRLGLALNFSVFYYEILNSPDCACHLAKQAFDDAIAELDTLSEESYKDSTLIMQLLRDNLTLWTSDMQDSNEKNDSKEAVSEVPDPGKPSETEASKTDDI

SEQ ID NO: 3564 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 3565 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKIMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 3566 - protein, 236 aa, Solibacter usitatus Ellin6076
MDLDRLRAAFPERQILYFESLDSTMRVAAASEPGTIVLADRQLAGLGRQGHTWHSEPGHGIYCSIVLPPTPVLTLALGVATIDAIAQAAGIQCDLRWPNDLMLDNRKVAGILVQLVNGSAIAGIGINVNHPGFPSDLAKEAISLRQHAGRELSREDILIALFPAIDSIVGEDSETILRLFTHASSYAAGRRVTVQQPGGDITGTTAGLDQSGFLIVRKDDGTDTLILAGGVRASGS

SEQ ID NO: 3567 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 3568 - protein, 817 aa, Arabidopsis thaliana
MGKKRIMFFASLLLITIFLSFSYAGITRESPLSIGKTLSSSNGVYELGFFSFNNSQNQYVGIWFKGIIPRVVVWVANREKPVTDSAANLTISSNGSLLLFNENHSVVWSIGETFASNGSRAELTDNGNLVVIDNNSGRTLWESFEHFGDTMLPFSNLMYNLATGEKRVLTSWKSHTDPSPGDFTVQITPQVPSQACTMRGSKTYWRSGPWAKTRFTGIPVMDDTYTSPFSLQQDTNGSGSFTYFERNFKLSYIMITSEGSLKIFQHNGMDWELNFEAPENSCDIYGFCGPFGICVMSVPPKCKCFKGFVPKSIEEWKRGNWTDGCVRHTELHCQGNTNGKTVNGFYHVANIKPPDFYEFASFVDAEGCYQICLHNCSCLAFAYINGIGCLMWNQDLMDAVQFSAGGEILSIRLASSELGGNKRNKIIVASILMHGNTLTIIESLVSAKISKIASKEAWNNDLEPQDVSGLKFFEMNTIQTATDNFSLSNKLGQGGFGSVYKGKLQDGKEIAVKRLSSSSGQGKEEFMNEIVLISKLQHKNLVRILGCCIEGEERLLVYEFLLNKSLDTFLFVLIVSIRYYCLDSRKRLEIDWPKRFNIIEGIARGLHYLHRDSCLRVIHRDLKVSNILLDEKMNPKISDFGLARMYQGTEYQDNTRRVAGTLGYMAPEYAWTGMFSEKSDIYSFGVILLEIITGEKISRFSYGRQGKTLLAYVNLKPKQQAWESWCESGGIDLLDKDVADSCHPLEVERCVQIGLLCVQHQPADRPNTMELLSMLTTTSDLTSPKQPTFVVHTRDEESLSQGLITVNEMTQSVILGR

SEQ ID NO: 3569 - protein, 380 aa, Clostridium perfringens ATCC 13124
MNKNVIGVEISGIRKFYNEVVKFPEAISLTLGQPDFPVPEKVKEAMIRAIEEGKTTYTANAGIVELREEISSLLKNNFDIDFSKDEIIITVGGSEGLYAAMTALLNSGEKVLVPSIAYPAYESISKIIGCEVINYDLNEDFSVNIESLKEGIKQGGKLLVLSYPCNPTGALLSKKSRDELIEIIKENDILVLTDEIYSSLCFEEEYYSVAQCKDIKEKIIYVSGFSKMFSMTGLRIGYVACSKEIYDQIIKVHQYNSSCATSISQWGALEGLKSCMNDVENMKESFKERMNFTYKRLKSMGLEVEKPKGAFYIYPNISKFGLTSEEFCHRLLEEGKVACVPGDAFGKGGEGYIRISYCYSKDELERALDKLEAFVKTLKK

SEQ ID NO: 3570 - protein, 421 aa, Medicago truncatula
MASNNSDKNKEKENDYFLDANEDETDIEAVNYDSDSSNNNDDDDEDDRIATHRPESFTSQQWPQSYNEALDPLTIAAAPNIGSVLRAPSVIYASFAAGRSSKSYLELQDGFLTGTQIQESTWWEKASIQKNIPEELPIGYGCTFTQTIFNGLNVLAGVGLLSAPDTVKQAGWASLLVIVVFAVVCFYTAELMRHCFQSREGIISYPDIGEAAFGKYGRVFISIVLYTELYSYCVEFIIMEGDNLSGLFPGTSLHWGSLNLDGKHLFAILAALIILPTVWLKDLRFVSYLSAGGVVGTALVGACVYAVGTRKDVGFHHTAPLVNWSGVPFAFGIYGFCFAGHSVFPNIYQSMANKKDFTKAMLICFVLPVFLYGSVGAAGFLMFGERTSSQITLDLPRDAFASKVSLWTIAIIPLTKYPFMS

SEQ ID NO: 3571 - protein, 151 aa, Zea mays
MGLQGQLSDVSSDSIPLMLVALLATLFKHVRSFFLRFSALSVVVDDAAASASVTSGLANLAVLADQLKLNRLFSYSYVGNAASDCIVCLSTLKTGEEVRKLDCRHVFHKHCLEGWLQHLNFNCPLCRSTLLGHGHGEGGPSSLHSAATASR

SEQ ID NO: 3572 - protein, 412 aa, Medicago truncatula
MANNDKNKEKENEYFLDANEDETDIEAVNYDSDSSNNRGSYDDDDQQPESFTSQQWPQTYNEAIDPLTIAAAPNLGSILRGPSVLYSSFVGSFSSKSYLELHDGKTSFLSGNQIQEGFPTTWWEKASIQMQIPEELPIGYGCTFTQTIFNGINIMAGVGLLSTPDTVKQAGWVSLVVMLIFAVVCCYTAELMRHCFQSREGIISYPDIGEAAFGKYGRVIISSYCVEYIIMEGDNLAGLFPGTNLHWGGLNMDGKHLFAILAALIILPTVWLKDLRIISYLSAGGVIGTALVATCVFVVGTRKDVGFHHTGQFVNWSGIPFAFGIYGFCFAGHSVFPNIYQSMANKKDFTKAIIICFVLPFLLYGGVGAMGFLMFGEGTLSQITLNLPRDAFASKVSLWTIAVIPLTKYPFP

SEQ ID NO: 3573 - protein, 824 aa, Arabidopsis thaliana
MGKKRIVLLLFISFSYAEITKESPLSIGQTLSSSNGVYELGFFSFNNSQNQYVGIWFKGIIPRVVVWVANREKPVTDSAANLVISSSGSLLLINGKHDVVWSTGEISASKGSHAELSDYGNLMVKDNVTGRTLWESFEHLGNTLLPLSTMMYNLVTGEKRGLSSWKSYTDPSPGDFWVQITPQVPSQGFVMRGSTPYYRTGPWAKTRYTGIPQMDESYTSPFSLHQDVNGSGYFSYFERDYKLSRIMLTSEGSMKVLRYNGLDWKSSYEGPANSCDIYGVCGPFGFCVISDPPKCKCFKGFVPKSIEEWKRGNWTSGCARRTELHCQGNSTGKDANVFHTVPNIKPPDFYEYANSVDAEGCYQSCLHNCSCLAFAYIPGIGCLMWSKDLMDTMQFSAGGEILSIRLAHSELDVHKRKMTIVASTVSLTLFVILGFATFGFWRNRVKHHEDAWRNDLQSQDVPGLEFFEMNTIQTATSNFSLSNKLGHGGFGSVYKARNVLSYSLFFFSVFSEDDICNFFQGKLQDGREIAVKRLSSSSEQGKQEFMNEIVLISKLQHRNLVRVLGCCVEGKEKLLIYEFMKNKSLDTFVFGGLHLASFLKRLELDWPKRFDIIQGIVRGLLYLHRDSRLRVIHRDLKVSNILLDEKMNPKISDFGLARLFQGSQYQDKTRRVVGTLGYMSPEYAWTGVFSEKSDIYSFGVLLLEIISGEKISRFSYGEEGKALLAYVWECWCETRGVNLLDQALDDSSHPAEVGRCVQIGLLCVQHQPADRPNTLELLSMLTTTSDLPLPKQPTFAVHTRNDEPPSNDLMITVNEMTESVILGR

SEQ ID NO: 3574 - protein, 774 aa, Arabidopsis thaliana
MGKKRIVFFAYLPFFTIFMSFSFAGITKESPFSIGQTLSSSNGVYELGFFSLNNSQNQYLGIWFKSIIPQVVVWVANREKPVTDSAANLGISSNGSLLLSNGKHGVVWSTGDIFASNGSRAELTDHGNLVFIDKVSGRTLWQSFEHLGNTLLPTSIMMYNLVAGEKRGLTAWKSYTDPSPGEFVALITPQVPSQGIIMRGSTRYYRTGPWAKTRFTGSPQMDESYTSPFILTQDVNGSGYFSFVERGKPSRMILTSEGTMKVLVHNGMDWESTYEGPANSCDIYGVCGPFGLCVVSIPPKCKCFKGFVPKFAKEWKKGNWTSGCVRRTELHCQGNSSGKDANVFYTVPNIKPPDFYEYANSQNAEECHQNCLHNCSCLAFSYIPGIGCLMWSKDLMDTRQFSAAGELLSIRLARSELDVNKRKMTIVASTVSLTLFVIFGFAAFGFWRCRVEHNAHISNDAWRNFLQSQDVPGLEFFEMNAIQTATNNFSLSNKLGPGGFGSVYKARNGKLQDGREIAVKRLSSSSGQGKQEFMNEIVLISKLQHRNLVRVLGCCVEGTEKLLIYGFLKNKSLDTFVFDARKKLELDWPKRFEIIEGIARGLLYLHRDSRLRVIHRDLKVSNILLDEKMNPKISDFGLARMFQGTQYQEKTRRVVGTLGYMSPEYAWTGVFSEKSDIYSFGVLLLEIISGKKISSFSYGEEGKALLAYIGLLCVQHEPADRPNTLELLSMLTTTSDLPLPKKPTFVVHTRKDESPSNDSMITVNEMTESVIQGR

SEQ ID NO: 3575 - protein, 839 aa, Arabidopsis thaliana
MGKKWIVFFAYLLLSSFFISSSSAGITKESPLPIGQTLSSSNGFYELGFFNFNNSQNQYVGIWFKGIIPRVVVWVANREKPVTDSTANLAISNNGSLLLFNGKHGVAWSSGEALVSNGSRAELSDTGNLIVIDNFSGRTLWQSFDHLGDTMLPSSTLKYNLATGEKQVLSSWKSYTDPSVGDFVLQITPQVPTQVLVTKGSTPYYRSGPWAKTRFTGIPLMDDTFTGPVSVQQDTNGSGSLTYLNRNDRLQRTMLTSKGTQELSWHNGTDWVLNFVAPEHSCDYYGVCGPFGLCVKSVPPKCTCFKGFVPKLIEEWKRGNWTGGCVRRTELYCQGNSTGKYANVFHPVARIKPPDFYEFASFVNVEECQKSCLHNCSCLAFAYIDGIGCLMWNQDLMDAVQFSEGGELLSIRLARSELGGNKRKKAITASIVSLSLVVIIAFVAFCFWRYRVKHNADITTDASQVSWRNDLKPQDVPGLDFFDMHTIQTATNNFSISNKLGQGGFGPVYKGKLQDGKEIAVKRLSSSSGQGKEEFMNEIVLISKLQHKNLVRILGCCIEGEEKLLIYEFMLNNSLDTFLFGGFLLASFLYYQQLFLYMELSYLIVHTLYCRLDSRKRLEIDWPKRLDIIQGIARGIHYLHRDSHLKVIHRDLKVSNILLDEKMNPKISDFGLARMYQGTEYQDNTRRVVGTLGYMAPEYAWTGMFSEKSDIYSFGVLMLEIISGEKISRFSYGKEEKTLIAYAWESWCDTGGIDLLDKDVADSCRPLEVERCVQIGLLCVQHQPADRPNTLELLSMLTTTSDLPPPEQPTFVVHRRDDKSSSEDLITVNEMTKSVILGR

SEQ ID NO: 3576 - protein, 427 aa, Bordetella bronchiseptica RB50
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 3577 - protein, 221 aa, Escherichia coli
DLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 3578 - protein, 161 aa, Oryza sativa
VMGQSVLFRQPSSASVVLPNRATSLTVRAASSYADELVKTAKTIASPGRGILAMDESNATCGKRLDSIGLENTEANRQAYRTLLVSAPGLGQYISGAILFEQTLYQSTTEGKKMVDVLVEQNIVPGIKVDKGLVPLVGSNNESWCQGLDGLSSRTAAYYQQ

SEQ ID NO: 3579 - protein, 1027 aa, Debaryomyces hansenii CBS767
MSVQLSTPPLSKDKSSEKSTTPKSSKKKFFSNLLHRKNKNETSPNLGLNNGLKSRSSSASTKVSSSPSLTNKLKRQSWVSNNSKRTSRSQVRGRSKGPDVSGNCIDDDDDSVFNYAEEDEIEDSRNVFDMTSSLSSLSHAMSSHSLNELGVRHNNSSNTNIGDMINLTMQSTDAQPQPWDGLTPESLVVPQYVKTHRRNKHSPRALNNLFLAQELNVESCASKNHNDNDSISSESLKQGTSSDDDHDEILYEHETQATSEFFSDSQGYSKRPAHKRKNKNDFNEVYVMEFSRDGKYLAVAGRNSIIKIWKVISSPLSRLEQKNAESLNENSKSKKTNKNLYKGAPVFHQAPVRVFKGHTHSVLSLDWSKNNFLISGSMDRLVKLWHVDRLDCLETFQNDDFVTTVKFHPMDDRFFLSGSLDNQVRLWSILEKNIAYNKDLGDDILITAASFTPDGQHCIVGGFNGSIFALEINGLHVINRFEVKEKSFVHSFHNKNGNKITGIKIFESREYSRLKIIDDDPLAKWNFLITTNDSKIRLVNSDLKKLVTRFKGLTNTSSSIVADMTDDFHYIVSGSEDHWCYVWENNNSIINNKLKLALKDLVLEGKNHINDLQSKHKSYAKLIHKNPLMKKLNVQKFLDDENAIEYVANENNSYVAFHPHHSKVNVAVFAPENTKKLLELSDDLIFELIKRGKKYNLGGVEDDKSLENDNPDDFSSEIGVNGGHIIITTDQYGLIRVFRQDSAYEVRKKLRDILKLKKENCSKLKSDSKVNSCNQLCDSKTNKNNLRLDLPRSRSTRLANNRSLSPSNDGYFALKNKLHSRIKGNSNGISNTSSSLSTMDGKSSNPGTPSSMYQISDHRSSSQSNLPRFVSSSSLVNGATLHNTSSSGIMSQVDATVDIRNDDIDSISMSEKSYIPETGNTSLNAPESAYTLTLTPSNDNKSSRTLTATPPVSSTKTEVFPALDNQKKGIPLLINTGSTVDNKEDKSEIINFHTLANDSINMDRAFEGPNSNNSSFYNAENNTRGRM

SEQ ID NO: 3580 - protein, 124 aa, Glycine max
MLCHYVYGEGLRMIKLFFKIHSLLYCKKKKKTEKFGIKIERNPPESKLTQLGVRQWPKWGCPPSKFPWTYESKETCYLLEGKVKVFPSGSNESVEIAAGDLVEFPKGMSCTWDVSVGVDKHYNV

SEQ ID NO: 3581 - protein, 831 aa, Arabidopsis thaliana
MYKLPQRNCADKQEYTVHMRKMGMVIFACLLLLIIFPTFGYADINTSSPLSIGQTLSSPDGVYELGFFSPNNSRKQYVGIWFKNIAPQVVVWVANRDKPVTKTAANLTISSNGSLILLDGTQDVIWSTGEAFTSNKCHAELLDTGNLVVIDDVSGKTLWKSFENLGNTMLPQSSVMYDIPRGKNRVLTSWRSNSDPSPGEFTLEFTPQVPPQGLIRRGSSPYWRSGPWAKTRFSGIPGIDASYVSPFTVLQDVAKGTASFSYSMLRNYKLSYVTLTSEGKMKILWNDGKSWKLHFEAPTSSCDLYRACGPFGLCVRSRNPKCICLKGFVPKSDDEWKKGNWTSGCVRRTQLSCHTNSSTKTQGKETDSFYHMTRVKTPDLYQLAGFLNAEQCYQDCLGNCSCTAFAYISGIGCLVWNRELVDTVQFLSDGESLSLRLASSELAGSNRTKIILGTTVSLSIFVILVFAAYKSWRYRTKQNEPNPMFIHSSQDAWAKDMEPQDVSGVNLFDMHTIRTATNNFSSSNKLGQGGFGPVYKGKLVDGKEIAVKRLSSSSGQGTDEFMNEIRLISKLQHKNLVRLLGCCIKGEEKLLIYEYLVNKSLDVFLFDSTLKFEIDWQKRFNIIQGVARGLLYLHRDSRLRVIHRDLKVSNILLDEKMIPKISDFGLARMSQGTQYQDNTRRVVGTLGYMAPEYAWTGVFSEKSDIYSFGVLLLEIIIGEKISRFSEEGKTLLAYAWESWCETKGVDLLDQALADSSHPAEVGRCVQIGLLCVQHQPADRPNTLELMSMLTTISELPSPKQPTFTVHSRDDDSTSNDLITVNEITQSVIQGR

SEQ ID NO: 3582 - protein, 517 aa, Bifidobacterium longum NCC2705
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 3583 - protein, 567 aa, Polaromonas sp. JS666
MPHSVSLISTIAAGLGLALIFGFAAARLRLPAIVGYLLAGVIIGPFTPGFVADTGIASQLAEIGVMLLMFGVGLHFSLDDLLAVRKIAVPGAVVQMTVATALGMGLAHWWGWNLGGALVFGLSLSVASTVVLLRALESRGILDSVNGRIAVGWLVVEDLAMVLVLVLLPPLGSWLSGKTDASADVNMLWKTLGMTMLQVGGFVALMLVVGRRFFPWVLWHVQRTGSRELFTLCVVAAAVSIAFGATALFGVSFALGAFFAGMVMRESEFSHRAAEESLPLRDAFAVLFFVSVGMLFDPWVLLERPLQVLAVVGIIIVGKSLAAGLLVVAFRYPLNTALTVSASLAQIGEFSFILVALGASLGLLPPEGQSLVLAGALISIALNQLVFKAVEPFQQWILGKSALARKLEARDDPTAQLPASTEAKYLSHHVVLVGYGRVGRRIAEALGAHHIPFVVAEQNREAVERLREQGLPAVSGDASEPDVLIQAHIAQARMLVIATPDTLDVRQMIATARALNPAIETVVRTHNEAEAKLLDQENAGKVFLGEHELAQAMTRHVLERSAASAAH

SEQ ID NO: 3584 - protein, 308 aa, Mesorhizobium sp. BNC1
MKTYKLVNRDVSAPGRDSAADADGSGVEMPMIGLGVFQTPPDETTAAVEEALRLGYRHIDTAAAYGNEREVGEGIRRAGIARDEVFIETKIWISDYGYDETLHAFDKSAGKLGVDQIDLLLLHQPLPSAFDRTLGAYRALEKLLADGKVRAIGVSNFMPEHLTRLLTETSIVPAVNQIEVHPYFQQRALQRLHAEHGILTQAWSPIGGITFYRGGEKSTLEDPVLLEIAQQHGKSAAQVMLRWHLQEGRSVIPKSTKPARIAENFDVFDFELSGEQIAAIDALDTGVRSGPEPDSITLESYGRPIPEA

SEQ ID NO: 3585 - protein, 547 aa, Triticum aestivum
  misc_feature (466)..(466): Xaa can be any naturally occurring amino acid
  misc_feature (519)..(519): Xaa can be any naturally occurring amino acid
  misc_feature (533)..(533): Xaa can be any naturally occurring amino acid
  unsure (1)..(547): unsure at all Xaa locations
RQGSSSADHRFRSAWTDEVELQDNLLTGDFPAVVGAAAPNLGEINLSNNQLTGALPASIGNFSGVQKLLLDRNSFSGALPAEVGRLQELSKAARGGNAIEGGVPPEIGKCRLLTYLDLSRNNLSGRIPPAISGMRILNYLNLSKNHLDGEIPPSISTMQSLTAVDFSYNNLSGLVPGTGQFSYFNATSFVGNPNLCGPYLGPCRPGIADAGHTNHGHGGLSSTIKLLIVLGLLLCSIIFATAAILKARSLKKASDARMWKLTAFQRLDFTCDDVLDSLKEENIIGKGGAGTVYKGSMPNGDHVAVKRLSAMVRGSSHDHGFSAEIQTLGRIRHRHIVRLLGFCSNNETNLLVYEYMPNGSLGELLHGKKGEHLHWDTRYKIAIEAAKGLCYLHHDCSPLILHRDVKSNNILLDSDFEAHVADFGLAKFLQDTGASECMSAIAGSYGYIAPEYAYTLKVDEKSDVYXSFGVVLLELVTGREPGGEFGDGVDIGQGVKMMTGPNKEQVMKILDPRLSTRPXHEGNHVFYVVLLAXEEHKVQGPTIPEVV

SEQ ID NO: 3586 - protein, 645 aa, Glycine max
MSSAEKPSSKGQAWFCTTGLPSDIVVEVDDMTFHLHKFPLMSKSRKLHLLITQQEAASNSTVPQQQQQQQETEDEDEIVEEQCHVTFTGFPGGSEAFEMAAKFCYGVKIDLTPSNVAALRCAGEFLEMTEDYSEDNLVSKTEGFLSQHVLKNLKDSVKTLKSCDSLMPMAENLGITQRCVDSVVSRASSADPALFGWPVSDATSVSKQVLWNGLDGDGRRKVGAGAGESWFEDLALLRLPLFKRLILAMRSAELSPEIIETCLMYYAKKYIPGVSRSNRKPLPSSSSSSSVATEAEQKEILETLVSNLPLEKSSKAATATRFLFGLLRTTNILNASEACRDALEKKIGLQLEEATLDDLLVPSYSYLNETLYDVDCVERILSHFLEEERNVAAIDGRAPRSPALMLVGKLIDGYLSEIASDANLKPEKFYNFAISLPDEARLFDDGLYRAVDVYLKAHPWVLEEEREKICGLLDCQKLTLEACTHAAQNERLPLRAVVQVLFFEQLQLRQAIAGTLMAAEAAAEPGRQSAALEREAEDGRGEGLGLEHVQERNGTWRVAVRENQVLRLDMDSMRTRVHQLERECSSMKRVISKFDKFAASGGGWRASLGRKFGCKFKTQVCDSHESTAVDTRKGRHHQQHHPHHD

SEQ ID NO: 3587 - protein, 325 aa, Emericella nidulans
MSSGKTFKLSNGVTIPAVGFGTFASEGASGETYRAVKKALEVGYRHLDCAWFYQNEDEVGDAVRDFLKENPSVKREDIFICTKVWNHLHRPEDVRWSIEDSLKKLKTDYVDLFLIHWPIAAEKESQDKPKIGPDGKYVILKDLTEDPKPTWQAMEKLYEDKLARSIGVSNWTIEGLEKLLKYAKVKPHVNQIEIHPFLPNEELIQYCWKNDILPEAYSPLGSQNQVPTTGERVSENKTLNEIAQKGGNTLAQVLIAWGLRRGYVVLPKSSNPARIESNFKTIELSDEDYEAVNAVAKGRHFRFVNMKDTFGYDVWPEETAKNISA

SEQ ID NO: 3588 - protein, 518 aa, Arabidopsis thaliana
MGKNEKTSLGRALVKHHNHMIQETKEKGKSYKDQHKKVLESVTEVSDIDAIIEQAEEAERSSSSGITAKEWKEQRMREEALHASSLQVPRRPHWTPKMNVEKLDANEKQAFLTWRRKLASLEENEKLVLTPFEKNLDIWRQLWRVLERSDLIVMVVDARDPLFYRCPDLEAYAQEIDEHKKTMLLVNKADLLPSYVREKWAEYFSRNNILFVFWSAKAATATLEGKPLKEQWRAPDTTQKTDNPAVKVYGRDDLLDRLKLEALEIVKMRKSRGVSATSTESHCEQVVVGFVGYPNVGKSSTINALVGQKRTGVTSTPGKTKHFQTLIISEDLMLCDCPGLVFPSFSSSRYEMVASGVLPIDRMTEHLEAIKVVAELVPRHAIEDVYNISLPKPKSYEPQSRPPLASELLRTYCLSRGYVASSGLPDETRAARQILKDYIEGKLPHFAMPPEITRDDENETADDTLGAETREGSQTEKKGEEAPSLGLDQVLDDLSSFDLANGLVSSKTKQHKKSHRKQ

SEQ ID NO: 3589 - protein, 279 aa, Streptomyces lincolnensis
MPSRYGSRQELGQNFLVDPDIIKLIRRAAERTEGPIVDLGAGDGALTLPLSRLGRPVTAVELDPRRVKRLSARAPENVKVVGEDILRFRLPTVPHTVVGNIPFHVTTATMRRILVAPAWVSAVLVVQWEVARRRAGIGGCSLVTAESWPWFDFSVLKRVPRFAFRPAPSVDGGILVIERRPEPLVRERREYQDFVRQVFTGRGHGLREILQRIGRVQDSDLSAWFRAHGVSPQALPKDLTAEQWASLWGMARGGRSVPRTRRPRGLPPRTSRGPRRNSG

SEQ ID NO: 3590 - protein, 211 aa, Schizosaccharomyces pombe
MTTEAAPNLLVLTRHGESEWNKLNLFTGWKDPALSETGIKEAKLGGERLKSRGYKFDIAFTSALQRAQKTCQIILEEVGEPNLETIKSEKLNERYYGDLQGLNKDDARKKWGAEQVQIWRRSYDIAPPNGESLKDTAERVLPYYKSTIVPHILKGEKVLIAAHGNSLRALIMDLEGLTGDQIVKRELATGVPIVYHLDKDGKYVSKELIDN

SEQ ID NO: 3591 - protein, 321 aa, Schizosaccharomyces pombe
MSAEQKYFENAQNVHFTLADGSKIPGLGLGTWRSEPNQTKNAVKTALQYGYRHIDAAAIYGNEDEVGDGIKESGVPRKDIWVTSKLWCNAHAPEAVPKALEKTLKDLKLDYLDEYLIHWPVSFKTGEDKFPKDKDGNLIYEKNPIEETWKAMEKLLETGKVRHIGLSNFNDTNLERILKVAKVKPAVHQMELHPFLPQTEFVEKHKKLGIHVTAYSPFGNQNTIYESKIPKLIEHETIQKIAKSKGEGVTGATIAVSWAITRGTSVIPKSVNEQRIKSNFKYIPLTKEDMDEINSIGIRARFNQATFSNEPVFAGLEDGRT

SEQ ID NO: 3592 - protein, 478 aa, Brucella melitensis 16M
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVITDDAHDLEDMVNHACEIVFHEEFGKAGDRVIITAGVPFGTPGATNMLRIAYIGADGKSGI

SEQ ID NO: 3593 - protein, 267 aa, Rickettsia akari str. Hartford
MNIGKFKLIVFDTLDSTSSEAMRIVQNAKVDSNYAVLAKSQTNGRGRNGKNWQSRSGNLHVSLLIKPDKELALLPQLSFVTALAIYDCMSSRGLTTGSSKPTTNDTVSCVLEPVVKPRDDIIQLKWPNDVLVNGRKIAGILLESVKIENNYYLIIGIGINITYHPDNIDQPTTSLISENLPPIETQALLQKLIENFEKYYQIWHNNGFSFIRQKWLEHAYKLHENISVKHQNDIITGLFKDIDNTGRIILQLPSKKIISFSTAELSF

SEQ ID NO: 3594 - protein, 614 aa, 'Chlorella' ellipsoidea
ELNLDDVGYDDVGGVRKQMAQIRELVELPLRHPQLFKTIGVKPPKGILLYGPPGSGKTLIARAVANETGAFFFLINGPEIMSKLAGESESNLRKAFEEAEKNSPAIIFIDEIDSIAPKREKTQGEVERRIVSQLLTLMDGLKARSHVIVMGATNRPNSIDAALRRFGRFDREIDIGVPDEIGRLEVLRIHTKNMKLDENAELELIGRDTHGYVGADLAALCTEAALQCIREKMDVIDLEDDTIDAEILNSMAVTNDHFKTALGISNPSALRETVVEVPNVNWEDVGGLEGVKRELQEVVQYPVEHPEKFEKFGMSPSKGVLFYGPPGCGKTPLAKAIANECQANFISVKGPELLTMWFGESEANVREILDKARQSAPCVLFFDELDSIANQRGSSQGDAGGAADRVLNQMLTEMDGMNSKKTVFIIGATNRPDIIDSALLRPGRLDQLIYIPLPDDPSRNQIFKAALRKSPVAPDVDINQLVKYTNGFSGADITEICQRACKYAIRENIEKDIEREKRLADNPDSMEEDVDEVPCITRAHFEEAMKYARRSVSDADIRKYQAFAQTLQQSRGFGSDFRFPDRPGQAPATTPAGQAAAPAFASGAAADDDDDLYS

SEQ ID NO: 3595 - protein, 825 aa, Arabidopsis thaliana
MDFLFLLLERKNKHMGKKRVVLLWLSIFISFSSAEITEESPLSIGQTLSSSNGVYELGFFSFNNSQNQYVGISFKGIIPRVVVWVANREKPVTDSAANLVISSNGSLQLFNGKHGVVWSSGKALASNGSRVELLDSGNLVVIEKVSGRTLWESFEHLGDTLLPHSTIMYNVHTGEKRGLTSWKSYTDPSPGDFVVLITPQVPSQGFLMRGSTPYFRSGPWAKTKFTGLPQMDESYTSPFSLTQDVNGSGYYSYFDRDNKRSRIRLTPDGSMKALRYNGMDWDTTYEGPANSCDIYGVCGPFGFCVISVPPKCKCFKGFIPKSIEEWKTGNWTSGCVRRSELHCQGNSTGKDANVFHTVPNIKPPDFYEYADSVDAEECQQNCLNNCSCLAFAYIPGIGCLMWSKDLMDTVQFAAGGELLSIRLARSELDVNKRKKTIIAITVSLTLFVILGFTAFGFWRRRVEQNEDAWRNDLQTQDVPGLEYFEMNTIQTATNNFSLSNKLGHGGFGSVYKARNGKLQDGREIAVKRLSSSSEQGKQEFMNEIVLISKLQHRNLVRVLGCCVEGTEKLLIYEFMKNKSLDTFVFVFTRCFCLDSKKRLEIDWPKRFDIIQGIARGLLYLHRDSRLRIIHRDLKVSNILLDEKMNPKISDFGLARMFHGTEYQDKTRRVVGTLGYMSPEYAWAGVFSEKSDIYSFGVLLLEIISGEKISRFSYGEEGKTLLAYVSKSAWECWCGARGVNLLDQALGDSCHPYEVGRCVQIGLLCVQYQPADRPNTLELLSMLTTTSDLPLPKQPTFVVHTRDGKSPSNDSMITVNEMTESVIHGR

SEQ ID NO: 3596 - protein, 319 aa, Metasequoia glyptostroboides
MAAAAALKTPISLGRSEWFGQTLRPTSSSSLSLQTHSLSTSPALNVRASAYSDELVKTAKTVASPGRGILAMDESNATCGKRLASIGLENTEANRQAYRQLLVSAPGLRQYISGAILFEETLYQSTTDGKKIVDVLVSQNIVPGIKVDKGLVPLAGSNDESWCQGLDGLASRCAAYYQQGARFAKWRTVVSIPNGPSALAVKEAAWGLARYAAISQDNGLVPIVEPEILLDGDHGIDRTFEVAKKVWAEVFFYLAENNVMFEGILLKPSMVTPGAEHKERASPTTVSEYTIKLLRSRVPPAVPGIMFPLWRAIRGGRRR

SEQ ID NO: 3597 - protein, 287 aa, Metasequoia glyptostroboides
MSCFKGKYHDELIANANYIATPGKGILAADESTGTIGKRLASINVENVESNRRALRELLFTAPGALPLISGVILFEETLYQKASDGTTFVDILTSAGVLPGIKVDKGTVDLAGTAGETTTQGLDGLGQRCATYYKAGARFAKWRAVLKIGPTEPSQLAIQENANGLARYAIICQENGLVPIVEPEILVDGSHSIDVCADVTERVVAACYKALNDHKVLLEGTLLKPNMVTPGIRRPQSQPGRYCSVHCPGSAADRATRRARDYVLVRWAERGGGHLELECHEQAAGR

SEQ ID NO: 3598 - protein, 342 aa, Trichodesmium erythraeum IMS101
MPLKVAINGFGRIGRLVFRAGLNYPDLIEFVGINDLVPPQNLAYLLKYDSTHGRFQGEVTASDDGIKINGKLIPCVSVKNPAELPWKEKDAHYVVESTGLFTTFDSASNHLAAGAKRVIISAPTKDPDKVKTLLMGVNHDLFDPAVDTIVSNASCTTNCLAPIAKVIDDNFGLTEGLMTTVHAMTATQPTVDGPSKKDFRGGRSAAQNIIPAATGAAKAVTLVLPHLKGKLTGMAFRVPTPDVSVVDLTFKTEKSTNYKDICAAMKTAAENSMKGILSYTEDPVVSTDFTGNSHSSIFDAGAGIELNSNFFKVVSWYDNEWGYSNRVLDLMLSMAEKEGKPK

SEQ ID NO: 3599 - protein, 1034 aa, Saccharomyces cerevisiae
MLRTRVTALLCRATVRSSTNYVSLARTRSFHSQSILLKTAATDITSTQYSRIFNPDLKNIDRPLDTFARRHLGPSPSDVKKMLKTMGYSDLNAFIEELVPPNILKRRPLKLEAPSKGFCEQEMLQHLEKIANKNHYKVKNFIGKGYYGTILPPVIQRNLLESPEWYTSYTPYQPEISQGRLEALLNFQTVVSDLTGLPVANASLLDEGTAAGEAMLLSFNISRKKKLKYVIDKKLHQQTKSVLHTRAKPFNIEIIEVDCSDIKKAVDVLKNPDVSGCLVQYPATDGSILPPDSMKQLSDALHSHKSLLSVASDLMALTLLKPPAHYGADIVLGSSQRFGVPMGYGGPHAAFFAVIDKLNRKIPGRIVGISKDRLGKTALRLALQTREQHIKRDKATSNICTAQALLANVASSYCVYHGPKGLQNISRRIFSLTSILANAIENDSCPHELINKTWFDTLTIKLGNGISSEQLLDKALKEFNINLFAVDTTTISLALDETTTKADVENLLKVFDIENSSQFLSEDYSNSFPREFQRTDEILRNEVFHMHHSETAMLRYLHRLQSRDLSLANSMIPLGSCTMKLNSTVEMMPITWPQFSNIHPFQPSNQVQGYKELITSLEKDLCSITGFDGISLQPNSGAQGEYTGLRVIRSYLESKGENHRNVCLIPVSAHGTNPASAAMAGLKVVPVNCLQDGSLDLVDLKNKAEQHSKELAAVMITYPSTYGLFEPGIQHAIDIVHSFGGQVYLDGANMNAQVGLTSPGDLGADVCHLNLHKTFSIPHGGGGPAGAPICVKSHLIPHLPKHDVVDMITGIGGSKSIDSVSSAPYGNALVLPISYAYIKMMGNEGLPFSSVIAMLNSNYMMTRLKDHYKILFVNEMSTLKHCAHEFIVDLREYKAKGVEAIDVAKRLQDYGFHAPTLAFPVPGTLMIEPTESENLEELDRFCDAMISIKEEINALVAGQPKGQILKNAPHSLEDLITSSNWDTRGYTREEAAYPLPFLRYNKFWPTVARLDDTYGDMNLICTCPSVEEIANETE

SEQ ID NO: 3600 - protein, 224 aa, Triticum aestivum
  misc_feature (174)..(174): Xaa can be any naturally occurring amino acid
  misc_feature (178)..(178): Xaa can be any naturally occurring amino acid
  misc_feature (186)..(186): Xaa can be any naturally occurring amino acid
  unsure (1)..(224): unsure at all Xaa locations
MAAPPSSVSVRAGASVSAKLTPSRAARVGFGGRVSVGSGRKCGGPVRASLFSPKPAVAMDARPTKVQELHVYELNEHDRESPAYLRLSAKQSQNALGDLVPFTNKVYNGSLDKRIGITAGICILIQHVPERNGDRYEAIYSIYFGDYGHITVQGPYLTYEESYLAVTGGSGVFXGVYXQVKLNQIXVFLFKIFYTFYLKGIPTARFFDGPSPPPVPPPGPPNPP

SEQ ID NO: 3601 - protein, 325 aa, Triticum aestivum
MDAAALDDVIRRLLEARGGRTVRPAQLSDAEIRRLCAAAKDVFLSQPNLLELEAPIKVCGDIHGQYSDLLRLFEYGGFPPEANYLFLGDYVDRGKQSIETICLLLAYKIKYPENFFLLRGNHEYAMTLGLFRIYGFFDECKRRFNVRLWKVFTDCFNCLPVAALIDDKILCMHGGLSPDLKNMDQIRNIARPVDIPDHGLLCDLLWSDPDKDVDGWGENDRGVSYTFGADKVAEFLQTKSRSYLVCRAHQVVEDGYEFFAKRQLVTIFSAPNYCGEFDNAGAMMSIDDSLTCSFQILKPSDKKGKAGTGNSKPGTPPRKIKINII

SEQ ID NO: 3602 - protein, 302 aa, Haemophilus influenzae R2846
MMNFTLLTYLSDCQTKVRSELEKFSKNLEEDIQQLREIGLDILVDGQHYRLVPMLPLLNPQQISTALFPYGIHYQPIISSTNEWILQNILSLKKGDLCVAEYQTAGRGRRGRQWLSPFAGQIMFSFYWAFDPKKSIEGLSLVIGLAIAEVLNVQVKWPNDILFDERKLGGILVEIANHKNGMLNLVIGIGINVSLSKQTEISQPYAEVCEIDPDVERQTLLPKLIQHLYTRLNIFEQNGIDEEFQQAWQSYNAFSNSEVKVLTEQGVISGIEQGIDERGYLKVLCGNKIQMFNGGEVSLRKK

SEQ ID NO: 3603 - protein, 394 aa, Synechococcus sp. WH 5701
MTQLETRTEPMVVNFGPHHPSMHGVLRLVVTLDGEDVVDCEPVIGYLHRGMEKIAENRTNVMFVPYVSRWDYAAGMFNEAITVNAPEKLASIQVPKRASYIRVLMLELNRIANHLLWLGPFLADVGAQTPFFYIFREREMIYDLWEAATGQRLINNNYFRIGGVAADLPYGWLEKCLDFCDYFGPKIDEYEKLITNNPIFKRRIEGLGVISREMAINWSLSGPMLRASGVPWDLRKVDKYECYDDFEWDVAWEKEGDCYARYRVRIEEMRQSLKILRQACTAIPGGPTENLEAQRMNEGKKSSWYDFDYQYVAKKVAPTFKIPGGELYARVESGKGELGVFIMGNDDVTPWRWKIRAADFNNLQILPHILTGAKVADIMAILGSIDVIMGSVDR

SEQ ID NO: 3604 - protein, 469 aa, Proteus vulgaris
MSLEHVLSMIEEHKVRYIDLRFTDTRGKEQHLTIPAHQVNDDFFEEGKMFDGSSIGGWKGINESDMVLMPDASTAMLDPFFQDPTLIIRCDVLEPGTMQGYDRDPRSISKRAEDYLKSSGIADTVLFGPEPEFFLFDDIRFKNDISGASYAINDIEAAWNTNTKYEDGNKGHRPMVKGGYFPLPPVDSSQDIRSTMCNIMEEMGLVVEAHHHEVATAGQNEVATRFNTMTKKADETQIYKYVVQNVAHVFGKTATFMPKPLVGDNGSGMHCHMSLSKNGTNLFAGDKYGGLSEMALYYIGGIIKHARALNAFTNPTTNSYKRLVPGFEAPVMLAYSARNRSASIRIPVVASMKARRIEVRFPDPLANPYLAFAAQLMAGLDGITNKIHPGDAMDKNLYDLPPEEAKEIPTVAGSLEEALNALDADREFLTHGGVFTNDSIDAYLALLRTDVQRVRMAPHPLEFEMYYSA

SEQ ID NO: 3605 - protein, 472 aa, Magnetospirillum magnetotacticum MS-1
MTMSDDVKKVLELIKENDVKYVDFRFTDPRGKWQHTAQHVSTVDADMLNEGIMFDGSSIAGWKSINESDMILKPDASSAVMDPFAAQSQLIINCDIVEPATGQLYDRDPRSIAKRAEAYVKSSGVGDATYFGPEAEFFVFDDVKYELGMNKGYYELRSEDGVEAQGRDFAEGNLGHRPGVKGGYFPVPPVDGHVDMRAEMLTVMGEMGLPIEKHHHEVASSQHELGIKFGSLVQAADWIQIYKYVVHNVAASYGKTATFMPKPIYGDNGSGMHVHQSIWKAGKPLFAGSGYADLSDTALYYIGGIIKHAKAINAFTNPLTNSYKRLIPGFEAPVLLAYSARNRSASCRIPYSASPKGKRVEVRFPDPGANPYLAFSAMLMAGLDGIANKIHPGDPMDKNLYDLPPEELKLVPTVCGSLREALESLRANSDFLCKGDVFSKEFIESYIDLKYEEVYRFEHTPHPVEFQMYYSV

SEQ ID NO: 3606 - protein, 252 aa, Streptococcus pyogenes MGAS10394
MSRKPIIAGNWKMNKNPQEARAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEAGSFLALLDFLN

SEQ ID NO: 3607 - protein, 98 aa, Glycine max
  misc_feature (83)..(83): Xaa can be any naturally occurring amino acid
  misc_feature (87)..(87): Xaa can be any naturally occurring amino acid
  unsure (1)..(98): unsure at all Xaa locations
TRAESPLFAPFTVLKTMAGLPTIKTTNYITSIANNGGRVQCMQVCPPVGKKKFDTLSYLPNLDDAQLAKEVQYLLRKGWIPCXEIRXDHGLEYREHNR

SEQ ID NO: 3608 - protein, 467 aa, Streptococcus pyogenes MGAS10394
MVNCNFITLLSISKLVCLFYQFLLILSIFDIIKIMNEKVFRDPVHNYIHIDNPLIYDLINTKEFQRLRRIKQVPTTAFTFHGAEHSRFSHCLGVYEIARRVTAIFEEKYADIWNKDESLVTMTAALLHDIGHGAYSHTFEALFHTDHETFTQEIITNPETEINAILVRHAPDFPDKVASVINHTYPNKQVVQLISSQIDCDRMDYLLRDSYFSAANYGQFDLMRILRVIRPVEDGIVFEHSGMHAVEDYIVSRFQMYMQVYFHPASRAVELILQNLLKRAQHLYPKQQAYFQKTAPGLIPFFEKKANLADYIALDDGVMNTYFQVWMASEDHILSDLASRFINRKILKSVTFDQDSRGELERLRQLVESVGFDPDYYTGIHINFDLPYDIYRPELENPRTQIEMMQKDGSLAELSQLSPIVKALTGTTYGDRRFYFPKEMLELDDLFAPSKETFMSYISNGHFHFSQ

SEQ ID NO: 3609 - protein, 195 aa, Arabidopsis thaliana
MTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 3610 - protein, 333 aa, Nitrosospira multiformis
MTIKVGINGFGRIGRMVFRAAVQNFPDIEVVAINDLLEPDYLAYMLQHDSVHGRFKGDVSIEDSTLIVNGKRIRLTAIKDPAVLKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGSMKGVLAYTDQKVVSTDFRGESATSIFDAEAGMALDGNFVKVVSWYDNEWGYSSKILEMVRVVAGK

SEQ ID NO: 3611 - protein, 256 aa, Shigella dysenteriae
RFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGLDPAMRAENISVAQYCQMANYLAENAP

SEQ ID NO: 3612 - protein, 333 aa, Nitrosospira sp. HBN8222A
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGKALDGNFVKVVSWYDNEWGYSSKILEMVRVVAGK

SEQ ID NO: 3613 - protein, 333 aa, Nitrosospira sp. PM2
MTIKVGINGFGRIGRMVFRAAVQNFPDIEVVAINDLLEPDYLAYMLQHDSVHGRFKGDVSIEDSTPIVNGKKVRLTAIKDPAELKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGAMKGVLAYTDQKVVSTDFRGESATSIFDAEAGMALDGNFVKVVSWYDNEWGYSSKILEMVRVVAGK

SEQ ID NO: 3614 - protein, 334 aa, Oryza sativa (japonica cultivar-group)
MTKTIGGTTKINPIYLTGKIKKLPKKNLTKPTKGQNGNPKKLSINVDSRQSAWPRHSTQTSAKQSAPRTRKERRGHIAAAAARMLAVFDPTVAKCPEGLRSPPVAGGAVAAGGAGALMKGFAGAHADAVTVSLGPAGALAYSAANQSPLVPRLFGAVNDIFCLFQGHIENIASLKQHYGLSKTATEVTILIEAYRTLRDRGPLPASQVVRDLSGKFTFILYDTLSKSTFVAADADGSIPFFWGVDSENHLVFSDNVDLLKASCGNSFAPFPKGCFYTTSGGLQSFEHPLNELKPVPRVDSQGQMCGSNYKVDSEAKKDSGIPRVGSAADWSNHF

SEQ ID NO: 3615 - protein, 218 aa, Vibrio fischeri ES114
MTQDEMKKAAGWAALEYVEAGSIVGVGTGSTVNHFIDALATMKNEIKGAVSSSVASTEKLKELGIEVFDCNDVAGLDVYVDGADEINGKNEMIKGGGAALTREKIVAAISDKFICIVDDTKQVDVLGQFPLPVEVIPMARSYVARELVKLGGDPAYREGVITDNGNVILDVHGMKITDAKDLEDKINALPGVVTVGLFAHRGADVLLVGAPEGVKKFD

SEQ ID NO: 3616 - protein, 409 aa, Vibrio fischeri ES114
MAKVSLEKEKIKILLLEGLHPSCVEVFQADGYTNIEYHKGSLSEEELLEAVKDVHFIGLRSRTQLTQEVFEAANKLVAVGCFCIGTNQVDLKAAAKRGIPVFNAPFSNTRSVAELVLGQILLLLRGIPEKNALAHRGIWKKSADASFEARGKRLGIIGYGHIGTQLGILAENLGMRVYYYDIENKLSLGNATQIPTMSELLNKCDVISLHVPETAGTKDMMGAEEFARMKPGAIFINAARGTVVKIQDLCDALESGHLGGAAVDVFPVEPKTNADPFESPLQKFDNVILTPHVGGSTQEAQENIGVEVAGKLTKYSDNGSTLSSVNFPEVSLPEHTDTSRLLHIHENRPGILTQINSIFANEGINIAAQYLQTSADMGYVVIDVETARAEEALVQLKAIEGTIRARILH

SEQ ID NO: 3617 - protein, 261 aa, Streptococcus suis 89/1591
MKIGFIGLGNMGAALAHAVSQQPDTQLLLSNHNPAKAQVLQEKVGGQLFSNGEIAEQAKVIFLGVKPHLIQTVLSGLQDQISQNPSAIWISMAAGVPLDSLAAFVSADKLIRIMPNTPVAIGQGMTTYSLVNQELAPLLEQILEKSGKVQQVPESLIDAATAIAGCGPAFVYQMIEALTDAGVQNGLTAQDAKVLAAQTLAGTAQMVLTSDKHPAQLRQEVTSPGGSTIAGVVALEKEGFRYAIIRAVAAALKKTRKLGKK

SEQ ID NO: 3618 - protein, 467 aa, Clostridium perfringens ATCC 13124
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLIANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 3619 - protein, 162 aa, Zea mays
  misc_feature (47)..(47): Xaa can be any naturally occurring amino acid
  unsure (1)..(162): unsure at all Xaa locations
MDAGAKVVKKAAAGRRGGGGPKKKPVSRSVKAGLQFPVGRIGRYLKXGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKFLRFKV

SEQ ID NO: 3620 - protein, 166 aa, Triticum aestivum
MAARAVTMLVVAAVLAGGASAQSTSGCTQTLIGMSPCLNYITGNETAPSKSCCSQLATVVSSKPECLCVALNADPAALGLGAVNKTRALGLPDQCGVKTPPLSNCASAPTTSPSSGAPAGQTPTSSGAGSKSTPTADVGSGSASLRSSAGIVAGFIVRAVYAVSGM

SEQ ID NO: 3621 - protein, 250 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 3622 - protein, 148 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQVAKEPKSPSKATKSPKKA

SEQ ID NO: 3623 - protein, 369 aa, Nitrosomonas europaea ATCC 19718
MTISSTEEILADFRNGKMVILIDEEDRENEGDLVLAADFVTPEAINFMARYGRGLICLTLTEERCHQLKLPMMVADNHSPLGTNFTVSIEAATGVTTGISAADRACTVQAAVKADARPEDLVQPGHIFPLKAQKGGVLARAGHTEAGCDLGRLAGLTEAAVICEILKENGEMARLPDLIEFAGKHTLKIGTIADLIHHRNLTESLVSRFAERPLHTAHGEFRLIAYHDKIAGVTHIALVKGTWNTGEEVLVRVHEPLSVIDLLEADDHSHSWSIHDAMAVIAQAGKGVVVLLHRKNDASVLTDRILRARPRQPDKPVPDLRQHGIGAQILKDLGVSKMRLLATPRRMPSMTGFSLEVAGYLEPGNRIRK

SEQ ID NO: 3624 - protein, 1169 aa, Ustilago maydis 521
MALGKRLPQENGHLDSLKGDEDDGMDVLSPKRVRIESQASQRNGESALTQSQSRSLAPRSQQPAKPEEHDGVATSDEDAGEEEQDDDGNDDEQQEEDEQKDVDTDEEMAEEEHRQAEASHGTAQSGIVEKIELRNFMCHANFSIQFGPKLNFVMGRNGSGKSTILTALMIALGGKTSSTNRGSSLKDLVKKGESSATITVTMLNQGSDAFKPDVYGNTIVIERRILAEGGGSWKMKSGNGKVIATTKSELESFCDFANIQPDNPIHILTQDTARQFLGSSDPAEVYKFFLEGTQLSQLVREYDFIETHVRSMKSALALKSGALEQLETLAQQALQQWQKVRETRGYQDKIDALDREFVWVQVQDAEAQLQHAVEKTERIRTKLVKCEESLQKTLEALKKCEERIVQLEDENNNFEGVFSPIQQEHDELVRKDKDLAQQVKAFNVQERELNDKIIDVNKSIERYEDQIREETAKLAQDGQSRRQQLEEERQKLQKERQELQDEMVDKEEQQRELEAKIAEALQREEEEGLQLRRLKNEYSTNSSRLAQLRESSRNRLIAFGGPKVPALLQAINSENGWRSKPIGPLGTHLKLKDMRWQRVLESVIGNNLNAFFVSNHGDRMRLKKIMDRVGIHSPIIIGAETLFDYSSGEPHSDITTILRVLDCDNEIVKRQLILAVHIERAALVERRADGDTLMRTTPQNVQVCFSADMYSIGGGQAGSLSAALQEHRGAPRLSQNVGDAIRALEEEQQRLDHEIAACTQRLRELKQEKSGYERAKDTCKRDLNNLRRRKDVLRQGLSRLDEQMQEAAPGNISGLEDAKRDVEVQKEAIVLQFQDIESQKTEIVAKRAPIQEQIQTLEDRKRQFEDRMGGLHGSLRAAVAERVEQINNRDHWQRKRASIEAEIKASEAEEANFEEDYQNVEQAALQYCDKVQTTRTMSQIEKEKKELQLLKKKAASEAGISLEQAAEDLQRRQRALAEAKDEVQNMNEAERRLRSSLAVRYAKWNFFRRSIAIRAKSNFARNLATRGYEGTLKFNHKSEKLSLAIDTQAHNQSHRSSSAAATQTQRAAQQHSNKGMSGGERSFATACLLLSLWQAMSSPIRCLDEFDIFMDQVNRRVALSMIMNEARATPHVQYIMITPQDMPDMRSEMDDVKMLVVNPPQRNEGALAG

SEQ ID NO: 3625 - protein, 405 aa, Trichodesmium erythraeum IMS101
MMEKQIMKTDMRLGVKTNTEYSNRTFVYEVEGLRQSQTAGELNNPIRRSGTVYITVPYSRMNQEMRRITGMGGKILSIKTLNEHSEANSQKTKTKQKTKPMTEAKPRRSEKKSVPVNTYRPKNPFIGKCLSTAELVNEGGEGTVRHLVFDLSGSDLHYLEGQSIGIIPPGKDAKGKAHKLRLYSIASTRHGDHLNDQTVSLCVRRLEYNHPETGERIYGVCSSYLCGMEEGADVAITGPVGKEMLLPDDEDATIIMIATGTGIAPYRAFLWRMFKEREQNPDYQFKGLAWLFFGCPYTPNILYKEELEELQREFPDNFRLTYAISREQKNKDGGKMYIQHRIQENAEELWQLIQKPNAHTYICGLKGMEDGIDEGMSAVTGQFDIDWGDYQKKLKKEGRWHVETY

SEQ ID NO: 3626 - protein, 513 aa, Oryza sativa (indica cultivar-group)
MDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 3627 - protein, 72 aa, Triticum aestivum
  misc_feature (27)..(27): Xaa can be any naturally occurring amino acid
  misc_feature (48)..(48): Xaa can be any naturally occurring amino acid
  misc_feature (53)..(53): Xaa can be any naturally occurring amino acid
  unsure (1)..(72): unsure at all Xaa locations
SEQSATKRSNTIKPRSKVRAGQWIVPXPKIRPGAEEEMFKVLRHWQAXTKQWXRMVTKATLVGPGITRKPPK

SEQ ID NO: 3628 - protein, 185 aa, Zea mays
  misc_feature (83)..(83): Xaa can be any naturally occurring amino acid
  unsure (1)..(185): unsure at all Xaa locations
MASASFGKLNGLSSPRISHRSFAHPSASPPPRVSFAIRAGAYSDELVKTAKTIASPGRGILAIDESNATCGNRLASIGLDNTXENRLAYRQLLLTTPGLGDYISGAILFEETLYQSTKDGKKFVDCLNDAKIVPGIKVDKGLVPLPGSNEESWCQGLDGLASRSAEYYKQGARFGKWRTVVSIPC

SEQ ID NO: 3629 - protein, 300 aa, Vibrio fischeri
GFGRIGRFVFRASVERNDIEVVGINDLIDVEYMAYMLKYDSTHGRFNGTVEVVDGNLVVNGKTVRVTAERNPEDLKWDAINVDVVAEATGIFLDDATARKHITAGAKKVVLTGPSKDATPMFVMGVNHTSYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGEVQTSVFDAAAGVALTDKFVKV

SEQ ID NO: 3630 - protein, 527 aa, Campylobacter jejuni RM1221
MKKKIIVCDAILDKGVDILRKAEDIELIEAAKFPKDELMQMLSDIEVAITRSSTDVDVNFLNHAKKLKALVRAGVGVDNVDIPECSKRGVIVMNVPTANTIAAVELTMAHLLTSARSFVNAHNFLKIERKWEREKWYGIELMNKTLGVIGFGNIGSRVAIRAKAFGMKILAYDPYISASKITDLDMEQAKNLDEILEKSDFITIHTPKTKETNGMIGKQEIAKMKDGIRLINCARGGLYTEEALYEGLKSGKIAWLGIDVFDKEPATNHPLLDFENISVTSHLGANTLESQDNIAREACEQALSAARGVAYPNALNLPIKTEDLPPFVAPYIELVSKMAFLAVQIDKNPIKSIKLEAEGIIGEYANSMLTFAAVGALGGILGEKINYVNAEFVAKEKGVELSCETLPNSGYNNKLSVKIITENSNISVSGTVFNENEQRIVGLNGFKTDFKPKGKMIIFKNKDIPGVIAKISSVLAAKNINIADFRLGRDGFGYALAVVLIDEKVQKEVLDELKQLEACVFVQYVEI

SEQ ID NO: 3631 - protein, 334 aa, Aspergillus nidulans FGSC A4
MSLGKKVTLNTGAQIPQLGFGTWQSAPGQVGEAVYQALKVGYRHLDLATIYQNQREVAEGIKRAYKDIPGLKREDIFITSKLWNTQHDPAVVEKALDDCLAELELDYLDLYLVHWPVAFKTGDNYFPLDESSDHPDGDVLIDDSISIVDTWKAMTKLPKEKARAIGVSNHTVEHLEAIINATGVVPAANQIERHPVLQSNDLIEYAAKKNIHITAYSAFGNNMFNIPLLVAHPEVKAVAEEASKRLGKTVTPAQVILNWSQEGGHSVIPKSVTASRIAENFQEVELTKEELAKVSKLGEERRRYNTPYVANKPRWNINIFGEEDEKPAKHKVIV

SEQ ID NO: 3632 - protein, 233 aa, Zea mays
  misc_feature (146)..(146): Xaa can be any naturally occurring amino acid
  misc_feature (185)..(185): Xaa can be any naturally occurring amino acid
  misc_feature (197)..(197): Xaa can be any naturally occurring amino acid
  misc_feature (209)..(209): Xaa can be any naturally occurring amino acid
  misc_feature (216)..(216): Xaa can be any naturally occurring amino acid
  unsure (1)..(233): unsure at all Xaa locations
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEXITSGPVVCMAWEEGLGVVASARKLIGKTDPLQAEPGTKXEGDLAVQTGRNXGVHGSDSPENAXRENFGLXFKEGELMARWDSALLLG

SEQ ID NO: 3633 - protein, 314 aa, Zea mays
  misc_feature (163)..(163): Xaa can be any naturally occurring amino acid
  unsure (1)..(314): unsure at all Xaa locations
MDPMNVDNGGCGGLDAQREQLMQCRPLAEQEVKALCEKAKEILMEESNVQPVKSPVTICGDIHGQFHDLVELFRIGGKCPDTNYLFMGDYVDRGYYSVETVTLLVALKVRYPHRITILRGNHESRQITQVYGFYDECLRKYGNANVWKTFTDLFDYFPLTALXVESEIFCPLYGLSPSIENLDSACSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFDPAPRRGEPDVTRRTPDYFL

SEQ ID NO: 3634 - protein, 333 aa, Nitrosospira sp. PJA1
MTIKVGINGFGRIGRMVFRAAVQNFPDIEVVTINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRAGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 3635 - protein, 336 aa, Desulfitobacterium hafniense DCB-2
MSVRVAINGFGRIGRLTLRAILKQSLPVEVVAINDLGSPDLLAHLFKYDSLHGILPNSVEIDGDTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSMIPTTTGAAKAVTLVIPELAGKMNGLAVRVPTPNVSLVDFVANLTKSTSKEGVNAALREAAEGKLKGYLEYTELPLVSRDFNGNSASSIVDGLSTMIIGERMVKVLAWYDNEWGYSNRIVDLVKLIVMKGL

SEQ ID NO: 3636 - protein, 333 aa, Nitrosospira sp. TCH711
MTIKVGINGFGRIGRMVFRAAVQNFPDIEVVAINDLLEPDYLAYMLQHDSVHGRFRGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 3637 - protein, 249 aa, Glycine max
KIVSIADLIRYRRKRDKLVDRRTRGLIERAGAALIPTMWGPFTAYCYRSLLDGIEHIAMVKGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQILRDLGVRSMKLMTNNPAKYVGLKGYGLTISGRIPLVSLITKENKRYLETKRVKMGHVYGSEFNSKLNYQDSGNGKANSDDDSNAAAGL

SEQ ID NO: 3638 - protein, 266 aa, Sinorhizobium meliloti
MRHRRPTVADLLSMKGKRQLTMLRVMTLEEAEAAEKARIDLVSVPPALLGPEFREAAPSVFAFPGLEYGDHVTAEDYIRAAFQALKAGGDAVYCAASLSTVRRMRDEGIPVCGHVGLIPSKVTWTGGFRAVGKTAASALEIWRQTKALEEAGAFAAEIEVVPGEVAAAISARTSMLMLSMGAGTGCDAQYLFAEDVLGANRGHYPRHAKTYRNFAAEYDRLQQERIAAFSEFAFDVRSGAYPEKGHLVGIEEKELSAFLAELEGGR

SEQ ID NO: 3639 - protein, 479 aa, Desulfitobacterium hafniense DCB-2
MKKEIRESLFIDGEWQEAINKEVKGVINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 3640 - protein, 333 aa, Nitrosospira sp. TCH716
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQTIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMNGVLAYTDQKVVSTDFRGESATSIFDAEAGMALDGNFVKVVSWYDNEWGYSSKILEMVRVVASK

SEQ ID NO: 3641 - protein, 185 aa, Arabidopsis thaliana
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKF

SEQ ID NO: 3642 - protein, 133 aa, Oryza sativa
MAAAVSACSSRCLRLILGRPPRARLASVVEVVEKRRRGGLVAVAATEGSAKSSGEADEQVPSWARPGSDEPPPWAREGGGGGGQQEPGAVELPFFAYLLASAITAIAAGFLWFKAVQTANKEAEEQDRRDGFS

SEQ ID NO: 3643 - protein, 392 aa, Streptococcus thermophilus CNRZ1066
MVFSVKTYNNINQIGLKELGNHFQIDGDLAENPDAYIIRSQNLHDTVFPENLKAIARAGAGTNNIPVDKATEKGIVVFNTPGANANAVKEAVLASILLSARDYIAANTWVNKLSGDDVPKQIEAGKKQFAGSEIAGKTLGVIGLGAIGARIANDAYRLGMKVYGYDPYVSIEAAWNISHHVKRVSDLKEIFENCDYITVHVPLTPDTKGTFNADAFSLMQKGTTIINFARAELVENDALFDALETGVVKRYITDFGTEELLNKPNVTVFPHVGGSTGEAELNCAIMAAQTIRRFMETGEIVNSVNFPRVQQVLSAPYRITLINKNVPNIVARISTAVSDFNINIDNIINRSKGEYAYTLLDLDETDKSKIDELVAKFEASDNIVRVRLIKGK

SEQ ID NO: 3644 - protein, 227 aa, Mannheimia succiniciproducens MBEL55E
MELVFIRHGLSEWNALNLFTGWRDVNLSEKGVEEAKEAGRKLKAAGFEFDIAFTSVLTRAIKTCNLVLEESNQLWVPQIKTWRLNERHYGGLQGLNKAEAAAEHGDEQVRIWRRSYDVLPPVLDPKDPNSAHNDRRYAHLPADVVPDCENLKVTLERVLPFWEDQIAPAIKAGKRVLVAAHGNSLRALAKHIEGISDADIMDLEIPTGQPLVYTLDDNLKVVSKRYL

SEQ ID NO: 3645 - protein, 327 aa, Debaryomyces hansenii CBS767
MAKAARKKFSTSSDPTGSTVSAEKHLNSVFKFNTNLGQHILKNPLVAQGIVDKAGIKPSDIVLEVGPGTGNLTVRILEQARKVIASEMDPRMAAELTKRVHGTPNQKKLDILLGDFIKTELPYFDVCISNTPYQISSPLVFKLLNQPRPPRVSILMFQREFAMRLLARPGDSLYCRLSANVQMWANVTHIMKVSKNNFRPPPQVESSVVRIEVKVPRPNIDFNEWDGLLRICFVRKNKTIAAGFKSNNILDILEKNYKTFLSTANAAANGDDSMMVDDKSSMTDIVKAKIEQVLTETGFSDKRAAKLDQTDFLKLLYAFHQVGLHFA

SEQ ID NO: 3646 - protein, 330 aa, Oryza sativa (japonica cultivar-group)
MACHISARSRYENYHEIYGGEVESRTSNYADLANKYYDLVTSFYEYGWGESFHFGSRWQGETLRESLKRHEHFLALQLGLKKGMKVLDVGCGIGGPLREIARFSSASVTGLNNNAYQISRGKELNFSVGLSETCNFVKADFMNMPIPDATFDAAYAIEATCHAPDAVGVYREICRVLKPGQLFALDEWCMTDKYDPGNSRHRSIKAEIELGNGLPDIRTTKQCIQALKDAGFEVVSVKDLAEDSPLPWYLPLDSSQFSLNGFRLTRVGRFITHMLVKTLECLHVAPQGSLRVSSFLETAAEGLVKGAKEGIFTPIFFVLARKPLDKQPEI

SEQ ID NO: 3647 - protein, 148 aa, Solanum tuberosum
MASKRILKELKDLQKDPPTSCSAGPVAEDMFHWQATLIGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 3648 - protein, 400 aa, Glycine max
WPSVFFSTTYICCGTQNPNTFICCADESKFVRVSFQLEKNCNFGEQFLIVGDDPVLGSWDPLEALPMTWFEGHVWAVELDMPAGKSFQFKFILKGKGGDIIWQPGLDRMIHTWETMNRIIVLEDWENAELQKIIEEDQLAEPNEEPQVDLEVPTLAETLENPQEELDSNASEISAVEDTQIHAEEKPLAEPVMQQNTDTISSSIEKPMAIVAENISSSEDLINSTSHKSNKKNIILQPKEESADSPGNDDIIHDLGHNGNAASLENQEKTIVESSLFDLEGGPVLVPGLIIEPTEPTDQAGQSEVQEMTNTDTSVGAFETQDQNIPEFSKEQETDDATPREINADINNGQELLYNEQESHLSPEMEGMPNYEQDDDNPLQNDIKWGQETVKKFLTKLGFL

SEQ ID NO: 3649 - protein, 655 aa, Ustilago maydis 521
MPLAQSKNTVGLGRAILNRKAKEAKQRNQTEFHTTDINNYGSVSNLRSVTHQGDLEEFLNTASLADADFTAERRNGGVTIITAPDRERTRHNPYLLTGQEEQEVLKKHVQNKERLRVPRRPEWTSATTRAQLERAEKDGFLEWRRGLAELQEGVGLVLTPFERNLEVWRQLWRVIERSHLVVQIVDARNPLRFRCEDLEKYVSSLGIGSTNGIEYLGEHSAEKGPRRNLLLINKADLLDDEQRKYWADYFDAQGIQYAFFSAANAAAIQLARAEEEERLRLEQLKLAEPQDDDDDDDEDDEDDEEEEEEEEEKHVDGELEASSAAADETAKDAKSLIGQEASDRVLDHSQDAVRDSLVAEKTSAQDNTVDTAAAAAAMPATHDPTRVLNVLELEELFMACAPSLDDFAIDGQPAPSKLVVGLVGYPNVGKSSTINALLGEKKVSVSSTPGKTKHFQTIHLSPTTVLCDCPGLVFPQFATTSAELVCDGVLPIDQMREYTAPAELVAKRIPKDIVEGTYGIRIETLTEEEGGNGVPTGLEMLTAYAVARGYTRQGQGNPDESRAVRYVLKDYVNAKLLYSHPPPGIDADLYNAAQRERARAALAGRKYNASTAANLAEYADATSGAADMDDLDADLQTELAALTKRQGSGSRTTVR

SEQ ID NO: 3650 - protein, 303 aa, Vibrio halioticoli
GRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKVVSWYD

SEQ ID NO: 3651 - protein, 529 aa, Pseudomonas syringae pv. syringae B728a
MPFPCTLFISLSNQHRVGSMTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 3652 - protein, 377 aa, Pseudoalteromonas tunicata D2
MENQFIKSKAAIAWGPNQPLSIEEVDVMYPKAGEVLVKIIATGVCHTDAFTLSGQDPEGVFPAIMGHEGAGIVHAIGEGVTSVAIGDHVIPLYTPECGECKFCTSGKTNLCQKIRATQGKGLMPDGTTRFYKDGQPIFHYMGTSTFSEYTVLPEISLAKVNKTAPLEEICLLGCGVTTGMGAVMNTAKVKAGDTVAIFGLGGIGLSAIIGAQMAGASQIIGVDINPSKFELAKKLGATLCINPKDYDKPIQEVIVELTDGGVDFSFECIGNVDVMRSALECCHKGWGESVIIGVAGAGQEISTRPFQLVTGRVWRGSAFGGVKGRSELPHIVERYLAGEFKLDDFITHTMALEQINEAFDLMHSGESIRSVIHFDHK

SEQ ID NO: 3653 - protein, 295 aa, Vibrio halioticoli
RIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFV

SEQ ID NO: 3654 - protein, 238 aa, Ureaplasma parvum serovar 3 str. ATCC 700970
MKYIIANFKMNATQELINHFLNNLTLFDEQKIIIGLAPGDLYLKTFVNLAEIKKVNLYAQNPSLHNKGPYTGQISCLQLLDINIKNALVGHSEIRIDFSQSIIDQKIKISMDLLEQVIICVGETFDAYKQNKSLNFVLNQLANIINYKGLKKIIIAYEPIWAIGTDLELDFKHINYMIEGIKTYLYNCTGINIPILYGGSVNDNNINELCNQKLIDGFLIGNASLDVNVFNKIIDKCK

SEQ ID NO: 3655 - protein, 493 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEVQVRKSDGISKGAYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKNILLDRGGQLKISGFGMIRLSKISQDKAKVANHKAHIDLSSKENASFTCMKTESLDYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPW

SEQ ID NO: 3656 - protein, 459 aa, Ralstonia eutropha JMP134
MSANSEHLQRGLGERHIRLMALGSAIGVGLFLGSANAIRMAGPAIMLAYLIGGAMIFLIMRALGEMAVHNPVAGSFCRYAQDHMGPLAGYLTGWNYWFLWLVTCVAEITAVAIYMGVWFPDVPRWIWALAALATMGSVNLLTVKAYGEFEFWFAMIKIVTIVLMLFGGGAMIVFGLGNGGIATGISNLWAHGGFMPNGASGVLMSLQMVMFAYLGVEMIGLTAGEAKNPRKSIPDAINSVFWRILIFYVGALFVILSLYPWNEIGAQGSPFVMTFERLGIKTAAGIINFVVLTAALSSCNGGIFSTGRMLYNLAQQGQAPAAFARVDRNGVPRRALLVSIGALLCGVLLNYLVPEKVFVWVTSISTFGAIWTWAIILVTQMQFRKNLSPAERDKLAFRMPFWPYGSWIALAFLALVIALMAYFPDTRIALYVGPAWLVLLTVLYYRLGMQARGPVTYQA

SEQ ID NO: 3657 - protein, 502 aa, Ureaplasma parvum serovar 3 str. ATCC 700970
MKLNKKIGLIIIDGLGIGKEDNTNAVHLANPPTLNYLINNFPTLQISAAQQNIGLLENQAGNSEIGHLTIGAGRIILNDNANINNYMKSVDYESAVLSNIKNEIVHIVGMYSNGLVHSNYEHIHWIIKQIIKNNNQVVLHLISDGRDDYPYGFAQFIEQINALKKQYNIIVKSLSGRYFAMDRDQRWERTQKAFNAMFVKQDKICEKTFLEVAQSIANSYKSDEFVQPVVFNDDEKYNLKPHQKVILANYRSDRMRQLAHLLKPNKKFHYNNPFLVQDVNLITLVPFPDVDAIALFEKQNLNNTLGDVFNKHQIKEARIAETEKYAHISFFFDGGVNKYYSTKTQYLIPSQKVATYDLCPQMSAHLITKTIIDHYFDHDVFIVNYANPDMVGHSGNMQQTIEAILSVDHEIRKLYDFFEKNNGVLMITGDHGNAEMMLDDQKQVITSHSVNDVWFIITDNKVILNSTQKFSLANIAPTILEYLNIAQPIQMTATSMIKKICE

SEQ ID NO: 3658 - protein, 300 aa, Vibrio neonatus
GFGRIGRFVFRAAQERNDIEVVGINDLIDVDYMAYMLKYDSTHGRFKGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKV

SEQ ID NO: 3659 - protein, 509 aa, Bifidobacterium longum NCC2705
MSRLALVDWVSANGAIAPRTKLNKNRQAFMRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMVYTDKVLKDAGKVADGDKIVILSSAQGDHQPGRTDSIYVHTVGACD

SEQ ID NO: 3660 - protein, 1037 aa, Flaveria pringlei
MERARRLANKAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMVTDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFAAGLKKLGTVQVQDLPFFDTVKVTCVDSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVATGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDLNNNVIKGAPHPPQLLMADKWTKPYSREYAAYPAPWLRAAKFWPTTCRVDNVYGDRNLICTLQPPQEYEEKAEATA

SEQ ID NO: 3661 - protein, 276 aa, Magnetospirillum magnetotacticum MS-1
MIDRSDPQWYRDAIIYQIHVKSFFDSSNDGIGDFEGLTQKLDYVRDLGVTAIWLMPFYPSPLRDDGYDIADYRDINPSYGTMDDFRRFVDAAHERGLRVITELVINHTSDQHPWFQRAREAPAGSPERDFYVWSDTDDKYSDTRIIFLDTEVSNWTWDPVAKQYFWHRFYSHQPDLNFDNPAVLEAVIEVMRYWLDMGVDGLRLDAIPYLIERDGTNCENLAETHTVIKAIRAALDAEYPDRMLLAEANQWPEETAQYFGDGDECHMAFHFPLSSV

SEQ ID NO: 3662 - protein, 410 aa, Arabidopsis thaliana
MNCLFLFKSKKPRKQQKDNNKNKRKGKELLQNSAPELTNRSETSSFNLQTPRSLPSPRSIKDLYTEREQNLRVFSYEELSKATYVFSRKLVIGEGGFGIVYKGKILSNGDSSDPPLVVAIKKLNRQGLQGHKQWLAEVQFLGVVNHPNVVKLIGYCSEDGETGIERLLVYEYMSNRSLEDHLFPRRSHTLPWKKRLEIMLGAAEGLTYLHDLKVIYRDFKSSNVLLDDQFCPKLSDFGLAREGPDGDNTHVTTARVGTHGYAAPEYVQTGHLRLKSDVYSFGVVLYEIITGSRTIERNKPVAERRLLDWVKEYPADSQRFSMIVDPRLRNNYPAAGARSLAKLADLCLKKNDKERPTMELVVERLKKIIEESDSEDYPMATTTTKESSQVRRRQVAKPEKQSLRGVSVRG

SEQ ID NO: 3663 - protein, 221 aa, Pichia pastoris
SWTKEFYLDQVHRPRHYGKGSAPLFGNFLEPLSMTAWWIVPMVWLPVNFYFFYIGFTNQNKLVAMAFWLLGLFVWTFLEYALHRFLFHLDYYLPENQIAFTIHFLLHGIHHYLPMDKYRLVMPPTLFIVLCYPIKTLVFSVLPYYMACSGFAGGFLGYIMYDVTHYVLHHSKLPRYFQELKKYHLEHHYKNYELGFGVTSKFWDKVFGTYLGPDDVYQKTN

SEQ ID NO: 3664 - protein, 439 aa, Pyrococcus abyssi GE5
MNVSEVKSGATRSPKFVQLIFVDINGMPKGMEIPASRLQEAIEDGISFDGSSVPGFQGIEDSDLIFKADPDTYVEVPWDNVARVYGYIYKDGKPYGADPRGVLKRVIEKLAEMGIKAYIGPEPEFYLFKKNGSWELEIPDVGGYFDILTLDKAKDIKREIAEYMPSFGLVPEVLHHEVGKAQHEIDFRYDEALKTADNIISFKYIVKAVAEVHGLYATFMPKPIYGMPGNGMHLHISLWKEGENIFKGEEGLSETALHFIGGLLKHAKALTAITNPTVNSYKRLVPGYEAPVYISWGYKNRSALIRVPAFWGNGARIEYRCPDPSANPYFAFAAILMAGLDGIKHKVEPFAYVEENVYEMDEGKRKELGIDTLPGSLGEALDELEKDKVVREALGEAYKNFIEYKRKEWESYLEYLEAKHLPKDTKRVTEWELERYFFI

SEQ ID NO: 3665 - protein, 227 aa, Glycine max
LCRYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 3666 - protein, 276 aa, Rhodospirillum rubrum ATCC 11170
MARIERTALLETFHEMVRQGRPIVGGGAGTGLSAKCEEQGGIDLIVIYNSGRYRMAGRGSLAGLLAYGNANEIVMDMAREVLPVVRHTPVLAGVNGTDPFCNFDHFLDQVKAVGFSGIQNFPTVGLIDGTFRANLEETGMGFGLEVDLVRLARAKDLLTTPYVFSEDDARAMTEAGADIVVAHMGLTTGGAIGAETALSLHGAAERVSAIAQAAIAVRPDVIVLCHGGPIATPEDAQFILETCPQCHGFYGASSMERLPTEIALTEQTKRFKAISR

SEQ ID NO: 3667 - protein, 328 aa, Burkholderia sp. 383
MHAWSARHVPAQGGKVAVVTGANSGLGWQLAETLAAKGATVVMGCRDAARAAQAADAIRRLHPDARVEVDPLDLADLASIARFAADVAERHGRVDILCNNAGVMFLPLRHTHDGFEMQFGTNHLGHFALTGHLLPALRAARRARVVTMSSGLNRGGRIRVDDLRAEHRYNRYLAYCDSKLANLVFAIELQRRFERAAFAGISVAAHPGYAATNLQFAGPAMDSSPARAALMRAANRYLAQPADQGALPAIHAATSPDLAGGAYIGPSGLFESRGLPAPASVPRAARDVASAALLWEASEAATGVRFLSSGAPAGRSPGRPFDTAAEVR

SEQ ID NO: 3668 - protein, 406 aa, Rhodospirillum rubrum ATCC 11170
MGKRLYIVGTRDTKNDELVYVRDQITQTGARAVIVDLSTSGPETFADGVAAAEVAAAHPEGAKAVFTGDRGRSIAAMAVAFESYLTGRDDIAGVIGLGGSGGTALIAPALRGLAVGVPKLIVSTVASGNVAPYVGPSDIAMMYSVTDLAGLNRISRLILANAAHAIAGMAKAPPVPLSASDKPVIGLTMFGVTTPCVNALTAALGDAYDPLVFHATGTGGQSMEKLVESGLIAGVIDITTTEVCDLLMGGVLACTEDRLGAIARTGVPYVGSCGALDMVNFGAPDTIPERYAGRTFYAHNPQVTLMRTTVEENVRMGRWIGEKLNACEGEVRFLLPEGGVSALDVPGMAFHDPEADAALFASLEATVRPTGRRQLIRVPAAINDPAFAEAVLTTFKGLMSSSNHDA

SEQ ID NO: 3669 - protein, 256 aa, Shigella flexneri
RFGQNFLNDHFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENAP

SEQ ID NO: 3670 - protein, 470 aa, Bacillus subtilis subsp. subtilis str. 168
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 3671 - protein, 537 aa, Streptococcus pyogenes MGAS315
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDFYIWRDEPNDLTSIFSGSAWEYDNASGQYYLHLFSKRQPDLNWENEALRHKIYDMMNFWIAKGIGGFRMDVIDLIGKVPDSEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDEEQVFAKDLAGAQVIIANTDVDTVLETKHLQPWDAFCLKLKA

SEQ ID NO: 3672 - protein, 339 aa, Haemophilus influenzae 86-028NP
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDAEAGIALTDSFVKLVSWYDNETGYSNKVLDLVAHIYNYKG

SEQ ID NO: 3673 - protein, 503 aa, Rhodococcus sp. RHA1
MSRCVSIPQKGQHLMSTTHSAASARGSGGAARNERSHKRFLTKLTVISTLGGLLFGYDTGVISGALLYMKDELNLSAVGEATVVSSLLFPGAAVGALLGGRLSDALGRKRTLLVCAGLFLIGALGCAMAPNVEIMVLARIVLGLGVGAAAVTCPLYLAEMAPVERRGRMVTINELMIVTGQMLAFSINALLDHLIEDPTVWRYMLAIASVPAVLLLLGMLALPDSPRWYASKGRLAETRSTLELSRSESEAAVEYASISLHAARDRNSKVSGAVHYLRDYPWMRRILWIGCGLAIVQQATGINTVNYYAPTILEQSGLGVSASLVATIAVGVTSVVMTILGIILLGFVNRRKMLLTGFIGVASSQAALSLVFLLPSSTGRSYIILAAMMVFVAFVQCFIGTCVWLLLSEIFPMAIRGFAMGIAVFVLWTTNALISFVFPILNSVLGSTGTFGLFVLVNLISVYFVYRFVPETKGRSLEELEDRLGAGRPDASAAGSTAAVAAH

SEQ ID NO: 3674 - protein, 256 aa, Shigella flexneri
RFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQDCQMANYLAENAP

SEQ ID NO: 3675 - protein, 318 aa, Streptococcus suis 89/1591
MKTYQKIYLLLKEREDYVSGEDLAQELGISRTSIWKAIRQLETHGLTIEAARNRGYRLAEGDLLLPELISQELQLPVHLNMDSDSTQLDAKQGIESGHTSPALYLAPYQNKAKGRFGRPFYASKSGGIYMSLRLSPNVPFLEFKPYTILAAAAVVKAIQSLCDLDVQIKWVNDIYLGHKKVAGILTEAISSMENQRVTDVIIGVGINVRIDDFPKELQQSAGNLFEEQPPFTRNQLITAIWKAFLETDEKELIALYKEKSLVVGQQVSFVENQVEFKGTAIAVTDTGNLVIQLDNGKAKIISSGEISLTSWSASPPNE

SEQ ID NO: 3676 - protein, 255 aa, Salmonella enterica subsp. enterica serovar Paratyphi A str.
MRHPLVMGNWKLNGSRHMVNELVANLRKELAGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 3677 - protein, 441 aa, Rhodococcus sp. RHA1
MTVSSGDPDVHASRSAQLFERADLVIPGGVNSPVRAFHSVGGTPRFIKEASGYTLTDVDGNDYVDLICSWGPMILGHAHPAVVEAVQKAAATGLSFGAPTEGEIELAEEIVGRVAPVEKVRLVNSGTEATMSAVRLARGFTGRTKVLKFSGCYHGHVDALLADAGSGLATFGLPTSPGVTGAQAEDTIVVPYNDLDAVAQAFAANEGRIACVITEAAAGNMGAVAPQPGFNEGLRKLTSDNGALLIMDEVMTGFRVSSAGWFGLDGVAGDLYTFGKVMSGGLPAAAFGGRADVMAHLAPAGPVYQAGTLSGNPVAVAAGLASLRAADQGVYDALERNSATLRTLLSDALTAESVPHRVQTAGTMLSVFFSEDPVTNYAEAKAAQTWRFPAFFHGLLSRGVYPPPSAFEAWFVSAAMDDRAFSIIADALPHAAKAAAAAVQP

SEQ ID NO: 3678 - protein, 652 aa, Dechloromonas aromatica RCB
MSALSLVLLLLGASVLAVVICRRINLPPVLGYLFVGSVIGPHALNLMHDMHQAEYLAEFGVVFLMFSIGLEFSLPKLYAMKRIVFGLGLLQVVLSMALVAGLVMLFGVSWQLGIALGGVFAMSSTAVLTKLLAERMQLDSPHGREIMGVLLFQDLAVVPLLVIIPSLTEPPEKLAMLLGVALIKAIVVLAVILVFGQRLMRKWFHFVARAKSSEVFVLNVLLITLSLATITELAGLSLALGAFVAGMLISETEYKFQVEEDIKPFRDVLMGLFFVTIGVKLDLHILLGLWWQVLLALVALLVIKSLVVGVLSWRLGASPGNAIRSALWLCAGGEFGFVLLGEILHLPREIQQIALTVLVLSMLIAPFIVQYSERVVMRFVASEWLMRSMQLTKIAAQSMGSEKHAILCGFGRNGQYLARFLAQEDINYVALDQDPDRVREAAAGGENVVYGDAGRKEALMAAGLMRASVVIVTVSDTPLSEKILHHVQELRPDVPVIVRTADERDMERLTRAGAAEVVPEALEASLMLASHALVLVGIPINRVLKRVRQTRSKRYSLLRGYYRGMSDRDHDEEDEYQPRLHSVLLVSGSAAIGRTLDALNLDALGCEVSAIRRRGIRALEPAPETRLEEGDVVVLLGLPEVVMAAEERLLQN

SEQ ID NO: 3679 - protein, 256 aa, Shigella flexneri
RFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDIRVLSRITTEAFNQRRKTIRNSLGNLFSVEVLTGMGIDPAMRAENISVAQYCQMANYLAENAP

SEQ ID NO: 3680 - protein, 109 aa, Triticum aestivum
  misc_feature (81)..(81): Xaa can be any naturally occurring amino acid
  unsure (1)..(109): unsure at all Xaa locations
MAPTVMASSATSVAPFQGLKSTAGLPVSRRSNGASLGSVSNGGRIRCMQVWPIEGIKKFETLSYLPPLSTEALLKQVDYLXIRSKWVPCLRFKQVGSSSREHNASPGVL

SEQ ID NO: 3681 - protein, 175 aa, Triticum aestivum
MAPTVMASSATSVAPFQGLKSTGGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIDFKPPGCEESGKA

SEQ ID NO: 3682 - protein, 204 aa, Arabidopsis thaliana
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKVDFRCYSLFYYHGFHCILKKTQYFSTGDCKSPSNIR

SEQ ID NO: 3683 - protein, 301 aa, Vibrio neonatus
RFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKVVSWDDNE

SEQ ID NO: 3684 - protein, 298 aa, Vibrio ezurae
GFGRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFV

SEQ ID NO: 3685 - protein, 474 aa, Ureaplasma parvum serovar 3 str. ATCC 700970
MFSKTRIIATVGPATTKLFSNWLEFNDLNNINDAQQVCINIKDLILSGVNIFRMNLSHGDQKIHLFRTQLIKKIADELKIKVEILFDTKGPEIRVCEMSDNNFIIKNSEVIIHCKEKVLGSFNEFSVTDATGQYNMISDVKINHRILIDDGKLILIVKKIDFLKNIIYTTAKNSYSLKTNKRLNLPDANYSLPFLSKKDIDDINLAVKLKIPYLALSFISNIKQINEVKQLLKKSSFIPKLIAKIETQEAIDNLEEIIKNTDGIMVARGDLGLEVPFYKIPIYQNKIVELCHKYNKYCIIATQMLDSLERNIIPTRAEVTDVYYAVKQKVNATMLSGETAAGIDPINAVQVMKSIILETENNNIENEITFKKNELLIPKEVKLKILSFHKLKINKHKLLVVNLISKNSKHLVYDILKYDFNFNILFVIDKNQEHDLLLKNANFIISENKMLKQEELLKSFNIDFNNHEFLFISI

SEQ ID NO: 3686 - protein, 279 aa, Zea mays
MRCSSLPPVRLPAEDILFCVDVDLEARAEMKSAAAAAAASSGSTSTASPQPTQPAGAGGAPAAGPRTVVRRMDAVRQALLLFVHSKLTMCPEHRFAFASLGETFSMVKKGFSSDAGFAMEAIHSLSASETRYAMADLTQLFMTACQEGKRAESQGRILRVVLIYCRSSTKPQHQWPVKPKNFTLDIIYLHDKPNPDNCPQKVYDALVDVLEHVSQYEGYILETGQGLARVLFRQMCILVSHPLQRCMQDDLDIPKQVAKKIVAAEPAQNEDAAPVSGQQ

SEQ ID NO: 3687 - protein, 297 aa, Vibrio ezurae
VFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKLYLGTT

SEQ ID NO: 3688 - protein, 123 aa, Solanum berthaultii
MATSSEEGQVIGCHKVEDWEVQPQKGVETKKLVVVDFTASWCGPCRFIAPILADIAKKMHHVIFLKVDVDELKKVAEDWNVEAMPTFVFIKEGKEVDRVVGANKDGLLQTIEKHGAAPAIVTA

SEQ ID NO: 3689 - protein, 957 aa, Salmonella enterica subsp. enterica serovar Typhi
MTQTLSQLENRGAFIERHIGPDAAQQQEMLNAVGAESLNALTGQIVPKDIQLATPPQVGEAATEYAALAELKAIAGRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVAADVHPQTLDVVRTRAKTFGFDVIVDDADKVLDHQDVFGVLLQQVGTTGEIHDYGTLISELKARKVIVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQGMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHGSRNEGHRDICLIPASAHGTNPASAHMAGMQVVVVACDKNGNIDLDDLRAKAEQHAANLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASRLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 3690 - protein, 407 aa, Polaromonas sp. JS666
MKPITKSAKLANVLYDIRGPIMDAAKQMEEEGHHLIKLNLGNLAVFGFDAPEEIQQDMIRNLPSSAGYSDSKGIFAARKAVMHETQKQGISGVTLDDIYLGNGASELIAMATNALLDDGDELLLPTPDYPLWTASTSLSGGKPVHYLCDEDNGWMPNLDDIRAKITPKTKGIVVINPNNPTGALYSDELLKQIVEIARTHGLVILADEVYDKVLYDGAHHTAIASLSTDVLTLTFNSLSKSYRSCGYRAGWLVVSGPKKRAEDYIEGLNMLANMKLCSNVPGQWAIQTALGGYQSINDLTGEGGRLRRQRDLAYELITAIPGVSCVKPSAALYMFPKLDPKVYPIKDDRQFFLELLKETKVMLVQGTGFNWASPDHFRIVFLPHEEDLREAVGRIAKFLENYRNNNI

SEQ ID NO: 3691 - protein, 300 aa, Vibrio ezurae
GFGRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKV

SEQ ID NO: 3692 - protein, 420 aa, Sulfolobus solfataricus P2
MEKYIKDPIYGNIKVESKLIDNPYFQRLKHIIQNGMAYMIFPSMRHTRFEHSLGTYYIASKMIDRIEGNIDSDFKEIIKKLALYHDIGHFPFSHTFEFALDVLKYLNDDKYKEIIGLTEYKGQLHKFHEMMGIKILKDGLGEKEVADLMENVYTSSNPLDDKIKIAKLIVNSDLDADRLDYLQRDSYYSGAKFGIIDPERIIITMTITPKGYIFPPKAIDDLEHFFLARFHMYSSVYNHPVIEIYNRVMSYFIAFAIHKGLLKIPSNLEEIKTFTDEQVFLALINAKNDNELSHFYFSLVERRKYKRAVLQGSEARTLHKYLTEDEDAKEFYEYILGYKGKVVIGSTELKTSIDNIQIKEKLGKYEYLNNLKEESSVVKPPERFRVHIGVYDDNVAKEISEYFSKNFSITLDFRNLESNP

SEQ ID NO: 3693 - protein, 536 aa, Arabidopsis thaliana
MEDKNNDKEKKTDVTFEDDEDNEDLEDNSSKYENDSETDQSDLGDLPGDAVDRDDDIDEPFISQVQWPQSFRETTDSYTIAASPIFGSLRSNPPSFYRASRSNLDVESKAPLLPERHDDSDKASATQSAWSHKGSFAEELPIGGYGCSVIQTIFNAINVMAGVGLLSTPYTVKEAGWASMVILLLFAVICCYTATLMKDCFENKTGIITYPDIGEAAFGKYGRILICMLLYTELYSYCVEFIILEGDNLTGLFPGTSLDLLGFRLDSKHLFGILTALIVLPTVWLKDLRIISYLSAGGVIATALIAVSVFFLGTTGGIGFHHTGQAVKWNGIPFAIGIYGFCYSGHSVFPNIYQSMADKTKFNKAVITCFIICVLLYGGVAIMGYLMFGEATLSQITLNMPQDQFFSKVAQWTTVVSPFTKYALLMNPLARSIEELLPERMSENIWCFLLLRTALVASSVCSAFLIPFFGLMMALIGSLLSILVAIIMPALCFIKIMGNKATRTQMILSSIIVAIGVVSGTLGTYSSVAKIIRNYQ

SEQ ID NO: 3694 - protein, 436 aa, Mycobacterium sp. MCS
MSTDLAALAEKTGTKFILALFVDLRGKPCAKLVPVEAVEQLATEGVGFAGYAVGAMGQEPKDPDLMAIPDAASFTPIPFVKDGLAIVHCDPHVEGKPWPYAPRIILRSLIQQAADAGFEPWVGAEVEYFLLTRNADGSLATADAADTAAQPCYDARGVTRMYDHLTTISSAMNQLGWANYANDHEDGNGQFEQNFQFADALTTADRVITLRYLLSMIAAERGMVATFMPKPFGDRTGSGLHLHLSLTSGGTPVFPCESDERGLGLSDTAYSFIGGILDHACALQSVIAPTVNSYKRTGAVSTASGASWAPRSATFGGNDRTHYIRVPDAQRIELRGGDGSANPYLAVAAALGAGLDGIKRSADPGAVGAVAETRSTLPPTLLHAVEELEADPVVSGVLDAAGDGVARYFAGLKRHEFFDYHGTVSPWEVEQYLTAF

SEQ ID NO: 3695 - protein, 611 aa, Mesorhizobium loti MAFF303099
MAAETSGSDLIQVVALLAAGVVAVPIFKRMGLGSILGYLAAGVVIGPFGLRIFSESGAILHVAELGVVMFLFIIGLEMQPSRLWGLRREIFGLGALQVGVCAVLLTGVGMAGGFPVSQSFVAGAGFVLTSTAIVMQLLEERGEIASPKGQRIVSILLLEDLAIVPLLALIAFLAPGGADTSMSERLTEVGIGLAAIVGLVLAGRYLLNPFFRILADARAREVMTAAALLVVLGSALAMQLSGLSMAMGAFLAGVLLSESTFRHQLEADIEPFRGILLGLFFLAVGMSLDLHVVAANWRLIAVYVVAYMVMKALGIYIVARILKTGHREALERAVFMAQGGEFAFVLYSAAAAVGIIDNQANATLTAIVIISMVLTPLAIIALRYVTPRDEQSLDGVDVADGLTGSVLIIGFGRFGQIASQPLLLRGIDVSIIDNDVEMIQAAADFGFKVYYGDGTRLDILHAAGAGRARAVLICVDKADAAVRIVQLIKAEFPLLTVLARAFDRGTALQLIRAGVDYQLRETFESALVFGGSALESLGVDPEDVAETIEDVRRRDTERFETQLAEGIRAGQRFLRGNIGTPIPTPLSTPRRPGQALNEETAGVLHKSETAD

SEQ ID NO: 3696 - protein, 431 aa, Vibrio fischeri ES114
MTKSAELFAKAQDKIPGGVNSPVRAFAGVGGSPIFVERADGPLIFDADGKAYIDYVGSWGPMILGHNHAAIREAVISAAQRGLSFGAPTETEITMAELVSELVPSMEQVRMVSSGTEATMSAIRLARGYTGRDKIMKFEGCYHGHADSLLVKAGSGALTLGQPSSPGVPADFAKYTLTATFNDLDSVRELFAVNKGEIACIIVEPVAGNMNCIPPVEGFHEGLRQICDEEGALLIFDEVMTGFRVAENCAQGYYNIKPDLTTLGKVIGGGMPVGAFGGRKEVMQYIAPTGPVYQAGTLSGNPVAMAAGFACLKVLTEEGNEKRLADTTRHLANGFKELANKHGIPMVVNQVGGMFGFFFTDQETVTSYADVAKCDIERFKRFFHLMLKKGVYLAPSAFEASFTSLAHGPKEIEATLEAADQCFAIIASEAK

SEQ ID NO: 3697 - protein, 166 aa, Zea mays
  misc_feature (116)..(117): Xaa can be any naturally occurring amino acid
  misc_feature (156)..(156): Xaa can be any naturally occurring amino acid
  unsure (1)..(166): unsure at all Xaa locations
AGAPTAPDKTQTTSAAPLSQSPQWRAPSFMIKPDGVQRGLIGEIISRFEKKGFYLKALKLVNVERSFAEKHYADLASKPFFQGLVDYIISGPVVAMVWEGKSVVTTGRKIIGATNXXASEPGTIRGDFAVDIGRNVIHGSDSIESANKEIALWFPXSSQHPWIYEK

SEQ ID NO: 3698 - protein, 134 aa, Glycine max
MFLRRILSGGGGLAAMRSARAVKETTGIVGLDVVSEARDVLIGLYTRTLKEIEAVPKDEGYRKAVESFTRYRLQICQEEEDWKRIEDRLGCGQVEELIEEAEDELKLIGKMIEWDPWGVPDDYECEVIEDDAPI

SEQ ID NO: 3699 - protein, 236 aa, Solanum tuberosum
MDDWDQETLEKVVASKSQEYNKNKPTDIVCKFFLDAVEKKQYGWFWACPNGKECHYRHALPPGYILKSQMKALLQEEADKMPIEEEIDEQRAKLTASTPLTTELFMEWKKKKMEEREASLAKQRADRAKNDRMSGRELFMSDASWFVDDVGAYDQYDREEESAELPKENKDSAKEEASSSTSAQKNIDDGGEAPPKDQVDDIYDDDDDDFDVDELNELEASLSKTSLQINEPGSRA

SEQ ID NO: 3700 - protein, 137 aa, Triticum aestivum
  misc_feature (49)..(49): Xaa can be any naturally occurring amino acid
  misc_feature (117)..(117): Xaa can be any naturally occurring amino acid
  unsure (1)..(137): unsure at all Xaa locations
MASSYEIFIAFKANVGQCALADPIISRSKNRGFKIAGITLMTPGKEHLXKHYADLAGKAFFAVLIENMNSGPICAMYCHVRRFVNTDRSILEATNPLASSPVIILGDYAIDDSRNVXHGSHSIENAQKDIVLWFKEG

SEQ ID NO: 3701 - protein, 447 aa, Streptococcus thermophilus
MAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFVSQWEIDNYLDLY

SEQ ID NO: 3702 - protein, 69 aa, Arabidopsis thaliana
  misc_feature (29)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (47)..(51): Xaa can be any naturally occurring amino acid
  misc_feature (54)..(54): Xaa can be any naturally occurring amino acid
  misc_feature (57)..(57): Xaa can be any naturally occurring amino acid
  misc_feature (66)..(66): Xaa can be any naturally occurring amino acid
  unsure (1)..(69): unsure at all Xaa locations
MASSMLSSATMVASPAQATMVAPFNGLKXSAAXPAXRKANNDITCIXXXXXRVXCMXGWPAIGKKXGRL

SEQ ID NO: 3703 - protein, 587 aa, Trichodesmium erythraeum IMS101
MELQNYLRRTKIVATIGPATIKPDVLRELIKAGATTLRLNFSHGTHEDHQNSIRLIRQTSFELNQTVAILQDLQGPKIRLGKFETGSISLEDGDPFILTSHLKLGTQKISSVTYEPLADEVPEGAKILLDDGKVEMLVEKVDKTEKELHCRVVVGGTLSNNKGVNFPGVYLSIKALTDKDRKDLMFGLDQGVDWVALSFVRNPQDVIEIKQLIANAGKKVPVIAKIEKHEAIEQMEEILALCNGVMVARGDLGVELPAEEVPLLQKRLISTSNRMGIPVITATQMLDSMVNNPRATRAEISDVANAIIDGTDAVMLSNETAVGKYPVEAVTTMATIAKRIEQEVITCNVSSMNDTGHSIPNAISHAVSQIAQELDAAAIMSLTKTGATARNVSKFRPKTPILAVTPHVDVARQLQLVWGVKPLLVLDLPSAGQTFQSAINVAQENELLVDGDLVVMTAGTLQGIAGSTDLIKVEVVTAVLGQGTGVGQGSVSGRARVARNSTEVRDFNHGEILVVNQTNAEFVEAMQKASGVVTEEDSVTSHAAVIGLRLGLPVIVGVKNATNVVRDGTILTLDAQRGMVYSGTNRR

SEQ ID NO: 3704 - protein, 308 aa, Vibrio superstes
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKVVSWYDNQV

SEQ ID NO: 3705 - protein, 304 aa, Vibrio superstes
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKVVSWY

SEQ ID NO: 3706 - protein, 623 aa, Arabidopsis thaliana
MSGIFRFSGDEDCLLGGSMYLSPGSCPGVYYPARKRLRVAATSFYSGFEEKQTSIDVLPEECLFEILRRLPSGQERSACACVSKHWLNLLSSISRSEVNESSVQDVEEGEGFLSRSLEGKKATDLRLAAIAVGTSSRGGLGKLQIRGSGFESKVTDVGLGAVAHGCPSLRIVSLWNLPAVSDLGLSEIARSCPMIEKLDLSRCPGITDSGLVAIAENCVNLSDLTIDSCSGVGNEGLRAIARRCVNLRSISIRSCPRIGDQGVAFLLAQAGSYLTKVKLQMLNVSGLSLAVIGHYGAAVTDLVLHGLQGVNEKGFWVMGNAKGLKKLKSLSVMSCRGMTDVGLEAVGNGCPDLKHVSLNKCLLVSGKGLVALAKSALSLESLKLEECHRINQFGLMGFLMNCGSKLKAFSLANCLGISDFNSESSLPSPSCSSLRSLSIRCCPGFGDASLAFLGKFCHQLQDVELCGLNGVTDAGVRELLQSNNVGLVKVNLSECINVSDNTVSAISVCHGRTLESLNLDGCKNITNASLVAVAKNCYSVNDLDISNTLVSDHGIKALASSPNHLNLQVLSIGGCSSITDKSKACIQKLGRTLLGLNIQRCGRISSSTVDTLLENLWRCDILY

SEQ ID NO: 3707 - protein, 410 aa, Salmonella enterica subsp. enterica serovar Typhi
MAKVSLEKDKIKFLLVEGVHQKALESLRAAGYTNIEYHKGALDAEQLKASIRDAHFIGLRSRTHLTEEVINAAEKLVAIGCFCIGTNQVDLNAAAKRGIPVFNAPFSNTRSVAELVIGELLLLLRGVPEANAKAHRGVWNKLAAGSFEARGKKLGIIGYGHIGTQLGILAESLGMHIYFYDIENKLPLGNATQVQHLSELLNMSDVVSLHVPENASTKNMMGAKEIALMKPGSLLINAARGTVVDIPALCDALATKHLAGAAIDVFPTEPATNSDPFTSPLCEFDNVILTPHIGGSTQEAQENIGLEVAGKLIKYSDNGSTLSAVNFPEVSLPLHGGRRLMHIHENRPGVLTALNQIFAEQGVNIAAQYLQTSARMGYVVIDIEADGDVAEKALLAMKAIPGTIRARLLY

SEQ ID NO: 3708 - protein, 219 aa, Salmonella enterica subsp. enterica serovar Typhi
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQNVVTDNGNVILDVYGMEILDPIALENAINAIPGVVTVGLFANRGADVALIGTPDGVKTIVK

SEQ ID NO: 3709 - protein, 90 aa, Triticum aestivum
MGRRGEPYYVEAAPPVDVNKNTEWFMYPGVWTTYILLLFFAWLLVLSVSGCSPGAAWTVVNLAHFAITYHFFHWKKGTPFAADDQGIYSR

SEQ ID NO: 3710 - protein, 300 aa, Vibrio gallicus
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKV

SEQ ID NO: 3711 - protein, 674 aa, Coccidioides immitis RS
MVLPKSRNAVGLGNSLMNDRFGKGKASDRKKVSYNAAAIRRTGPGGETYITNPTEEASWVKMRSITEQAALDEFLSTAELAGTDFTAEKMNNVKIIHPDQKNPYLLSAADERTAVSKHQRNKNRLTVPRRPKWNSKTTRQQLDIMERENFIEWRRGLAELQENQDLLMTPFERNIEVWRQLWRVIERSDLIVQIVDARNPLLFRSEDLEKYVKEVDPKKRNLLLVNKADMMTPHQRELWADFFESQGISYKFFSAALAKEQNEAKLDEEVEDDASVIANLVKRTSKAALDDSEGNSEDDDSETDESGGIPLPADPSESRIRILSVDELESLFLEAAPTPDPQIDGSESSKKVTTIGLVGYPNVGKSSTINALLGAKKVSVSATPGKTKHFQTLHLSPTLVLCDCPGLVFPNFATTKAELVINGVLPIDQLREYTGPAGLVAQRIPKHFLEAIYGMKIHTRPIEEGGTGIPTSSEVLRGYARARGFATTGQGQPDESRAARYILKDYVNGKLLYCHPPPPIADSVPLDPTQFNQGLYDLAHLPPKRQAALLNQSSSASVSGFTDSNDVDTNSDVMSLSSAQPPFEGARSRNVDAGFFTAGGSGSAGHLKMPFNHVYTEQGAKQRHKELSGRKVRTMIALEKGVDVSEVQTSGKKHFKGGKRKAKAKGNTKDADDF

SEQ ID NO: 3712 - protein, 358 aa, Angiococcus disciformis
MGRGLQPLPPDAPHPRPARCEGRRWQGLGAHGQPHLRPRRGESGPGRCRDGSHREGTHPPQSRSYLAMTADSMDATVPSRRPALGFIGGGVMAEALIGAVTGGGLAAPGTLLVGEVDEERRRVLREQYGVEVTADNLAAADAELVVLAVKPQHLGVVLQQLRGQLREDTIVVSIIAGARLQTLCEGLEHPLVVRAMPNTPARVRKAATFWIPSAGLSEPALVRVRSLLGALGTEVEVADEAGVEMATGLAGPMPAFVYFLIEAFIDAGVALGLPRDQATLATVESMRGSLELLHRSQESPAALRKQVTSPGGATLAGLKVFESAGVRDAMDAAVRAVHARAQELGRLPLAPLEPGKEG

SEQ ID NO: 3713 - protein, 135 aa, Yarrowia lipolytica CLIB122
MSSGGKSGGKAASSSKTSKSRSAKADLTFPVGRVHRLLRKGNYAQRIGAGAPIYLAAVLEYLAVEILELSGNAARDNKKSRIVPRHLQLAIRNDEELNKLLGHVTIAQGGVLPNIHQNLLPRKSAKGAKGASQEL

SEQ ID NO: 3714 - protein, 450 aa, Glycine max
KATNVVLSKIKNFDPENASKIMGYLLMNLEESELIRLACSPDPVLHTLVLRVKNHLSGLTLSSTTPSSPSLPPSPLNPTARLTAISSNPFSRGGGPTNGFDFTRNHPSSPSSHSHAWNFPNNNPISPKSTPLFSYDNIRALSPRVVNDDCGDFVDEQQVNEYFPFLNDSSKNEDLVDPRLEFGVGAQNWHSGDSHLQHRRSYSASDVGFGCDEAAAAAPGLGYKPCLYFARGFCKNGTNCKFLHGAFTDSLDAIVGSPSKQLEGMEQREEFVRFNKAPQLQRIASGPSAAAREKYYEFLMQESQRAAAAFMMGEEFYNFGWDRPERNDFLAAISGEKPNSASRQIYLTFPAESTFKDEDVSEYFSKFGPVQDVRIPYQHKRMFGFVTFVYPETVRLILSKGNPHSICDSRVLVKPYKEKGLVPDKRQQQRQQQLERGDLSPCLSPSGFGS

SEQ ID NO: 3715 - protein, 156 aa, Triticum aestivum
MDVSGAAAKGKKGAAGRKAGGPRKKSVTRSVKAGLQFPVGRIGRYLKKGRYAPRVGTGAPVYLAAVLEYLAAELLELAGNAAKDNKKSRIIPRHLLLAVRNDEELGKLLAGVTIAHGGVIPKINPVLLPKKTAEKEGKEPKSPKKAAKSPKKATKA

SEQ ID NO: 3716 - protein, 359 aa, Triticum aestivum
  misc_feature (61)..(61): Xaa can be any naturally occurring amino acid
  misc_feature (146)..(146): Xaa can be any naturally occurring amino acid
  misc_feature (170)..(170): Xaa can be any naturally occurring amino acid
  misc_feature (180)..(180): Xaa can be any naturally occurring amino acid
  unsure (1)..(359): unsure at all Xaa locations
LFFADRFCSFALSAWFGAHTGKIKIGINGFGRIGRLVARVALQSDDVELVAVNDPFITTEXMTYMFKYDTDHGHWKHSDIKLKDDKTLLFGEKPVTVFGVRNPEEIPWGEAGADYVVESTGVFTDKDKAAAHLKGGAKKVVISAPXSKDAPMFVVGVNEDKYTSDVNIVXSNASCTTNCXLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 3717 - protein, 271 aa, Rhodococcus sp. RHA1
MTRIAVIGGGKIGEALISGLLQAGHAVKDLVVAEQHPARADELAAAYAVRVTTPSDAAEGADVIVIAVKPGDVEAALTEVSKVELDGEREQLLVSLAAGIPTAFYETRLPAGFPVVRVMPNTPMLVGEGVSVLAPGRHVKKEHLELVRGVLSSVGKVVVVPESQIDAVTAVSGSGPAYFFLVAEAMIDAGVGLGLTRATASELVVQTMVGSAAMLDRSGESATELRAAVTSPGGTTAAAIRRLEGNGLRTAFFDALEAAKIRSAELGTSTE

SEQ ID NO: 3718 - protein, 377 aa, Picea rubens
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYSFTTTAEREIVRDVKEKLAYVALDYEQELETAKSSSSIDKSYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 3719 - protein, 367 aa, Malus x domestica
MGKGGQSCNGVVRDAKPVEQENMAVWLVDVNTIKILPFKLPAIGPNDVRIRIKAVVICGSDVHYLKTMKCADFEVKEPMVIGHECAGIVDTVGSEVKHLVPGDRVGEPGISCARCQQCKGGRYNLCPDMKFFATPPVHGSLANQIVHPADLCFKLPENVSLEEGAMCEPLSVGVHACRRANVGPETSVLIIGAGPIGLVSVLAARAFGAPRIVIVDMDDKRLAMAKSLGADEAVKVSTKMEDLDDRVAEIKKAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 3720 - protein, 463 aa, Pseudomonas syringae pv. syringae B728a
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWVFTLVITLVLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPAVSKRTSKGGTPHWAVIMSTAAAFLTVFANYIAPAAVFDFLLASSGAIALLVYLVIAVSQLRMRQKRIAAGEAIDFKMWLFPWLTWAVIAFIVAVLTIMLLQEEHRLEIIATGVLSLLVIGAGMIVSRRRKDGRVGAAALG

SEQ ID NO: 3721 - protein, 302 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVVS

SEQ ID NO: 3722 - protein, 301 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVV

SEQ ID NO: 3723 - protein, 530 aa, Agaricus bisporus
PVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 3724 - protein, 303 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVVSW

SEQ ID NO: 3725 - protein, 303 aa, Vibrio gallicus
VGINGFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVK

SEQ ID NO: 3726 - protein, 145 aa, Ehrlichia canis str. Jake
MEIILLERTLSILKPDVVKRNITGQVNSYIENSGLKIVTQKMCLLTRFQAEEFYAIHKSQHFFIPLVDFMVSGPIIVQVLEGENAISLYRELMGATDPKKANPGTIRGDFAENIDANCVHGSDSLDNAVREIRFFFSDYELLSLK

SEQ ID NO: 3727 - protein, 857 aa, Coccidioides immitis RS
MRGRWSFVCFDIDFSVLNVLILLFLLPLLVAENGDFQGRRHQPQPGGDVWSMDHGYAASCPVRDFVDVQAEYVRYPVCLGSRRASSSAPDGMTESASVATERTSEAPTASSAETVSTPKVESELDTESPLDNEKFLSFEEWKKKNLAKIGQSVDNVRGNRQAVGSTEMRKRSRPGEISNALDSLGEEGEIELGFGGFGPGDSDIPPVETKDAKSTSSSVNGEKHVTKGTEGESQSDGVPRRGIARRKDAGVTCKERFNYASFDCAATVLKTNRECTGSSSILIENKDSYMLNECRAKDKFIILELCDDILVDTVVLANYEFFSSIFRTFRVSVADRYPAKPDKWKELGTYEAANTREIQAFAVENPLIWARYLKIEFFSHYGNEFYCPLSLVRVHGTTMMEEYKNYGDSARAEEEAVEAVVQAQQNPGSVPTMKNSNQTQSEIRDQNVNISITQTGSGTLPDEEALGASCFPQINEIERLLLGMSSDNMSSIYDMALDPDYQSEAHESAESETWASNATGSTSLEDTSVSDTPPTMVGGSDHQRATPGSRMVSTSGSSRSENETTADNQRTPVVSQPPPPNPATQESFFKSVHKRLQMLETNSTLSLLYIEEQSRILRDAFNKVEKRQLAKTSSFLENLNSTVLHELREFRQQYDHIWHSVVIEFEQQRQQYHHELFAVTSQLAILADEVVFQKRVSIIQSVFVLLSFGLVLFSRSAVGSYLEFPKMQSMVSRSHSFRSASPPYETPSPSPNSPMQSPPYQEGSLHRRNPSDGQTDCEICNHTFPYSPPPSSDTLSPSEEEEKGLHDVHLEYSRSTASNLVPEENPAGIKRQRSSPADLCGHDEGDSAEFKLPQAPS

SEQ ID NO: 3728 - protein, 280 aa, Anabaena variabilis ATCC 29413
MSATLYQQIQQFYDASSGLWEEIWGEHMHHGYYGVDGTEQKNRRQAQIDLIEELLTWAGVQTAENILDVGCGIGGSSLYLAEKLNAKATGITLSPVQAARATERAKEAGLSGRSQFLVANAQAMPFDDNSFDLVWSLESGEHMPDKTKFLQECYRVLKPGGKLIMVTWCHRPTDETPLTADEQKHLEDIYRVYCLPYVISLPEYEAIARQLPLNNIRTADWSQSVAQFWNIVIDSAFTPQAIFGLLRAGWTTIQGALSLGLMRRGYERGLIRFGLLCGDK

SEQ ID NO: 3729 - protein, 458 aa, Oryza sativa (japonica cultivar-group)
MAASTSATSFSTPTKPASSSSSSSSPNSVCFARASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 3730 - protein, 48 aa, Antirrhinum majus
AVYVGENEKKRFVIPLSHLNERLFQDVLCRADEEFGFHHPMGGLTIPC

SEQ ID NO: 3731 - protein, 251 aa, Rhodococcus sp. RHA1
MNGMSTGTLVLLRHGESEWNALNLFTGWVDVHLTDKGIAEGKRAGELLLEHNLLPDVLYTSLLRRAISTANIALDTADRHWIPVIRDWRLNERHYGALQGRNKAQVKEKYGDEQFMLWRRSYDTPPPPIEAGSEYSQDTDPRYANLDKVPLTECLKDVVVRLIPYWEDTISADLKAGKTVLITAHGNSLRALVKHLDGISDEDIAGLNIPTGIPLRYDLDENLKPLNPGGTYLDPEAAAAGAAAVANQGGK

SEQ ID NO: 3732 - protein, 136 aa, Triticum aestivum
MAALVGDAAYWLAEHPDIVGFRWSPSGLWFSTWAFLLGFLATYVSLCLAADALLRRRKQPLPLGPLPAAHALLMAAVSAAIFAGTLLSAVAEIRDTRWSWRGRSRTTPLRWLLCFPPGTRSSDRVFFWSYAYYLSR

SEQ ID NO: 3733 - protein, 87 aa, Phaseolus vulgaris
PGRYFFSMGLASLSALTIVVYIQDNMGWGWGLGIPSIAMLISIIAFVLGSPLYKTVKPEGSPLVRLAQVIAAAVKKRNKALPEDPKL

SEQ ID NO: 3734 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 3735 - protein, 90 aa, Triticum aestivum
  misc_feature (49)..(49): Xaa can be any naturally occurring amino acid
  misc_feature (76)..(76): Xaa can be any naturally occurring amino acid
  unsure (1)..(90): unsure at all Xaa locations
MAAAAKASWMVAMSVGAVEALKDQVGLCRWNYALRSIHRAAKASANVRXGVSQGAEQLPASAVAVAERRREEKAEXGLRTVMYLSCWGLN

SEQ ID NO: 3736 - protein, 406 aa, Bordetella bronchiseptica RB50
MLYRQPNMAQIVLFENIHPSARAVFSAAGYTDIVAHAAALPSGELREALRGAEVVGIRSRTHLDADLLAANPDLRVVGCFCIGTNQVDLDAAMMRGVPVFNAPFSNTRSVAELVLGEAILLLRRIPEKNARVHLGHWDKSAAGAYEARGKTLGIVGYGNIGSQISTLAEAIGMRVVFFDVEAKLPLGNARAAGSLAELLEQADVVTLHVPGGKSTQNIVNADTLARMKRGAILINASRGTVVDIQALHDALASGHLAGAALDVFPTEPKSADEPLASPLIGMPNVLLTPHIGGSTQESQENIGREVAEKLVRFLQAGTTKSAVNFPELSYQAPVGGSRIIHVHRNAPGALGALDNLMAQHGLNIVSQSLQTKGQIGYAVTDVDGEVSDTVLADLRSHPVTVRCEKL

SEQ ID NO: 3737 - protein, 239 aa, Robiginitalea biformata HTCC2501
MNKTASESEALLDELAAKLPDCSAEVMVAPVFVNLAEAVRRLEHSKIEAIAQNMHFADSGAYTGEVAADMLLGIGVDTVILGHSERRAYFGEDDDLLAKKVGQAIEKGMRTIFCFGEELKDRQAGKHFEVVESQLKNALFQLPEEAWGRIVLAYEPVWAIGTGETASPEQAQEMHAFIRKIVSDAYTDAVAQKVSILYGGSVKPGNAAEIFSKPDVDGGLIGGASLKADDFVAIIKAIG

SEQ ID NO: 3738 - protein, 469 aa, Solibacter usitatus Ellin6076
MTPQEVLDYAKTNGAQQLDLRFTDIPSLQHHVSYPMNQVDESSFEEGFGMDGSSIRGWAAIHESDMLLIPDSTTAFMDPFAEVPTLVMYGDVKDPITKQRYERDPRWIAQKAELYLKNSGVADTSYFGAEAEFFIFDNVSFDQNQHSGFYYIDAEEGRWNSGRRENNLGYRPRYKEGYFPVPPTDHYQDLRSEMVRTMIECGLNIECHHHEVATGGQCEIDQKYDTLVRSADNMMLYKYVVRNVANQYGKTVTFMPKPIFGDNGSGMHCHQSLWREGKPLFAGDSYAGLSQMALHYIGGLLKHARALSAIIAPTTNSYKRLVPGYEAPVNLAYSRRNRSAAVRIPMYSASPKTKRVEFRPPDASANPYLAFAAMLMAGLDGVMNRINPGEPLDKDIYDLSPEEMKSVPSMPGSLDEALTCLEDDHGFLMRGDVFTEELLETFIDYKRKNEAEAVRLRPHPYEFALYYDI

SEQ ID NO: 3739 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 3740 - protein, 68 aa, Atropa belladonna
VAIEDGVGHTPFIECNVDSQGNHQVYQVYLCVDSSASNFIDCPVFPHGGRCGSKIEFPPFSSTDHDEF

SEQ ID NO: 3741 - protein, 247 aa, Zea mays
MLAVFDRAVAPSPEGLRQPGAAGGGSAAGLADRFREARPDAVTVNLGGSGALAFSSSNQNPLLPRLFGAVDGVFCMFQGTIANVAVLKQQYGLSKGANEVSIIIEAYRTLRDRGPYPADQVVRDISGKFAFVLYDCSTKSVFMAADPDGNVPFYWGVDTDGRLVVSDDAELVKSACGKSCAPFPKGFFFTTSGGLRSYEHPMHEVKPVPRVDSKGEVCGTTYTVDATARKETSIPRVGSAADWSSQY

SEQ ID NO: 3742 - protein, 399 aa, Thermococcus kodakarensis KOD1
MIKPSERAMGVEYAIRDVVLPARELEKKGIEVIRLNIGDPGKYDFQPPEHMKEAYCRAIKEGHNYYGPSEGLPEMREAVVQREKRKNGVDITPDDVRVTTAVTEALQLLFGALLDPGDNILVPSPSYPPYTGLVKFYGGIPNEYDTIEENGWQPDIDDMRKRINERTKAIAVINPNNPTGALYEKKTVKEILDLAGEYDIPVISDEIYDLMTYEGEHVSPGSLTKDVPVIVMNGLSKVYFATGWRLGYFYYVDPENKLAEVREAVDKLMRIRICPSTPAQFAAIAGLTGPMDYLEEYMKKLKERRDYIYKRLTEIPGVSTQKPQGAFYIFPRIDERSKWKSDKEFVLDVLHEAHVLFVHGSGFGRAGNWHFRIVFLPPVEILEKAMDRFEEFMRKRLAE

SEQ ID NO: 3743 - protein, 642 aa, Arabidopsis thaliana
  misc_feature (466)..(466): Xaa can be any naturally occurring amino acid
  unsure (1)..(642): unsure at all Xaa locations
MASTSIMLSSFFSFFFLTFFVTYAQQNVTVHTICYYDGGNFTSNTSYSLNLNRLISSLPDLTPTINGFYNISINGEVNAIALCRGDVKPNQDCISCITTAAKQLVESCPNIIEANIWLEKCMFRYTSRIILGQMEPVPFSYTSSNVSVTDKEGFSKGLGDLLDSLGAKIDAANETKEVKFAAGVKGTIYALAQCTPDLSESDCRICLAQIFAGVPTCCDGKTGGWWTNPSCYFRFEVYPFFDLSVTSEQKQPLSSHNNNTRRSDQGKSKDRSKTLIFAVVPIVAIILGLVFLFIYLKRRRKKKTLKENAENEFESTDSLHFDFETIRVATDDFSLTNKIGEGGFGVVYKGHLPDGLEIAVKRLSIHSGQGNAEFKTEVLLMTKLQHKNLVKLFGFSIKESERLLVYEFIPNTSLDRFLFDPIKQKQLDWEKRYNIIVGVSRGLLYLHEGSEFPIIHRDLKERESSXSPPPPPKISDFGMARQFDFDNTQAVTRRVVGTYGYMAPEYAMHGRFSVKTDVYSFGVLVLEIITGKRNSGLGLGEGTDLPTFAWQNWIEGTSMELIDPVLLQTHDKKESMQCLEIALSCVQENPTKRPTMDSVVSMLSSDSESRQLPKPSQPGFFRRSASFSISLNDVSLTDLSAR

SEQ ID NO: 3744 - protein, 464 aa, Salmonella enterica subsp. enterica serovar Typhi
MPDNKKQGRSNKAMTFFVCFLAALAGLLFGLDIGVIAGALPFITDEFQITAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKRELDEIRESLQVKQSGWALFKENSNFRRAVFLGILLQVMQQFTGMNVIMYYAPKIFELAGYTNTTEQMWGTVIVGLTNVLATFIAIGLVDRWGRKPTLTLGFLVMAIGMGILGTMMHIGIHSPSAQYFAIAMLLMFIIGFAMSAGPLIWVLCSEIQPLKGRDFGITCSTATNWIANMIVGATFLTMLNNLGNANTFWVYAGLNVLFILLTLWLVPETKHVSLEHIERNLMKGRKLREIGAHD

SEQ ID NO: 3745 - protein, 303 aa, Oryza sativa (japonica cultivar-group)
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPEEDDKAAAATAAAVAGAGEKKVAA

SEQ ID NO: 3746 - protein, 304 aa, Thiobacillus denitrificans ATCC 25259
MVIQWFPGHMTTARKKAAETMAQIDVVVEVLDARLPEAGCNPMIHELRAHRQRPCLKVLNKVDLADPAVTRAWLDHYNRQPGVMAVAISAKKAADVAKLSALAQKLAPHRDDAFKPLRLMIMGIPNVGKSTLMNTWVKRRVAAVGDEPAVTKSQQRINLSPRLILVDTPGMTWPKIEHDADGFMLAASHAIGRNAVIDEEVAVFLAAILLERYPALLRARYGFDVEGLDATGVVEAVAKKRGCLLKGRGGELDLEKAAMILLTDYRSGALGRISLETPDSRRAMLAGGAPTNTAGAENGADQSP

SEQ ID NO: 3747 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIIDPNLVAKIRPESLRKFGDTAVKCLALSSEDRPSMGDVLWKLEYALRLQESVI

SEQ ID NO: 3748 - protein, 122 aa, Glycine max
  misc_feature (96)..(96): Xaa can be any naturally occurring amino acid
  unsure (1)..(122): unsure at all Xaa locations
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 3749 - protein, 336 aa, Schizosaccharomyces pombe
MAIPKVGINGFGRIGRIVLRNALVAKTIQVVAINDPFIDLEYMAYMFKYDSTHGRFDGSVEIKDGKLVIDGNAIDVHNERDPADIKWSTSGADYVIESTGVFTTQETASAHLKGGAKRVIISAPSKDAPMYVVGVNEEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDAVVSTDFCGDNHSSIFDASAGIQLSPQFVKLVSWYDNEWGYSRRVVDLVAYTAAKDN

SEQ ID NO: 3750 - protein, 231 aa, Plantago major
GNRMNDGTNRGHAKAFKLDTLLKLVDIKGTDGKTTLLHFVVQEIIRSEGAGSNPETESIPNANIKFKEDEFKKQGLHVVSGLSKELCNVKKAAAMDSDVLSSYVTKLEMGLEKLRFVLQYEKQTVQDKFYVSMKEFLKEATDEISRVKSEERKALSHVKEATQYFHGDAAKEEAHPLRIFMIVRDFLSVLDNVCKDVGRMQERTTVGTGKAFRIPATASLPVLNRFNVRHD

SEQ ID NO: 3751 - protein, 311 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDALWKLECALRLQESVI

SEQ ID NO: 3752 - protein, 142 aa, Glycine max
  misc_feature (85)..(85): Xaa can be any naturally occurring amino acid
  unsure (1)..(142): unsure at all Xaa locations
ERLVLLLNKIDLVPKEALEKWLKYLREELPTVAFKCSTQQQRSNLSDCLGADTLIKLLKNYSRSHEKSITVGLIALSSVGETCLXAYLHRLHRSQGRLRRWSRLFLRDALLYSMPCSLRPPSAILRSGTARVCSSCLILHLL

SEQ ID NO: 3753 - protein, 697 aa, Nocardia farcinica IFM 10152
MTRTIEGEQRVGLDRRTLLARSAVGTVALATAGTAATAATVGQGVAAAPALAAPDSGYRVGLGISDITGPAAECGMMGYSQFGQDTAGIHLRPRARAFIFEAGAARVVFAVAENGMIFQSVHRGVLLELARRFGDRYTEQNVLLTSTHSHATCGGASHDYAYNLSVLGFQQQVYDAEVQGIVEAIVAAHEDLSPATLALGRAELHDASVNRSRVAFERNPAEDRAHFPGAIDPAVTALSIRKGGREVGAITWFATHNTSMTNQNRLISSDNKGYAAFAHEHIEHGVRYLDGAPEFIAAFAQTNAGDMSPNLNLRPGSGPTDDEFANTRIIGERQHAASKAALAQAAPVRGPVQSLLCYIDLADIAVDGRFTPDGQPRRTAPAAAGVSLIAGSVEDGPGLPGAPIPEGVRNPLIDALGDPRRPAPSWLADAQAPKVIAAPLGLLPPVPWVPNVVPIQLVRIGELYLAAAGGEFTIVAGLRVRRAVAAALGVDLEQVLLQGYANAYHQYVTTPEEYDAQQYEGGSTLFGRYTLPAYQQEFTRLATALATGGTVARGPAPRDVSHLQPNLVPAPGPDTALPDRTFGDVLVQPAPGYARGEQVVAEFVSAHPKHDPRRNGTFLEVQRRTADGWVRVANEGEWAVRFHWRKTGTATSIARFTWDIPADAAPGRYRFVHFAGRLAPDGSRHPVTGVTDEFDIA

SEQ ID NO: 3754 - protein, 316 aa, Capsicum chinense
MGSKYSKATNSISDASNSFESYRFPLEDLEEATNNFDDKFFIGEGAFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDIKSINILLDENFVPKITDFGISKKGTELDQTHLSTVVKGTLGYIDPEYFIKGRLTEKFDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 3755 - protein, 399 aa, Clostridium perfringens ATCC 13124
MKKFNLVEEAIEDIKNGKMVIVIDDEGRENEGDLVMAGELVTGEKINFMATYGKGLICAPVSERIAENLGLNPMVLNNTDNHETAFTVSIDYKDTTTGISAFERAHTIKELINEESKAEDFRRPGHVFPLIAKNGGVLKRAGHTEAAIDLAKLAGLKEVGVICEIMKDDGTMARTDELLEFANSHNMKIITIEDLIAYRTERDNFVYRVVETNMPTKYGEFKAIGFIDKLTGEHHVALVKGEIKSEEPVLLRVHSECLTGDVFGSRRCDCGEQFHRAMEKINEEGKGILLYMRQEGRGIGLINKLKAYKLQDEGLDTVEANIALGFPEDLRDYGVGAQILKELSVREIRLMTNNPKKITGLEGYGLKIVERVPIEIKCNEENEFYLKTKKEKMHHLIMQ

SEQ ID NO: 3756 - protein, 570 aa, Klebsiella sp. LX3
APSLNQDIHVQKESEYPAWWKEAVFYQIYPRSFKDTNDDGIGDIRGIIEKLDYLKSLGIDAIWINPHYDSPNTDNGYDISNYRQIMKEYGTMEDFDSLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSGMRFDTVATYSKIPGFPNLTPEQQKNFAEQYTMGPNIHRYIQEMNRKVLSRYDVATAGEIFGVPLDRSSQFFDRRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQAAAPHSTSLSLSPWQAGVYKLR

SEQ ID NO: 3757 - protein, 264 aa, Vibrio fischeri ES114
MKKISIHDLMKWKQEGKKFATVTAYDASFAQLFEQQEVPVLLVGDSLGMVLQGKSDTLPVTTEEIAYHTRCVRAGSPNSLLMADMPFMSYATPEQACENAGKLMQAGANMVKIEGGEWIAETVRVLAERAVPVCAHLGLTPQSVNIFGGFRIQGRDEAKAEQMVKDALTLEAAGAQIILLECVPASLAERITKACTVPVIGIGAGNVTDGQILVMHDMFGISANYMPKFSKNFLAETGDMRKAVTKYIQDVEQGVFPVAEHTFN

SEQ ID NO: 3758 - protein, 397 aa, Clostridium perfringens ATCC 13124
MILSRKAQNIGASLTLALTAKAGELKKEGIDVVSFGVGEPDFNTPKNIIEAATRAMEEGNTKYTATSGIVELKEVIAKKLHDDNGLNYGTKNIIISTGAKQSLANVFMAILNPGDEVIIPVPYWVSYPELVKLSDGVPVFIETKKENDFKVTYDELKSVLSKNTKAIVINSPNNPTGTVYSKKDLEVIAKFAEENDLIIISDEIYEKLIYGKEEHISIASLSEDAFKRTVVINGFSKAYAMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 3759 - protein, 442 aa, Methanothermobacter thermautotrophicus str. Delta H
MSDKIGRIIAKMDECGVKFVRLQFVDIHGKPKNMAIPLVRPDQIEDIIKDGLLFDGSSVEGFVDINESDLVLKPDPDTFSTLPWRPEEKGVCRFICDIYWPDGKPFEGDPRYVLKRALDKYAHLGYEYNVGPEPEFFILDQDEDGNIIPHDCGAYFDVEPVDQGTDFRRKLVMDLEALNFDVEVSHHEVAPGQHEIDFKFDKALKTADAVITFKQAIKAIVDKIGYMVTFMPKPFFGENGSGMHCHQSLFKDGENVFYDPDTETQLSEEALYFIGGLLKHAPALTAVCAPTVNSYKRLVPGYEAPVYIAYGLKNRSTLIRIPASRGKGTRVELRMPDPSCNPYLAFAAMLEAGMNGIQNKIDPGEPTEIDVYEKSMSELREMGIETLPSSLWEAYHALEEDDVIKGALGGHVYEKFMEIKHREWDDYRVRVFKYELERYLDI

SEQ ID NO: 3760 - protein, 491 aa, Archaeoglobus fulgidus
MVRRLRGDCMEEVERAKAVLKENNVRQVLCAFADVRGYLQMFSIPAREFVDGSAFENGIGFDGSSVRGFRTIEKSDMVWMPDASSLKIIPWIDDPIQKSAIMFGNVYEAWGTEIADCDPRGYVAKRYEDMLKSEGMSAIFGPEIEFFLFEGVDFTRLSWDMWVSPNGGAGDSWGPPRIMPISSELESGYMIRPKEGYFRPPPEDTTVEYRNELVYYLEQLGIDIEYHHHEVATAGQVELDFKPKQLVDVGDAFYLYKFAAKNIAAMHGLYATFMPKPLYLDNASGMHTHQSLWKGEPFSGEAVFADPDDEYMLSQKARYYIGGLLEHAKALTALCAPTVNSYKRLVPGFEAPIYICWSPRNRSALVRVPMYVKKPSAIRVEYRGVDPSCNPYLAITAQLAAGLDGIKKKIDPGDPLLEDVYELTPAQKRELGVGELPTTLRDAIDHLASDELMQEVLGSHIFDAFMELKIDEWNQYCLYITPWEFMKYFDI

SEQ ID NO: 3761 - protein, 590 aa, Saccharum officinarum
PGSTHAGRSIAKCQIVLLHASYPFSKEASYLASVYSQVYLDFGLAIPKLSVHGMTSSLKELLELAPIKKVMFSTDGYAFPETYYLGAKRARDVVYRVLSAACEDGDLSIQEAIEAVEDIFRRNALHLYKLNVVNGSINHETTIVADSVSLSSVEEDVLFVRIIWSDASGQYRCRVVPAGRFYEITRNKGVGLTFAAMGMTSFCDGPADGSNLTGVGEIRLVPDMPTLVRIPWSRREEMVMADMQIRPGECWEYCPRNAMRKVTKVLLDEFNVTMKAGFENEFFLRRKLVSDGVEQWVPYDNTNYCSTSAFDGASSILQEVYSSLKASGIVVEQLHAEAGKGQFEIALKYILCTLAADNLIYARETIQSIARKHGLLATFLPKPDLNDFGSGSHVHLSLWENDQNAFMGSSKDNFHGMSKTGAQFLAGVYHHLPSILAFTAPHPNSYDRIQPDTWSGAYQCWGKENREAPLRTACPPGVPLDLVSNFEIKSFDGCANPHLGLAAIVAAGIDGLRRDLKLPEPIESNPSDHASKLKRLPQNLQESVEALSADKVLHELIGDKLVTAAIAIRKAEIDHFSKNPGAFNDLIFRY

SEQ ID NO: 3762 - protein, 491 aa, Ralstonia eutropha JMP134
MSLTLANAALLRSQNFINQQWRDAGLGRRLAVANPATGEVFAHVPDSDDDDAGRAADAAAEAFPAWSARPARERAQLIKRWHALILANQEDLARIISTEQGKPLKEARGEVLYGASYVEWFAEEATRICGDIVAEAVPGRKLLVLKEPVGVVAAITPWNFPLAMIARKIAPALAAGCTVVAKPAEDTPLTALALVWLAEQAGLPAGVLNIVTASRESTPNVVDAWLADSRVRKITFTGSTPVGKHLARESAGTLKKLSLELGGNAPFIVFEDADLDAAVDGLMASKFRNGGQTCVCPNRVYVHESVHDDFVERLARRVGALHVAPATDENAQIGPMINARAVDKIARHVEDAVAKGARVVTGGRRVRTADGPHYYAPTVLIDATPAMELACEETFGPVAPVFRFRDESEVIRDANDTPFGLAAYFYSNDVRRIWRVAQALETGMVGINEGAIAAEAAPFGGVKESGYGREGSRHGLDDYMHTKYLCQGQLG

SEQ ID NO: 3763 - protein, 314 aa, Zea mays
MARSCSMTATAPPPLVGAGVRLLAVVVAILVVAGGGGRCHGALLKAHFYRHSCPAAEAVVRDIVLARVAADPAKLPAKLLRLFFHDCFVRGCDASVLIDSTPGNTAEKDAAPNGSLGGFDVIDTVKAVLEAVCPGTVSCADIVSAETALGPSFPPLPELLTSLQPQRLPNLRSLSITASCCSSSRATILRRSPPGCSALPRPPMASGSKPDSMDTDPLGGGLSIAVERNPPESRLQQLGVRSWPKWGCPPGKFPVKFDARQTCYLLKGKVRAHIKGSSECVEFGAGDLVVFPKGLSCTWDVAAAVDKYYKFDSS

SEQ ID NO: 3764 - protein, 370 aa, Oryza sativa (japonica cultivar-group)
MRGLARAGKRASEMAFNAGGGAVNWFPGHMAAASRAIRDRLKLADLVLEVRDARIPLSSANEDLQPVLASKRRILALNKKDLANPNIMNRWLHHFESCKQDCISINAHSTSSVSQLLGLVEFKLKEAISKEPTLLVMVVGVPNVGKSALINSIHRIVTSRFPVQDKNKRATVGPLPGVTQDIAGYKISSQPSIYVLDTPGVLVPSIPDMETGLKLALTGAVKDSVVGEERIAKYLLSLLNIRKTPLHWERLVYRREQFNEDAFNSNEKDYRDSPRRRRRPNNSDALYVQDMVMEVQRTLCSTFMDFADNTEDENELESLIDSQLVALRKVFRIPHKPFDETHGPASKKLLTLFRSGKLGPFILDDLPDNQ

SEQ ID NO: 3765 - protein, 274 aa, Enterococcus faecalis V583
MTLDKTKKLANGNEMPRLGLGVWRVEDGSEATNSVKWALEVGYRLIDTAAVYKNEVGVGEGIRQSGIPREEIFVTTKLWNEDQGYENAIKAFDKSLEKLGLDYVDLYLIHWPVAGKYKESWKALEEIYASGRAKAIGVSNFHQHHLEDLLTEANVVPMVDQIELHPTLTQEPLRKYLAENKIAVEAWSPLGQGNLLSEPVLVKIGEKYGKSAAQVIIRWHLQNDIIVIPKSVHEKRIQENFAVFDFELTPEEITAINQLNKDHRFGADPDNFDF

SEQ ID NO: 3766 - protein, 222 aa, Petunia axillaris
MFKLQLASVLCVFLFACSPISGSFDHWQLVLTWPAGYCKVKGCPRPVIPNDFTIHGLWPDSISLIMNNCDPTKTFATITEIKQITELEKRWPELTTTAQFALTSQSFWRYQYEKHGTCCFPVYSQSAYFDFAIKLKDKTDLLSILRSQGVTPGSTYTGERINSSSASVTRVKPNLKCLYYRGKLELTEIGICFDRTTVAMMSCPRISTSCKFGTNARITFRQ

SEQ ID NO: 3767 - protein, 465 aa, Thermococcus kodakarensis KOD1
MKTVLLAGGKGTRLWPLSRELMPKQFVRFLDDESLFQKTVERALLFSKPSEIFVVTNKDYRFRVMDDLREIRIELPADNILLEPVGKNTLPAIVWAVLKIEEKFGPSKVAVLPSDHLIETGEAYERAFENAERLADKFLVTFGIKPNRPHTGYGYIKPGERIEEGGRLLGYRVDEFKEKPDLETAKRYVESGYYWNSGMFAFSTSLFLEEVEKHAPEVLEAFESSSSIEEAYEKAPEISIDYGVMEKTEKAAVVPLNVKWSDLGSFDAIYEVLEKDDAGNAVQIRGKKGYHIGVNSKNNLIMTERLTATVGVSDLVIIDTGDALLVAHRGETQKVKEIYRALREMNDERAIVHRTAYRPWGSYTVLEEGDRYKIKRLTVLPGKKLSLQMHYHRSEHWVVVRGTAKVIVGDRELLLRPGESTFIPAGVKHRLENPGKVVLEVIETQIGEYLGEDDIVRFVDDFGRD

SEQ ID NO: 3768 - protein, 201 aa, Arabidopsis thaliana
  misc_feature (29)..(29): Xaa can be any naturally occurring amino acid
  misc_feature (32)..(32): Xaa can be any naturally occurring amino acid
  misc_feature (40)..(40): Xaa can be any naturally occurring amino acid
  misc_feature (67)..(67): Xaa can be any naturally occurring amino acid
  misc_feature (84)..(84): Xaa can be any naturally occurring amino acid
  misc_feature (86)..(86): Xaa can be any naturally occurring amino acid
  unsure (1)..(201): unsure at all Xaa locations
KQQDILTFLNTHNQQKGTAFFKTTTAKPXTGXKSSAAFPXTRKTNKDITSIASNGGRASCMKAWPPXGKKKFETLSYLPDLRDXQXAKEVDYLLRNKWIPCVEFELEHGFVYREHGNTPRYYDGPVTGQLWKAFPHLFRNATQLPLQSCLKENLKNAKKEYPGPFSLRIIEFRPTPSKSQCIQFPFPSKPPKLSPKLNFFF

SEQ ID NO: 3769 - protein, 218 aa, Petunia axillaris
MLSSQLMSVAFILFLALSPVYGSFDQLQLVLTWPPSFCHEKSCNRIPRNFTIHGLWPDNQHVMLNDCAKTFKKITDVLKSKELDDRWPDLKYSRNNAIQTQSFWRYEYNKHGTCCSQRYNQQAYFDIAKNLKDKFDLLQILKKKGIIPGKTYTVDKIEEAIREVTQAYPNLNCIGDPQNTMELKEVGICFEPDATTVTACHRRRTCNPQNKKEISFPL

SEQ ID NO: 3770 - protein, 219 aa, Petunia axillaris
MLKSQLTSVLSILLLVLSPVYGYFEYFQLVLTWPPYFCHFNNCNRPTPDNFTVHGLWPDNWSKPLQNCDPLATIDGVLDIEKRSQLDERWPQLKHSKDDGMNLQPLWKGEYKKHGTCCNNMYNEQAYYDLAMNLKDRFDLLKILSSQGITPGKSYIVQKVQDAIRTVTHQLPRLKCVEYPGLELSEIVICFEPKGKNVVSCRRPGTCFKNGKMGTILYR

SEQ ID NO: 3771 - protein, 314 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGISKKGTELDQTHLGTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 3772 - protein, 140 aa, Rhodospirillum rubrum ATCC 11170
MAIERTLSIIKPDATRRNLTGAINARFEEAGLRIVGQKRLRLTTAQAEGFYEVHKERSFFGSLVEFMTSGPVVVQVLEGENAVLKNREVMGATNPANAAEHTIRKDFAESIEANSVHGSDSAENAAHEIAYFFAQTEIVA

SEQ ID NO: 3773 - protein, 220 aa, Bacillus cereus G9241
MNLKQLAGEYAAYFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELLIIVDESKLVTHLGTFPLPVEIIPFSWKQTERKIQSLGCQTTLRLKNNEIFITDNNNMIVDCIFPNHIATPSALHKRLKMITGVVETGLFVNMTSKAIIGTKNGIKEL

SEQ ID NO: 3774 - protein, 308 aa, Glycine max
MESALIFLGTGVSGTVPSMRCLIDPSDPPCLVCTQSLSLPPHLNPNYRCNTSLLIDYYSQSDATHKYILIDAGKTFRETVLRWFVFHHIPRIDSILLTHEHADAVLGLDDIRAVQPFSPTNDIDPTPIYLTRHSMDSMEKVFPYLVQKKHKEGQEIRRVAQCCWNIIADDCNLPFSASGLKFIPLPVMHGEDYICLGFLFGEKDRVAYISDVSRIPASTEYVISKSGAGQLDLLILDTLKKTGSHNVHFCLPQALETVKRLCPKQTLLIGMTHEFDHHKDNEFLMDWSRREGLLVQLAHDGLRVPINL

SEQ ID NO: 3775 - protein, 359 aa, Capsicum chinense
  misc_feature (288)..(288): Xaa can be any naturally occurring amino acid
  unsure (1)..(359): unsure at all Xaa locations
NMSYRVPFAALLEATSNFDESLVIGIGGFGKVYKGVLYDGTKLAVKRGNPKSQQGLAEFRTEIEMLSQFRHRHLVSLMGYCDEKNEMILVYEYMENGTLKSHLYGSDLPSMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKKGQLEQIIDPTLVGKIRPDSLRKFGETAEKCLADFGVDRPSMGDVLWNXEYALQLQEAVIQDDPEENSTLLIGELSPQVNDFSQVDAGASAALIGTPNLDDLSGVSMSRVFSQLVKSEGR

SEQ ID NO: 3776 - protein, 821 aa, Arabidopsis thaliana
MRIVACLLLITALFSSYGYAAITTSSPLSIGVTLSSPGGSYELGFFSSNNSGNQYVGIWFKKVTPRVIVWVANREKPVSSTMANLTISSNGSLILLDSKKDLVWSSGGDPTSNKCRAELLDTGNLVVVDNVTGNYLWQSFEHLGDTMLPLTSLMYDIPNNKKRVLTSWKSETDPSPGEFVAEITPQVPSQGLIRKGSSPYWRSGPWAGARFTGIPEMDASYVNPLGMVQDEVNGTGVFAFCVLRNFNLSYIKLTPEGSLRITRNNGTDWIKHFEGPLTSCDLYGRCGPFGLCVRSGTPMCQCLKGFEPKSDEEWRSGNWSRGCVRRTNLSCQGNSSVETQGKDRDVFYHVSNIKPPDSYELASFSNEEQCHQGCLRNCSCTAFSYVSGIGCLVWNQELLDTVKFIGGGETLSLRLAHSELTGRKRIKIITVATLSLSVCLILVLVACGCWRYRVKQNGSSLVSKDNVEGAWKSDLQSQDVSGLNFFEIHDLQTATNNFSVLNKLGQGGFGTVYKGKLQDGKEIAVKRLTSSSVQGTEEFMNEIKLISKLQHRNLLRLLGCCIDGEEKLLVYEYMVNKSLDIFIFDLKKKLEIDWATRFNIIQGIARGLLYLHRDSFLRVVHRDLKVSNILLDEKMNPKISDFGLARLFHGNQHQDSTGSVVGTLGYMSPEYAWTGTFSEKSDIYSFGVLMLEIITGKEISSFSYGKDNKNLLSYAWDSWSENGGVNLLDQDLDDSDSVNSVEAGRCVHIGLLCVQHQAIDRPNIKQVMSMLTSTTDLPKPTQPMFVLETSDEDSSLSHSQRSNDLSSVDENKSSEELNASS

SEQ ID NO: 3777 - protein, 274 aa, Saccharomyces cerevisiae
LADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDL

SEQ ID NO: 3778 - protein, 314 aa, Capsicum chinense
MGSKYSKATNSINDALNSSYLVPFESYRFPLVDLEEATNNFDGKGGFGKVYRGVLRDGTKVALKRHNRDSGQSIEPFRTEFEILSRRSHPHLVSLIGFCDERNEMILIYDYMENGNLKSHLYGSDLPTMSWEQRLEICIGAARGLHYLHTSAAIHRDVKSTNILLDENFVAKITDFGISKKGTDLDHTHVSTHVKGAFGYLDPEYFIKGRLTEKSDVYSFGVVLFEVLCARSAIVQSLPREMVNLAAWAVESHNNGQLEQIIDPNLVAKIRPESLGKFGETAVKCLAPSSEDRPSMGDVLWKLEYALRLQESVI

SEQ ID NO: 3779 - protein, 89 aa, Glycine max
MPSLQKALPPELADNALRLYRECLRRAKFIGSQQHNTGLLVSMVRQQFKKNMHETDPEKIQKMKDDAARGLINHIIYESEKMTGRKFSG

SEQ ID NO: 3780 - protein, 481 aa, Mannheimia succiniciproducens MBEL55E
MSGEKTSRYVLGVTLVATLGGLLFGYDTAVISGTVSSLDTVFIQPKGLPEISANSLLGFCVASALIGCIIGGACGGYLSSKYGRKKALLIAALLFLISAFGSAYPEFGLKTINETNNIPYYLSNFLIQFVIYRIIGGIGVGIASMVSPMYIAEITPARIRGKMVSFNQFAIIAGQLIVYFVNYFIALNGDNTWLNMLGWRYMFLSEMVPAALFLILLFFVPESPRWLVLQNKFSQAEITLLKLLGERSGKTELQNIVSSLEHRVVKGAPLFSFGLGVIVIGIALSVFQQFVGINVALYYAPEIFKSLGASTNNALLQTIIMGTINLSCTTIAIFTVDKYGRKPLQIIGALGMAMGMFVLGMAFYANLSGTIALTGMLFYVAAFAISWGPVCWVLLAEIFPNAIRSQALAIAVAAQWIANYIVSWTFPMMDKSSYLVERFNHGFAYWVYGLMAILAALFMWKFVPETKGKTLEELELLWNKK

SEQ ID NO: 3781 - protein, 393 aa, Pseudomonas aeruginosa PAO1
MRYSDFTQRIAGDGAAAWDIHYRALARVEQGEEILLLSVGDPDFDTPAPIVQAAIDSLLAGNTHYADVRGKRALRQRIAERHRRRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCMAHDLWMISDEVYSELLFDGEHVSPASLPGMADRTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 3782 - protein, 627 aa, Oryza sativa
MPPFHDYRDGGVLVMEPAASAALFGGVRSRKRARVTAVPPCGFVSAAAEAVEVVEEEGLTAAKRQKQQQQQREAPSLDALPDECLFEILRRVKGARARCASAAVSRRWLALLGGIRSSEIKREPAAAAVPDLNQVFVDEDEEEEDEFEVPLGGGCSSERCLEGREATDVGLMAVAVADALRGSLESLVIRGSHPTRGVTDAGISAAARGCPSLLSLALWHVPQGCPDLKVVTVEACPGVADEGLKAIGRCCAKLQSVNIKNCAHVGDQGVSGLVCSAAASLAKVRLQGLSITDASLSVIGYYGKAITDLTLARLPAVGERGFWVMANALGLQKLRFMSVSSCPGVTDLALASIAKFCPSLKQLNLKKCGQVSDGRLKDFAESAKVLESLQIEECNKVTLMGILAFLLNCSPKFKALSLVKCNGIKDICSAPAQLPLCKSLRSLTIKDCPGFTDASLAVVGMICPQLENVDLSGLGAVTDNGLLPLIKSSESGLVHVDLNGCENLTDATVSALVKAHGSSLARLSLEGCSRITDASLFAISEGCTDLAELDLSNCMVSDYGVAVLASARQLKLRVLSLSGCLKVTQKSVPFLGSMSASLEGLNLQFNFIGNHNIASLEKQLWWCDILA

SEQ ID NO: 3783 - protein, 413 aa, Xylella fastidiosa Temecula1
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRRIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 3784 - protein, 314 aa, Coccidioides immitis RS
MASRHTTFRLNTGEDIPAIGFGTWQDENAQEDAVLTALSAGYRHIDTAAVYGTEKAIGRALARSRLSRDELFITSKLWNNKHRPEDVEQAIDQSLKNLEIDYLDLYLMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPTLAAIGTKYGKTGAQVALAWGINKGHSVLVKSKTPHRIQQNFESDFELKQEDMKAIENIDKKLRFNDSSADFGYNFFVGLEGKEK

SEQ ID NO: 3785 - protein, 779 aa, Arabidopsis thaliana
MELSLVRLWNTCFPSFFYISTVLFLLTGGGVYSHSEYLIGLGSYDITGPAADVNMMGYANMEQVASGIHFRLRARTFIVSEPQGKRVVFVNLDACMASQIVKLKVIERLKARYGDLYTEQNVGISGIHTHAGPGGYLQYVVYIVTSLGFVRQSFDALVDGIENSIIQAHENLRPGSIFLNNGELLDAGVNRSPSAYLNNPSKERSKHKYNVDKEMTLLKFVDDQWGPVGSFNWFATHGTSMSRTNSLISGDNKGAASRFMEDWYEQNTAERSYSEEFISDEIPRRVSSLIENHQDSHHELLELASYFESQPGKPVTRISSSARRVRSALRKADKPGFVSAFCQTNCGDVSPNVLGAFCLDTGLPCDFNHSTCGGKNEMCYGRGPGYPDEFESTRIIGERQFKMALELFNKASEQLQGKVDYRHVYVDFSQLNVTLPKKDGKSEVVKTCPAAMGFAFAAGTTDGPGAFDFTQGDDKGNPFWRLVRNVLKTPDKKQIDCHYPKPILLDTGEMTKPYDWAPSILSLQVLRIGQLFILSVPGEFTTMAGRRLRYAVKTQLKNSGNKDLSGEIHVVIAGLANGYSQYVTTFEEYQVQRYEGASTLYGPHTLSGYIQEFKKLSKSLVLDMPVQPGPQPPDLLDKQLSFLTPVMMDTTPSGDSFGDVISDVPKNLSLKRGNGQVTVVFRSACPRNDLLTEGTFTLVERLEQKDKTWTPVYDDDDLCLRFKWSRHKKLSSRSQATVEWRIPESASPGVYRITHFGAAKKLFGSVHHFTGSSSAFVVT

SEQ ID NO: 3786 - protein, 249 aa, Aspergillus nidulans FGSC A4
MPRKFFVGGNFKMNGNAESTTSIIKNLNSANLDKSVEVVVSPPALYLLQAREVANKEIGVAAQNVFDKPNGAFTGEISVQQLREANIDWTILGHSERRVILKETDEFIARKTKAAIEGGLQVIFCIGETLEEREANKTIDVVTRQLNAAAKELSKEQWAKVVIAYEPVWAIGTGKVATTEQAQEVHSAIRKWLKDAISAEAAENTRIIYGGSVSEKNCKDLAKEADIDGFLVGGASLKPAFVDIVNARL

SEQ ID NO: 3787 - protein, 482 aa, Escherichia coli
MSDVPLIAVVMAGGTGSRLWPLSREHYPKQFLQLSGENTLLQSTLLRLSPLSCETPLVITNEQHRFVVAEQLRQINQLSDNIILEPCGRNTAPAIALSAFTALKRNEQQDPILLVLAADHVINKTDVFCNAIKNSISIVEQGNILTFGIIPDYAETGYGYIEKGSIVKESQRGVGNTFYHVEQFVEKPNRSRAEEYISSGKYLWNSGMFMFKASVYLEELKKYRPDIYDICEKTVSSSYHDLDFIRLSKDVFQNCPSESIDFAVMEKTKRCIVYPVDIGWNDVGSWQSLWDVSDKTPTGDVCKGDILTYNTKNNYIHSESALVAAVGVEDIVIVQTKDAILVSKKSEVQDVKKIVQMLKMQERSEYLSHREEFRPWGKFDAIEQGDRYKVKKIVVKPGEGLSLRMHHHRSEHWIVLSGTAKVTLNNKTFLVTANESVYIPLGATYSLENPGVIPLNLIEVSSGDYLGEDDIVRQKERYKIDD

SEQ ID NO: 3788 - protein, 678 aa, Aspergillus nidulans FGSC A4
MTTFKLNTGATIPALGFGTWQDADAQETAVLEALRAGYRHIDTARVYGTEAAVGRAIKKSGIPRNQIFLTTKIWNNKHHPDDVAQALQDSLNDLDQDYVDLLLIHWPVAFKRGTEQFPKTEDGKPAVADTDYLDTYKALEKLLSTGKVKAIGVSNFSKAEMERILANATVPPAVHQLEGHPWLQQREFAEWHKKHGIHITHYSPFGNQNEVYSREGTIGRLIEDPVLVEIGKKYNKSAAQVALAWGVTEGHSVLPKSKTPERIKANLEGDFKLEEEDLKKIRGIDRKLRFNDSSKDFGNAASATPRAYSALMADSVILRGQAIHDQDSDSSGLLQVGTFQNALLNLIESPSGRFMQQNWQEYLGRSVDSVVNVVGNAKEDTKFPLDRLSKMDRYGQTGNKTYKNILDSLRFSIDLQPRNQFGGLWYYVYPNWSYLDGMFSLLSFSPMYASTFDIANSTLMNRDLFNQLDLLWSHCRDNRTGLLVHGYDASRTAPWANPVTGASPIVWIRALGWFMMALVDLFEHDLMDARVSIWRTRFVDLANALVDAVDSTSGAWWQVMSAPGQEGNYIESSGSAMFVYALYKGVRVGILPAPEKGGEAYIEVAERAYSELVKRFIVENEDGTLSYNGTVGVCSLNSTATYDYYIHQPLVYDSVLGSAAFIRASTEHELHLEASLNL

SEQ ID NO: 3789 - protein, 509 aa, Desulfotalea psychrophila LSv54
MEVRSMDNLLKIDNGQAIDRSLIPHVSYEVFFTTLSDFVRNEGFIVQFFAYEEGQKKHLLAVVRNRDLYVIGTEVGKSFQSLTGAVSEKFHMFEREIAEQYGITPDGHPWLKMVRYHKNYAGAKDVFGNNYGKENIPGNYPFFSVEGESIHEVAVGPVHAGIIEPGHFRFQCAGEEVLHLEIQLGYQHRGIEKMLPTLPQKRFPIICESIAGDTSIGHGLSMCQAIEGLAGISVDRGAKIIRTTALELERICNHIGDLGALAGDAAFNPPAAYFGRIRGEFLNLLQVLSGNRFGKGLVRPGGVTHIMREEQRKLIREKLLEVTGEIENICDLIFSAHTVQARFEHTGTVQHEMAKDLGLVGYSGRASGIAYDVRNSFPTECYRELPANENRVTNGDVNSRGMVRVEEIMHSLKLINILIEESENTASEVHMQDQILAPNAFIITLNEGWRGEISHCILTDKKGKVQRYKIKDPSFHNWTGLAMSLRNQEISDFPLCNKSFNLSYCGFDL

SEQ ID NO: 3790 - protein, 317 aa, Agrobacterium tumefaciens str. C58
MSKTVLVTATNYSRYCADAKAMLAAEGIDVVENGFGRPMTFDELSARLGDVDAVIAGVDTWNERVFNLAPRLKAIARFGVGVDNIDIDAAHRHGIAVTNAPGGNANAVAELTLGLILSAMRRIPYLHDALRGGAWDRFVGQELIGRRVGLLGFGNIARKIARKLCGFDVEVIAYDKFPDQVAATKLGVRMCEMDEVLSSSDILVMMMPSLPETRRLMDAGRFARMKPGSIFINTARGALVDEKALYDALVSGHLQAAAIDVYETEPALPDNPLFTLPQIVTTPHTAAETYETYTSIGRITAEAVIDVLANRQPRNQL

SEQ ID NO: 3791 - protein, 467 aa, Rhodobacter sphaeroides
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGAAVKAEAYLKASGIGDVAYFGPEAEFFIFDDVRYSVTPAKVAYQIDADAGAWNTDSEYEMGNLAHRAGHKGGYFPVNPIDEAQDLRGEMLSTMKRMGMKVDKHHHEVATCQHELGLIFGGLTEQADNILKYKYVIHNVAGMHGKTVTFMPKPMKGDNGSGMHVNMSIWKEQALFAGDKYADLSQEALWFIGGILKQPSVNALTNPATNSYKRLIPGFEAPVLRAYSARNRSGCVRIPWTESPNAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 3792 - protein, 836 aa, Geobacter sulfurreducens PCA
MDETLPPSEQSAELDTLMLIIKSFLEHLEYTLGKDKYSATRHDIFNALAYAVRDRMVERWLDTQQAYYNQDPKRIYYLSMEFLMGRTLENSLVNLGLLDDFRDAMNSLGFDLDVLIDQEQDAGLGNGGLGRLAACFLDSMATMGIPGYGYGIRYEYGIFRQNIVDGAQVEYPDNWLRYRNPWELDRQEHLHPVKFYGRVVERKNAEGNTVFAWIDTEDVMAMAYDTPIPGFGTNSVNTMRLWTAKSSRDFDLTFFNEGNYIRAVEKKMLSENISKVLYPADHIPEGKELRFKQEYFLASATIQDVIYRFRKNHSDLRLIPDKVAIQLNDTHPSLAIPEMMRLLMDRERLDWDTAWDITTRTFAYTNHTILPEALEKWPVWFLEQILPRHLQIIYEINDRFLAQVRQHFPGDTGRLERMSLVEEHWERKIRMAHLAIVGSHSVNGVAALHTEILKEKVFTDFFEMWPERFNNKTNGITQRRWLKSANPGQAGLISRAIGDGWITDLDQLRKLADLAKDRDFIHAWQRVKQENKKRLADYIFRNNELQVNVDSLFDCQVKRIHEYKRQLLNVLHVITLYNRIKAAPAGDFVPRTVIFSGKAAPAYALAKLIIRLINAVGDVVNNDPDVGDRLKVVFLANYSVSLAEKIFPASDLSEQISTAGTEASGTGNMKFALNGALTIGTLDGANIEIMEEVGRENIFIFGMTAGEVDELRRRGYDPRDYYHRIPELKRVLDQIAEGFFSPATPDLFRPVVDALLNQGDNYMLLADYASYVACQEEVSRLYLDPDEWARRAILNCAGMGKFSSDRTIAEYARDIWGVEQMEVRPVLEFRKHDGPA

SEQ ID NO: 3793 - protein, 456 aa, Enterococcus faecalis V583
MTIPYKEQRLPIEKVFRDPVHNYIHVQHQVILDLINSAEVQRLRRIKQLGTSSFTFHGAEHSRFSHSLGVYEITRRICEIFQRNYSVERLGENGWNDDERLITLCAALLHDVGHGPYSHTFEHIFDTNHEAITVQIITSPETEVYQILNRVSADFPEKVASVITKQYPNPQVVQMISSQIDADRMDYLLRDAYFTGTEYGTFDLTRILRVIRPYKGGIAFAMNGMHAVEDYIVSRYQMYVQVYFHPVSRGMEVILDHLLHRAKELFENPEFDYDLQASLLVPFFKGDFTLQEYLKLDDGVLSTYFTQWMDVPDSILGDLAKRFLMRKPLKSATFTNEKESAATIAYLRELIEKVGFNPKYYTAINSSYDLPYDFYRPNKDRHRTQIELMQKDGSLVELATVSPLVAALAGQSQGDERFYFPKEMLDQGNKKHYDLFDETYREFSSYIHNGALVLKK

SEQ ID NO: 3794 - protein, 81 aa, Arabidopsis thaliana
MASSMLSSATMVASPAQATMVAPFNGLKSSAAFAATRKANNDITSITSNGGRVNCMQVIYISSFTFLLVHMIFICFFIESR

SEQ ID NO: 3795 - protein, 222 aa, Petunia axillaris
MFKWRIVSALIILNFALFKVYGEFDYLQLVLTWPASFCYQPKDICKRTVNNFTIHGLWPEKKGFRLEFCSGGTKYKIFEDNMVKDLERHWLQMKFDENYAKKHQPLWSYQYRKHGMCCYKLYNQNAYFLLAMRLKDKLDLLTTLRTHGITPGTKHTFSEIQKAIKTVTNNKDPDLKCVEHIKGVKELNEIGICFNPAADSFHDCRHSYTCDETDSTKTLFRL

SEQ ID NO: 3796 - protein, 157 aa, Zea mays
MQASRARLFKEYKEVQREKSADPDIQLICDDSNIFKWTALIKGPSETPYEGGVFQLAFAIPEQYPLLPPQVRFLTKTFHPNVHFKTGEICLDILKNAWSPAWTLQSVCRAIIALMAHPEPDSPLNCDSGNLLRSGDIRGYQSMARMYTRLAAMPKKG

SEQ ID NO: 3797 - protein, 137 aa, Brassica napus
EIFPKLSKVLFLDDDIVVQKDLSGLWSVDLKGNVNGAVETCGESFHRFDRYLNFSNPLISKNFDPRACGWAYGMNVFDLDEWKRQNITEVYHRWQNLNQDRDLWKLGTLPPGLITFWKRTYPLDRKWHVLGLGYNPS

SEQ ID NO: 3798 - protein, 377 aa, Eucommia ulmoides
MAESDDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDMKEKLAYITLDYEQELETSKTSSTVEKSYELPDGQVITIGAERFRCPEVLFQPSMIGMEAAGIHETTYNSIMKCDVDIRKDLYGNIVLSGGSTMFPGIAERMTKEITALAPSSMKIKVVAPPERKYSVWIGGSILASLSTFQQMWISKGEYDESGPSIVHRKCF

SEQ ID NO: 3799 - protein, 215 aa, Zea mays
MHKLGRGSRDKVQQFMAITGASEKVALQALKASDWHLEGSFDYFYSQPQISVTNSRHLEDLYSRYKERDADMIMVEGTSQLCNDLLVDPQDVVMLVISWHMKAATMCEFTRQEFIDGLQSIGVDSIEKLREKLPSLRAEIKDDNKFREIYNFAFAWAREKGQKSLPLETAIGMWRLLFAERHWPLIDHWCQFLQVRHNKAISRDTWSQLLEFVRQ

SEQ ID NO: 3800 - protein, 475 aa, Xanthomonas campestris pv. vesicatoria str. 85-10
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 3801 - protein, 127 aa, Prochlorococcus marinus str. MIT 9313
MLNATARRGMSKAPQRVERPWGWYEDLLEGEGYKVKRFLVFAGQQLSLQRHQHRSENWTVVSGQGQLFCKNTWHDAQAGTTLYIPLGVLHRARGGQSDLVVIEVQHGQLLQESDIERLEDDYGRVIS

SEQ ID NO: 3802 - protein, 733 aa, Zea mays
  misc_feature (699)..(699): Xaa can be any naturally occurring amino acid
  unsure (1)..(733): unsure at all Xaa locations
MEEVLSAHLAVAVALLLLLAAKRTPAVAVPSPQCQRQCGGVDIVFPFGIGENCSLSAGFNVSCQEVQVQGGGVVYRPFLGNVELLNISLIHGTIRELNHISTYCYDSSSSSMELSTWCFDASETPFRFSDVQNKFTAIGCQTLAYIMDNTDKSYQSGCVSTCQSLSDLADGSCSGIGCCQTDIPKGMGFYNVSFDTGQISPSGLGRCSYAVLMEAAAFSFRTTYIDTTDFNDTSAGQVPVVMDWAIRDGPPSCELAKRNEETGSYACLSGNSECVDSPNGPGYLCNCSSGYEGNPYLPHGCHDVDECKNSPCPSGGVCHNTVGGYRCSCRVGRKINERSNTCDPDTTLITGVTIGFLVLVIFSSFGYMILQKTKLNQVKQEHFRQHGGMILFERMRSENGLAFTVFSEAELVKATDNYDKSKIIGKGGHGTVYKGIVKGNVPIAIKRCALVGERQKKEFGQEMLILSQINHKNIVKLEGCCLEVEVPMLVYEFVPNGTLYELIHGKNQASQTPFCTLLRIAHEAAEGLSFLHSYASPPIIHGDVKSANILLDGNYMAKVSDFGASILAPSDKEQYVTMVQGTCGYLDPEYMQTCQLTEKSDVYSFGVVLLEILTGQEPLKLDGPETQRSLSSKFLSAMKENNLDAILPSHVNGQGSDELIRGLAELAKQCLDMCGSNRPSMKEVAYELGRLRKLSLHPXVQIDADMIETQSLLSGTTAASFEIEVGTVADYAR

SEQ ID NO: 3803 - protein, 1646 aa, Anabaena variabilis ATCC 29413
MVNMKTVENQEPLDGVAIVGMVGRFPGAKNVQEFWGNLCAGKESTTFFQDEELDPSIDPHLVQDPSYVKARGIIPGGETFDAAFFGINPREAEVMDPQSRVFLELVYEALENAGYDAEAYSGLIGLYAGCGQNTYFANHICGRQEIIDRVGEFQTMLANEKDFLTTRAAHKLNLKGPAVSISTACSTSLVAVIQACQSLSNYQCDMALAGGVSMTTPQNSGYIAQEGTMLSGDGHCRPFDAKSQGTMFNNGAGLVVLKRVEDAIQDGDRIYAVIRGFGINNDGADKVSFTAPSVDGQAEAIAMAQAYANFHPETISYIEAHGTATSLGDPIEIEALTQAFRIHTNSKQFCAIGSLKSNVGHLVAAAGVAGLIKTALALYHQQIPPSLNFEAPNPNIDFANSPFYVNTQLTPWPQGETPRRAGVSSFGVGGTNAHIVLEEAPAILPSNLSRPSQLLLLSAKTSTALETATVNLQEHLRNNASINLADVAHTLQRGRKAFNYRRFVVCQNTKEAITTLQSLEPKRVFTRHTQVRDPEIAFMFPGQGSQYVNMGFNLYSREIVFRQVVDQCAEILKPILGRDLREIIYPVATDIETASTALQQTCFTQPALFVVEYALAQLWQSWGVKPQAMIGHSIGEFVAACLAGVFSLEDALMLVANRGRLMWELPRGAMLSVRLSAPEVEKRLAGELAIAAINSPSLCVVSGTTEAIAAWQTQLETAEIVCRLLHTSHAFHSPMMEAIVAPFAELVGKVKLSPPQIPFVSSVTGDWITPEEATNPMYWAQHLRQTVRFADGVKTLWQQPERLLLEVGPRTTTTTLARQQAKDIKQQITIASLSDNADNEAEWTALLQAMGQLWLAGVTINWNNFYQEERRQRIPLPNYPFERQRFWIDPLPHPNRNTNHKPAHYQLEKTQTMSAQTTLISLLKEIIEETSGLEIASVDASTTFLEMGLDSLSLTQVGLALKKKFKVKVSLRHLLEVYPNLATLADFLQQNLSAEALSALVPSETTSPSATLSLQEVSTNGSNGKNGKNGSTPSPMLLVPPTSTNGNGSKNGSLPQVSLPNVASSALEGVINQQLQIMAQQLALLGNNSQPVTVPAVNGQNNGVKSEKPVTQSNQKPEPQDSTENLPKKVFGAGARIETTQTKTLTPQQRTYLDSIIQRYTQRTQKSKEYTQTNRPHLADPRSVSGFNPTMKEMVYPIVVSRSSGSKLWDIDGNEYVDLSNGFGLNLFGWSPAFVTEAIEAQLKLGMEIGPQTPLVGEVAKLMCEITNFDRAAFCNTGSEAVLGAMRLARTITGRNLIAIFSGGYHGILDEVIVRGTKKLRSIPAAPGIPQEKVDNILVIDYDAPDALDILKSRADELAGVMVESVQSRRPEYQPREFLQQLRQFTEQEDIALIFDEIVTGFRIHPGGAQAHFGIKADIATYGKIVGGGLPIGVIAGKSKYMDALDGGFWQYGDDSVPEVGVTYFAGTFVRHPLALAAAKAVLQHLLKNGPSLQQQLNAKTDQFVVELTDYFQQMQAPYTVHNFGSLFMVKSAPEFLYGDLLFYLMRDKGVHIWDHRPCFLTTAHSDADLSLAMAAFKESIAEMQSAGFFSAPTPTTKGSPESSKNLRNRPPQPGAKLGRDPEGNPSWYVPDPQRPGKYLQVSSVS

SEQ ID NO: 3804 - protein, 178 aa, Arabidopsis thaliana
  misc_feature (85)..(85): Xaa can be any naturally occurring amino acid
  misc_feature (101)..(101): Xaa can be any naturally occurring amino acid
  misc_feature (110)..(110): Xaa can be any naturally occurring amino acid
  misc_feature (131)..(131): Xaa can be any naturally occurring amino acid
  misc_feature (137)..(137): Xaa can be any naturally occurring amino acid
  misc_feature (140)..(140): Xaa can be any naturally occurring amino acid
  misc_feature (144)..(144): Xaa can be any naturally occurring amino acid
  misc_feature (146)..(146): Xaa can be any naturally occurring amino acid
  misc_feature (161)..(161): Xaa can be any naturally occurring amino acid
  misc_feature (173)..(173): Xaa can be any naturally occurring amino acid
  unsure (1)..(178): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEXVDYLLRNKWIPCVEFXELEHGFVYXREHGNNSGYYDGPVLGQMWEXPLVGCXDFXQVVXKXVEKCQKGDPGPFIKXIRIHNTRQVQCXNLLLQ

SEQ ID NO: 3805 - protein, 319 aa, Acidovorax sp. JS42
MAIQWFPGHMHLTRKAIGERIKDIDVVIELLDARLPGSSSNPLLAELTGHKPALKVLNKQDVADPARTPAWLAWYNARPGTSAIALDASDAAPARRLIDACRQLAPNRRGLSKPMRVLICGIPNVGKSTLINTLSAKREAKTGDEAGVTKQEQRIVLDDDFYLWDTPGMLWPRITVPESGYKLAASGAVGRNAYDEEEVALELLAYLKQHYAPLLDARYKLGLDAAAIAAKHDDELLELIARKRGAVMSGGRLNLQKAAEIVLTDLRSAALGRVTLETPAEFEAWLAAAEVQEKERAARKAEQLRRNERRARNAPRDED

SEQ ID NO: 3806 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 3807 - protein, 282 aa, Mycobacterium sp. MCS
MSTVPTVTLNDGASIPQLGFGVYQVKPDETANAVKTALDIGYRHIDTAEMYQNERGVGEGIRDAGIDRAEVFVTSKLNNGFHRPDDARRAFDKTLSELGFDYVDLFLIHWPLPTLYDGDFVSTWQTLEEFKKDGRARSIGVSNFQVDHLERLARETETVPAVNQIEVHPYFTNDAVRAYGREHGIATEAWSPIAQGQVLDDPTVTRIAEASGKSPAQVVLRWHVQRGDIIFPKSVTPKRIEENFDLFDFELGEADVDALSGLDKGEQGRIGPNPDTFDYIPD

SEQ ID NO: 3808 - protein, 565 aa, Xanthomonas campestris pv. campestris str. ATCC 33913
MHHDTSLIDIIAVGLAVAFVLGTLAQKVKLSPLVGYLLAGVCVGPFTPGFVADQTMANQLSELGVMLLMFGVGLHFSLDDLMEVKWIAVPGALAQIVVATLLGWALAWSMGWPLMQGLVFGLALSVASTVVLLRALEERRLLETQRGRIAVGWLIVEDLVMVIALVLLPALANVLGGSAGAAEHAGESTSLLAALGWTLLKMVAFVAVMLVVGRRVIQWSLEKVAATGSRELFTLAVLGIALGVAFGSAKLFGVSFALGAFFAGMLLKESELSHKAASDSLPLRDAFAVLFFVSVGMLFDPMILIAHPWQVLATFLTVTVGKSLAAFVIVRAFGHPTGTALTISTSLAQIGEFSFILAGLGVQLAILPETGRDLILAGALLSIVANPFLFSWLDRWQAKQAQDAPATVEPELPPGPPLQLDGHAIVIGYGRVGSALAQLLRSRGVPVLVIDDNGDHVAKAHAAGIPGIRGSAAADRVLAEARPEQAKIAILAIPQPLEAGEALAKLRALNPSLTLLARAHSDAEVKHLLEHGADGAVLAERELAYSLAEMVMSTPPYRALRVPAS

SEQ ID NO: 3809 - protein, 283 aa, Nocardia farcinica IFM 10152
MTFRSETSAVPSIVLNDGNVIPQLGFGVFQVPPDDVFDVVTTALRAGYRSIDTAAVYGNEEGTGRAIRAFGLPRDEVYVTTKLWNSEQGYDSTLRAFDDSMSKLGLDYLDLYLIHWPVAAAGKFVDTFRAFQELKRQGRVRSIGVSNFTVDNLRTLIAETGEIPAVNQIELHPALAQRELREFHAENAIATEAWSPLGQGTLLEDATITRIAQEVGRTPAQVIIRWHLQLGNVVIPKSVTPARIEANFDVFGFELSREQMAAIDGLDRGGRIGPDPDTFSAGL

SEQ ID NO: 3810 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 3811 - protein, 217 aa, Zea mays
  misc_feature (205)..(205): Xaa can be any naturally occurring amino acid
  unsure (1)..(217): unsure at all Xaa locations
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGXQKGVNLPAAAVD

SEQ ID NO: 3812 - protein, 145 aa, Arabidopsis thaliana
  misc_feature (12)..(12): Xaa can be any naturally occurring amino acid
  misc_feature (47)..(47): Xaa can be any naturally occurring amino acid
  misc_feature (53)..(53): Xaa can be any naturally occurring amino acid
  unsure (1)..(145): unsure at all Xaa locations
MASSMLSYAAEXTSPAQATMDAPFTGLKPSDALPDTHKANIASVASXGNGGRXICRKARPPSGKKKKETLSYLPDLTDVELAKEVDYHLHNKRMTCAENEMEHGFVYREHGNSPGYYDGRYWTLWKLPLIGCTDSAEVLKEDEEC

(The sequence listing continues in the following parts.)

We claim:

1. A plant cell nucleus with stably integrated, recombinant DNA comprising a promoter that is functional in plant cells and that is operably linked to DNA that encodes a protein having an amino acid sequence with at least 90% identity to and the activity of SEQ ID NO:213, wherein said plant cell nucleus is selected by screening a population of transgenic plants with said recombinant DNA and have the level of said endogenous protein suppressed for an enhanced trait as compared to control plants that do not have said recombinant DNA; and wherein said enhanced trait is selected from the group of enhanced traits consisting of enhanced cold tolerance, enhanced heat tolerance, or increased yield.

2. The plant cell nucleus of claim 1 wherein said protein has at least 99% identity to SEQ ID NO:213.

3. The plant cell nucleus of claim 1 further comprising DNA expressing a protein that provides tolerance from exposure to an herbicide applied at levels that are lethal to a wild type of said plant cell.

4. The plant cell nucleus of claim 3 wherein the agent of said herbicide is a glyphosate, dicamba, or glufosinate compound.

5. A transgenic plant cell or plant comprising a plurality of plant cells with a plant cell nucleus of claim 1.

6. The transgenic plant cell or plant of claim 5 which is homozygous for said recombinant DNA.

7. A transgenic seed comprising a plurality of plant cells with a plant cell nucleus of claim 1 having the recombinant DNA.

8. The transgenic seed of claim 7 from a corn, soybean, cotton, canola, alfalfa, wheat or rice plant.

9. The transgenic corn seed of claim 8 wherein said seed can produce corn plants that are resistant to disease from the Mal de Rio Cuarto virus or the *Puccina sorghi* fungus or both.

10. A transgenic pollen grain comprising a haploid gamete of a plant cell nucleus of claim 1, wherein the gamete comprises said recombinant DNA.

11. A method for manufacturing non-natural, transgenic seed that can be used to produce a crop of transgenic plants with an enhanced trait resulting from expression of stably-integrated recombinant DNA in a nucleus of claim 1, wherein said method for manufacturing said transgenic seed comprising:

(a) screening a population of plants for said enhanced trait and said recombinant DNA, wherein individual plants in said population can exhibit said trait at a level less than, essentially the same as or greater than the level that said trait is exhibited in control plants which do not express the recombinant DNA, (b) selecting from said population one or more plants that exhibit said trait at a level greater than the level that said trait is exhibited in control plants, (c) verifying that said recombinant DNA is stably integrated in said selected plants, (d) analyzing tissue of said selected plant to determine the production or suppression of a protein having the function of a protein encoded by nucleotides having a sequence selected from the group consisting of one of SEQ ID NO:198-394; and (e) collecting seed from said selected plant.

12. The method of claim 11 wherein plants in said population further comprise DNA expressing a protein that provides tolerance to exposure to an herbicide applied at levels that are lethal to wild type plant cells, and wherein said selecting is effected by treating said population with said herbicide.

13. The method of claim 12 wherein said herbicide comprises a glyphosate, dicamba, or glufosinate compound.

14. The method of claim 13 wherein said selecting is effected by identifying plants with said enhanced trait.

15. The method of claim 14 wherein said seed is corn, soybean, cotton, alfalfa, wheat or rice seed.

16. A method of producing hybrid corn seed comprising:

(a) acquiring hybrid corn seed from a herbicide tolerant corn plant which also has stably-integrated, recombinant DNA in a nucleus of claim 1;

(b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA;

(c) selecting corn plants which are homozygous and hemizygous for said recombinant DNA by treating with an herbicide;

(d) collecting seed from herbicide-treated-surviving corn plants and planting said seed to produce further progeny corn plants;

(e) repeating steps (c) and (d) at least once to produce an inbred corn line;

(f) crossing said inbred corn line with a second corn line to produce hybrid seed.

* * * * *